United States Patent 11,001,841 (CCCTC-BINDING FACTOR (CTCF) RNA INTERACTOME) - sequence listing, part 11

SEQ ID NO: 26530 - DNA, 1049 bp, Homo sapiens
gcttttccatgcttcaggcctcctttccagttccttccatgggggcctaaactcgattcccttattaggaggtgggtacctggccccttcggggataatttagggaagttatgccacctctgtggtagcaactgaaaatgtggcccatggaccagcagcatcacatcacctgggagcttgagaaatgtagaactcacccctgtcccatactaactaaataagcagcaacgttttcacagcacacccaggtgaccccttatgttgtctccacatctttcaatacaacacagtcctaacaccttagcccccagccccaagactaaaggagggaacattctcctgatgtcctgccaggctccgactcatggtattgtgggatctgcaggtggcctcacttaggagaaactctgggctggggctgctggaggcagagactgcagcatgctgctgcttccaccggggcttagcaggtgttccgtgcccttcatgagggtgtgtcttaattttccttctcactcaatgatgttctcagggccccctggggttgccaagacactacttttcactgcactggacatttgtgttcctgcagttcatatcctcttcccttgtggctcttattttctgccatcatttcagactatggcatcatgcccctgcttctgggtgagagtgtgtgaagaggggggggaagaaagacttctaccatgcagagggtgacctgacttcctgtattgcggttgtaacttaggggagggcctcaggttgtcagaggagacaggaaaagcaggagttgggttataagtgcaatcagatcagatggagaggtggcattaaagtgaatggattttcttttcctgtgtctgtgagtaggagaaatgttttagttacttgctgcatcatggatgtggtagccagggctgtttaattacctgagaagtggggctaattgtatcttgaacagtgagtcactttcctggcataattttctctgtgcccaatcattaccatataaaagttgtcagtgctggccctcaggagtgggattt

SEQ ID NO: 26531 - DNA, 1033 bp, Homo sapiens
tctgatatttggcacttcgttgattggtagaaaaatcgttttggccaggcgcggtggctcacgcctgtaatcccagcactttgggaggctgaggagggcggatcattaggtcaggagatcaagaccatcctggctaacacggtgaaaccccatctctactaaaaatacaaaaaattagccgagagtggtggtgggtgcctgtagtctcagctactcgggaggctgaggcaggagaatggcgtgaacctgggaggtggagcttgcagtgagctgagattgtgccactgcactgtgagactccgtctcaaaaaaataaataaataaaaaagaaaaattgttttacaaaaagttctggcacagagagaagttaagagtcagtaactttcttactgtttgtggatgtgtttgaacagagtagtgacttttggatttcatagtgacttcgtatgaaacctagagctggcagcatgaggattttctagatgaattaaatatgtggtatctttttgtagaactagctgtgtgatttcatgcggatgtgggagaaatgaataggaatttaatttgatgatatgaatgttgaattttgtggtccgctaaattttaaggattttatagtatttagaacaaaaggacaaaatagcttttggcatgactagtctttattttaaatgttttttaagttacaaatgtataatatttatgaatcaagtagatgaaaataactcccaactttcattgcccagagatggcctgtatggccagtttggtgtgtatccttgcagatgtttttctatgtatacatctacataaagatttttccaaaatgtaataattttacatgtaatgtggaaactatacgtattgttctgcaatctgtaaattttacttcttcaaagtaatatatatatattacttgggtattttacttctgtatattttctgtaaatatttttagtaaagtatacacattataaatattcacagctgtcattccaggctatttctcagagatccacctcctttaaaaatg

SEQ ID NO: 26532 - DNA, 1092 bp, Homo sapiens
agcaaaagaaaccaccatcagagtgaacaggcaacctacagaatgggagaaaatttttgcaatctactcatctgacaaagggctaatatccagaatctacaatgaactccaacaaatttacaagaaaaaaacaaccccatcaaaaagtgggcgaaggatatgaacagacacttctcaaaagaagacatttatgcagccaaaagacacatgaaaaaatgctcatcatcgctggctatcagagaaatgcaaatgaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccattccattactgggtatatacccaaaggattataaatcattctgctataaagacacatgcacacgtatgtttattgtggcactattcacagtagcaaagacttggaaccaacccagatgtccaacaatgatagactggattaagaaaatgtggcacatatacaccatggaatactatgcagtcataaaaaaggatgagttcatgtcctttgtagggacatggatgaagctggaaaccatcattctcagcaaactattgcagggacaaaaaatcaaacaccgcatgttctcactcataggtgggaattgaacaatgagaacacatggacacaggaaggggaacatcacactctggggcctgttgtggggtggggggaggggggagggatagcattaggagaaatacctaatacctaatgttaaatgacgagttactgggcgcagcacaccaacatggcacatgtatacatatgtaacctgcacattgtacacatgtaccctaaaacttaaagtataataataattaaaaaaaaaaaaatcccaggctcgtgattctgccctaattcagtattttcttccacttatatcacattgtttccttgttggtggaaaggcagatgttagaaatattattgactcg

SEQ ID NO: 26533 - DNA, 1019 bp, Homo sapiens
tggtaccttcgctggcgctagggtaagggagccggagcactgagtgtgttctgatctcccagacctttataccaggctgccttgctgctgcagtgggttctttgatcttgattagtttgtttgttgttgtttttaaaatactaaatgatgtctgaaatgctttgtctcaagacagggctttgattttcatttcatttcactttcttttttaataaatagaaaaatgtatatagaaatgttcttttgtattttgtatttttttttttttgataaagggtctcactctgtcacccaggctagagtgcagtggtgcaatcatacctcactgcagcctcgaactcttgggctcaagtgatcttcccacatcagcctcctgagtagctgggtctataggtgcaaaccatcatgcctgcctaattttttttttctttttttatttttaagaaatgggggtctcactatgttgcccaagctgctcttgaactcctccgctcagcgatgctccggccttggcttcccaatgtgttgggattacaggcgtgagccactgtgcctggcctctttatatatatatatatatatatatatatatatatatatttttttttttttttgtaagagtcttgctctgttgcctgggctagattgcagtggcgccatctcagttcactgcagcctctgcctcctaggtccaagcagttctcctgcctcagcctcccgagtagctagtattacaggcctggctaatttttgtattttttgatagaaacagggtttcaccatgttggccaggctggtcacaaactcctggtctgaagtaacccgcctgcctcagcctcccaagttgctgggattacagcgtgagtcactgtgcccggcctcttttgtattatttttattgtggtaaaatatacacaacaaaaattgtaccattttaaccgttcttaaagtgtgcaattcagtagcattaattatatttacaagataaatactcttttaaatgtgctgtcatggggctg

SEQ ID NO: 26534 - DNA, 1054 bp, Homo sapiens
gtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggcggcacaggctgtcggctggcccatctgcagggacgcgtacgagctgcaggaggttatcggtcagtgcggcgggcgcggcggggccggcacaggccgggcgccgaggccgggcgggagggggcgcgggatgctgggctagcctgcatgcacgccctggaggcagagaggccggcttcggggcctactggcttcaacagttttttttttttttttttttttttttttaatttttaatgtatttgttcgttctatgagcgttggtgctgcaggaggcggcgcggcggatgtgactcgcactgcagacgagccgcatgctgcaaacttttatctcagggatcgccggggcggtggagcggaggaccaggcggcgccgccgcatcttcctccccccgcgtgccgggaccgcagcccgtggccggtggccacgcggacaggcagccgcgggtggggtgtggttgcgggggccccgccctgggtttccagggccccgggggccgcgtcctgggggactctgcgggcgcagccgctcctctgcctcccgtcgtgaccctctcgtcgtgggtaacggggccacgtagaagccgcggaggccccagtgcttttctgaggccggggaggatgctggcctctcttcctgacagccgccactccacgcccgccttgcagcccggctctccgcgccactcggcgcgcccgggtacccgcctccctccgtgccagggtgcgccgcctgccgcccagtccggctccccggggaaagcgggtgccctggcctcctgccctgcaccgggccgatgcttccctctgtttcaggccgagctgcaagagtgaaatccgaggctgccggtgatctgctctctgcctttc

SEQ ID NO: 26535 - DNA, 1032 bp, Homo sapiens
tgccaggagtgtgtggatggaggtgtgaggagaacggaggtttagatcagcttctggtgggaatcaagactgctgagcaggaaaccaggaagaatttgctgagcagcacagagcatcagctcaggtgatcatgagcgcttctatgtgagatgagaaaatgaatgccccccgcttgggtgttcagcttcaggattaacaaaagctgccagattaagcagtgaagatggcatgggtgtatgacagagtaacagccaaggttatggttaccagctggaggagaggagagagcactgtggatctttacttcccagggaagctgctgatgggggtaggaagaggaaattcaccacttagctgccatgcttttttctttattattgcatgacatcaataaagaatagcttctaatgagcactcagaatgcctaggcaggtcctggcactgagtattttaacagactgggttcgcctcttcggaagctgcctcattattcaatacttgttatgatcatttccaactgtgaagactgacatggaaagaaataagagtcttgtaaaatcttgctaacaatgaatttaagttattcaatggatatttcttcagatgaaagagctactggtgatgacaattttctcttcctttgtaaggggtttgcagtggtgctggttgcatttccttagtggagactcatcttttgtagaagatatcgactatttcaaaggttttcaatctgggacacataccacaagaggggtgcaagataatctattggggtgtaagcagaaaatgttcattttgttcctgtaccccaatattattcgtgttcattttgcctgaaaacacagttgtcaagcttactcttatttaatatatgagtctacactggtgctcacacatggacagttgtggattctgatatggcctgggggaagggtggggattctgcaacctgaaaagctgccctaggccctcactgtgttttcccttccagcatctgggacatgtggccattgacatatacctgggccatgt

SEQ ID NO: 26536 - DNA, 2964 bp, Homo sapiens
tttccttctcctgcctgattgccctggccagaacttctaacactatgttgaataggagtggtgagaggacattcctgtcttgtgccagttttcaaagggaatgcttccagtttttgtccattcagtatgatattggctgtgggtttgtcagagatatcctaccatcccctaatttgggttgatctcattggtgtcttgattgcctgtctctcttcttggaattgatctgtgttcctcatctcccaggctctgcttgaccccctcataggcctgctgtgttctgttgccacccaaatccagaggaaaaagacatctaagtcccactgctgttgtctaccagataactctgacttcaggcaagcagctgaacccaccttggactccgtctgtttctgtgacaccaggggttatactggatcatctctagggtctcctagaatttggaaactcctctaggaaccaaggagcctcttccttgtctgtctccacccatccatcttttttctgactgtttcaagctaataatcatgaatgcaaagtgctgtgacatgcaggtagaactccatccatttcaaaagaaaaacatgtaaaggtaagagcactttattcttatttgaaccacactgtattgttgattaccgagtgtgaaggtagtatgttcagagtcttgttttatgcctttgtagctgtgttgccagcatttgaaggtaactcctccacataagcggcaggaaaatggccttttttcccattcaaagatccaaaccaccatcctccttcttttttctcgtgtataatcacaatgtcacctgtgaaaatacagttagacaaatgggtctctgtgatgtgaacacatgcctcagcccgattgataagagttttaaggaggttctgcttcaaggatttacttggtagtgtcattttctgcacttgattcagatgaagccaaatgtatcgaacacctgtgtataaagcaggcataatccagaggatactaaaaagagtaagataatgaacaactgagatatatcataaaataattgcttaaagacaggattggctgggcgtggtgggtgacgcctgtaatcccagcactttgggaggccaaggtgggtggatcacaaggtcaggagtttcgagaccagcctgaccaacatggtgaaaccccttctctgctaaaaatacaaaaattagctgggtgtggtggcgcacgcctgtaataccagctactcaggaggctgaggcaggagaatccttgaacccgggaggcagaggttgcagtgagctgagatcatgccactgcactctagcctgggcaacagcaacagggcaagactctgtctcagaaaaaaaaaaacaggatcacagccaggcacggtggctgacagctgtaatcccagcacgttgggaggccgcgatgggcagattaggcagattacttgaggtcaagaggttgagaccagcctggccaacatggtgaaaccccgtctctactaaaaatacaaaaattagccaggcatggtggcacacgcctgtagtcccagctatttgggagactgaggcaggagaatcacttgaatccaggagacggaggttgcagtgagcttgggagactgaggcaggagaatcacttgaatccaggagacggaggttgcagtgagctaagatcacaccactgtactgcagcctgggtgacagagcaagactctgcctcaaaaaaaaaaataaaaaaagatcacgttggatcatatatccttatgctgcctggctcactttctatttctatgtagctgatggattgtcaccaaactctttcttggtgtccgtactttgagggtttcacatgctggtgtttttgattgtttggcgtgttggctgctataagtatgtctcaccaacagtcttttcttaagatcaagacaatgtctctgcattatccctgatttcacaggccaaaagtttaactcactcacagctttgcacagaaatgtaactccccattcaaaatgtaactccccattcaacaacttagacaactttaatacaacatcaatttggagacaatattttttaaagcaatgattcaaataaagagaattccatagagaattggacaagaaacatggctcttgtcataaaagtagaaagatctgcccccttcaggatcatctgcccccgtcaggatccaagagctactttttatttggcatcattctgaggtgatttttcagtcttcctttcactcttttcctcagcaactttctttctaagacaaaggaaattattaactccttttctatcttttctacattttcttagtcataaatcactattcttaaaggacattattctcggtctctaagttctccctcgtcagtaaattgacataatctattaacaagaattcaaacaaataatgatttcaaattgtattgccagcttccctaaggctccaacgtcgtgtttcatttaaagaaactgcttagaatataaagtataagtaggctttgcaaccaacagagaactgaaaacaagataatcaatttattgtgaatgatgtaacttaaatgctgcatccatgggttctaggtggcatctgggaagtatgtctgtcttttattcacataggaagaaaagtaattgcctggagagatatgactggcaaatgctgcaaaggaaacacccaataaatagcaaatgtgtggtgtccctgtcgtttggctacaaaatgtatcttgattttccattggctctgggagccatgtccttgtcgtggataatattctttctcccataacgttactctttctcactaacccttccgtttccagatctctgcattagcgctaacattcaaacatggtttctaactggacacataaagaaggttgaggctggagactttcttctttaataatgttgtggtttacattataaagccactacgtaatacctttccatgtt

SEQ ID NO: 26537 - DNA, 1077 bp, Homo sapiens
tataaaaataatgaaaacatcatttttagcttatgaaagttgtgtaatgattaatcatttcatactttgtcttaatatgtgatatatcttatacatatatcttaacccaaaacttagattcaaaagttttccttttctcagagaggaattttaaaaccccactcttgatggggatcaggataaagattaaattatttttgaaaaaggaacttttattatctattaaggagataagtgaactgatagtttaagatattatgggaatgtttaaattacaatgtgtagacagttttgagaactttggaagatactgtttacttattcacttatacattcatccattaatgcagtcatatggtcatccatttagttatcaaacatttattgggcaactattttatgccaggctctgagtaccaggccctgggacacaataatgagcaaatcagacacagtcattgacctttgggagttaaaatcttatagggaagagagacactagtcaagtaacaactgataggattatacattggatttatttattaaagtctcaataaatactaggcaacactttgtagtgttgttttatttttggaacattcttaaaactagtaagctgcctttcacaagaatagtctcaatgatttttttcactttttttttttcaaaactcaactctcctttccctgagatcagtgtgagtgaggtttgtctgtgtgtagaagtggaagaacttcctgtctgtgaggtttagcaaacatgggtggtttattagtgtaagtaaggacttaatgaagagtaagataaataccaacctgccttgaaaaagtccagacagcgttgtatgtggggttggaggtcttgtggtccagcagcccactgaaaccctgggaaaggcccatgcttgtctgatgaagtacattatatttattgctgcaatgctgcaatgtcattttagcccatatgatggtaacaggctattgccttccattactctaaatgtctgggaatagtgggatatgattttgactgatattcttctattttcacagatgatcaacctttcttaataactgt

SEQ ID NO: 26538 - DNA, 1075 bp, Homo sapiens
tagagatggggtcttgccatgttgcccaggctggtcttgaaacatgggcctcaagcaatccttctatgttggcctcccaaagtgctaggaccacaggcatgaaccactgtgcctggctggctgaatatgaacttttagactgccatattagtgcatcataatagttgctatttggaactgttgatgctcctgactgacccccacagtctctttaaaaaaaaaaaacaacttaatttccctgttgttttatactgtggttctctaatcagctggataaaatttccattgatccaaacacactgttaaaaaaaattcccaggttaacttgtaaaataccagattctttcatcttctgtttttcttttgtagttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggtaagaagtattttttatggcttatggctttataagttgcagggaaagtgcataaaatggctgcagagaaatatcaaaggaccagaattaaaatattgctttgttggtggacatgatagctttaatgacctttgtactgacatttgcatgaagtgacctgctctattttgttaacttttcttgtgtcccataacacaagaggtaaacgctcattaaatataacctccagcatttgttctttgatttctcctctccaactcttcccctagtcccacatgatgcacattattttcattcactcctgagttcatttgtgctttgtttctcaagatcactttcccttttaattttctaaccttcccccaataaatacatgttttattaggtatttgatgttgcctactgggaattaattggattttactctgctcttatatatttcaaatttcaaggagaaattctttgtattgtatttttacctggtatacaaagatactta

SEQ ID NO: 26539 - DNA, 1055 bp, Homo sapiens
ccatgcccggctgaaatcatttattttgtcaggaaattcttaaagttgaatttaagaatgaaagtattttatcagaaatatggcaatcctacccacattttaatctcactagaaggggggtgatacatgctagcatgtacttccacactggtttaattttgatgtggggaagggtgtggagaatactttttgttgcaagaaacagaaaacccaactcaaaatggcctacacaataaagggtatttcttggcttatgtgagtaaaaaatactgaggcagagtggggttcaggcgaggtgcagtcagggctccagttctctttctttgtgttttccttgaccctactcccccctaagtttcacctttgtgtgcggtctggcttcccatatgattctgatatggctgccagggcaaatggggctacgtgtttccttgatcctatccagggggaatccaactttgagaaggttttagttatgttctcaaaagtattatttcatcacaataacttacagattgttagaatttctaaggaccctagacaaagtcagctagctccccaaacttgacatatcatcaaaatcacctgaggaacttaaaaaagtatagagattcttaaatcaaaactcacccttactaaagcaggggtatgaaaatctgtgttttttaaaaattttattttattttactttcagttctgggatacatatgcagaatgtgcaggtttgttacataggtatacatgtgccatggtggtttgctgtacctatcaacctttcatctaggttttaaggctcacatgcattaggtatttgtcctaatgctctcccttcccttggcccccaccccctgacaggccccggtgtgtgatgttcccctctctgtgtgtgatgttcccccccctgtgaccatgtgttctcattgttcatctcccacttatgagtgagaacatgcggtgtttggttttctgttcctatgttagtttgctgagaatgatggcttccagcgtcattcatgtccctgcaaatgacatgaactcattcctttttatggctg

SEQ ID NO: 26540 - DNA, 1051 bp, Homo sapiens
ctactcgggaggctgaggcaggagaactgcttgaacacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatggataggaaaggggttctcaaggttgactgcacgaatctagagcaactaaaaaaatactaattgtgaagccctattctagcatggaaaaaataagcttgatggaacctttggtataaatcaaatggttctatcgtatcctattaactttatagtcttgagtaattaaaaatttttaccactattgtgtattctgtgaatgtttattttattttttccatgaatatttattaaatatcaacagtgtgctgatgagtcaatagtatcaatactacagaaacattaaggaagatgagaactgaaaagaggtgtctacatatctcgcaattaaaatggactgcagttttgcatttaagattctgaaatagtcattgactcattcctaataaccctgcccaggatctcaccagcattagaaagattggagatgtttcagcatccgagttctgggatgcttcttgataatgatcagctagtagttgttttgaaatgtcaagagcatttctgtggttcttcacatgttcctaatgcaaatgtttccgaagtaatttcttgacagttacagtgttttgagatgaagtgggaagggcttgtgattttgaagttggaggatcttggtttgattcctacctctgccatttattatctgggaaatccagtaccacacatgctgggtgctctggggcagttttcttatctgtaaaatggacatatatctacctcacggggtggttatgcaaaggcaatgaatgtgaaatgtttaataaactgtgaagtctcatatagatttccattcatcattattacccaatacgaga

SEQ ID NO: 26541 - DNA, 1029 bp, Homo sapiens
gctaggataacaggtgtgagctaccacgcctggcctaaggtcccactattattattaacacattgatgattatgtttcaacagatgaattttgggggacacatttagatcatagcagtttataactttatatgttgtgaatatttttctatgccaacagatatgcttatacaacatcttttttagttactgcatatttcattgagtatgctatgatttaatcaatctgtaagatttttttgctggtatgtccatctgtcaaacaatgctgcaatttcatataacaacaataataggtttatttttatatattgcttattatgtgttagacaccattttaagtacttcgtaagtacttgtgtgtgtgtatgcatatagtaaacttatatccctatgaagtatgtaaattatttgcagatgaggagactaaagtccacaaacattattgattgcccaaggttatatacctggcaaatgacagagccaggatttgagcttggcattctggctctagaattcattctcttaatgaattctatatatttcatctttcataattaatttaaagatggttcagtgcctgagtttttcaccagagttccatctgattcttttcaaatcacagacatcatttcaggaagtatatttaaaagataagaatgacttaaaaaacataacaacaatatcatctttatcatcctataaccattaataataatttcttaatatcttttaagaaatgttcagcaatatgggaaatttaacgtaagtagacagatgggaaattttagataaaatttaacattttattgaaatgttagatttggcatactataatgaactcaatgatcaaggattgaaggtagtagaattatgggaaatgtcacataagtagagagatatgggaaattttagataaaattgaacatttatgggaattatgggaaatgtaacataagtagggagatatgggaaattttagataaaatttaacattttatcgaaatgttagatttggcctactataatg

SEQ ID NO: 26542 - DNA, 1075 bp, Homo sapiens
cacctgtaatctcagcactttgggaggccaatgctggcagatcacttgaagtcgggagtttgagaccagcctggccaacatggtgaaaccccgactctactaaaaatacaaaaaaaaagggccgggtgtggtggctcatgcctgttatcccagcaccttgggaggctgaggcggttggatcacttgaggtcaggagttcgagaccagcctggccaacatggtgaaaccccgtttctagtaaaaatataaaaaattagccgggcgtggtggtgggcacctgtaatctcagctacttgggaggctgaggcaggagaatcgcttgaacctgggagactgaggttgcagtgagccaggattgcgccattgcactccagcctgggcaacaggagcgaaactctgtctcaaaaaacaaacaaaaaaatacaaaaaataattagccgggagtgatggcaggtgcaatggtgggcatctctaatcccagctactctggaggctgaggcaggagaatcgcttgaacctgggaggcggaggttgcagtgagctatcatgctcctgcactccagcctgggcaacagagtgagactccatctcaaaacagacgaagaaacacacacacgaacaaactttattggaaccgttttttgtcaccaagtactgttaaaatctcagtgctaaagcaataaaacagttgggtttaactgagtctgtcttcaaggaatttatattgcaattgagaggatagatataattgaaatatgtaaatactgtaacaacatagtttatgaagaaacaataaaattagtgatatggatagtgctgtgagcagacagaagtgagagaaaaatatagactgaagtggttgggaaaagtttgtggagaaactgggtttgaaacctttgaaaaggttggtggaaaggatggcatggagttatccatgtgaatagacaattagtttatcctatcagatgtcacgtttcgagcttgctttctaaatgattctaaaaaatacacgtatcatggtacttaacattactgcactactttggatagttcaaatgacaactaatcatagtca

SEQ ID NO: 26543 - DNA, 1208 bp, Homo sapiens
ttgtttgtgtaatgaagctgttcaagtggaaagaactgagttgtagtccctgcttcactagtactagaaggattttttaaacctttttgaacctattttgccttatctgtaaaatggaaataatatcaacctggaaggttagctgagagaatttaatgagataatgtgtttcaaacgttctttgtaaatggtaacatgttgcagaaatattagattatatgactttagtccctgcttttctaaccattacttctcaattataaatgtaaacatttatagcatatttttaaaacaaattattcttttttcataattatctttagttcttttattgtttcagcatgacttgaaacattacttaatttcttagtatttcttgattggtgctttaattgtgtcgttcattggttaaaacctatccaaggccagtaatgattaaattatatgacttcttttatttatttattttctaaagaaaggaattatttgagctctttaagggcacaagaaaaaggggcaagaaattatcctgaaagcaaataaacctgagaccatacttctgaaaaattaaaaaaaaaaagtatatatatatgtatgtataaatatatatggctctgaattaatgcctacactttttagaaactttgaaggtgattatttattttaaacaattttcctctttttcgaaaagacagctctgagtttgtgggctttttttttccttttatggtaaatttgaaaactttatgtaaatgtcagatttaaaacacttttaaaatggggtgcagaaagaagcccctttttctggacatttattttttgatcaaattctgctatctggtttagactaagaaaaagtctttagttaatgcagaaaaaatgtattactttaatttgaattttggaatcattttgatattaatgatgtaagcataaccatgttaaaccaattcttttatagaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcattggttacaaatatgcttcgtctaagagctatttgtccattctcctggagagtgtttcaatttcgacccatcagt

SEQ ID NO: 26544 - DNA, 1013 bp, Homo sapiens
tttttcagctccatttataattttatgggactaccaaaatatatgcagtccctagataaccccaaatggcattatgtggtgcatgagtagctttctatcacttggatttattgtgtgatttggttcagattgttaaatgtattgaaattgatttattattttcagaatactatccattcaattgaaatttttataagggtctagattctaatgaaattttaagcttaaaaactcaatctcaagtattagtaaaaagcaattttaaaaaatcattatttaaaaatcagctcataacaacatattatttatgttcagcatgttcaaaagaaagctgcagaatggaaaatcaagatagatattatagcaggtaagacaaatctcaatcctaatatccaaaagggccaacatgtattcgcccaaccaaaattttcatgcaggtgctgagaagataaactatgctttacagtgtggcaaaatgtgcatgattggtaatagattggaaatggagtaaaagcagaatgaacacttagcctgagactgtcctaatttatgcgatttactgaaaatttctaatagcactcaggtatttggtcactccagactcaggcagaacactgtatagcagcacaatggctaaaaacatgggctgggggccaggtgtggtggctcacgcctgtaatcctagcactttgggaggccaaggtgggcagatcacctgaggtttggagctcaagaccagcctggccaacatggtgaaaccccatctctactaaaaatataaaaaattagccaggcatggtggcgcacacgtgtaatctcagctacttgggagactgaggcgggagaatcgcttgagtcccagaggcagaggttgcagtgagccgagatcgcaccactgttcttcagcctggatgacagaggagactcagtctcaaaaaaacaaaaacaaacaaatgaaaaaaaaaagtgggccgggcgcggtagctcacgcctgtaatcccagcactttggga

SEQ ID NO: 26545 - DNA, 1100 bp, Homo sapiens
tagtgttttgcagctgagctaagagaagagtaagggactttggttttatgaacacatgccaaaaaaggagaatttgtgggatttttctggtttaggaatatctggtcataagtggttgaaaggggggaggtccgttatttaccttgagattggagacatatatatacatggaaaaagcagctgagtgccctgcagaacacacacttaaaggtgctgagtaaattcagtgcttgtattaatatgggtacttggactttaatagatatgtatcttttactctgttttcctcacttattttccaaatggttgagttaaaaacaacaactatatttcctaatttaaattgttccttagtgctagatactacaattaaacattagtgtcttttctcaagttataattaactctactatgatgtctgtgctggctggtatatttttatctcaaaaatcacagtacagtaaagattgctaaatggagctttttgttcaaattccaagcaactgtatctttgacctgtattcctcttggctcttccaaatctcagtgacccaacatggacagtctgtgaagctaaccatgacctgcaagcagggagcatgaacatcgttttagtttttcaatcagtttaatcttttatgcttttttaccaccagaggcttcacttgtcacatttgctctttaaaatttgtcactgttgttttaaattagccaagaaaacaggaatccttaattaatagaaacttttctgaatatagttaagtattctgagtcacagcattaaacagctttagaatacatatgggtcactatataattttaaatgcccttcaggttttctggctgagagcagtttaagaaaaacagactaccttaaacttcagtaatttacgttctatcttgatatcaaatggattttctcattttaagcaatactacccttttacctaaattcattttttggaatctacttttctatgaacttaaaaagtgagtggctattttctgaatatttccacagtgatggacacccatgtaattcttatatagttgtttttaaattattataagatatttgttttgttattttcctttggata

SEQ ID NO: 26546 - DNA, 1051 bp, Homo sapiens
tgtgtgtgtgtgtgtgtttgtactccaaatgctgtaaggcgtaggaagaatcattctgcttttttctttcttcctcttttaactattataaaatattttcattttatttgttttctactagtaaattattccttcttaaattaaaatttgcatggactagaaatggctcattttatgttatgtcagttttcaactacctttcagtatatacattataaaaatagatttcttgtagtacagaataaaacccagcatctcattaggtatagattttcatgtggaggatggtttcttcaaataggtttttgccttatctctttccatcttttcggcattgaaaagagcactttggtcttttaactcggtggtactttataatatactattcttcccatcactgtaaaacattgatgcatgggtaaaaatatcttttttatatcgcaaataaattgagcttgttatagtcccctctcttcattttcaggaagaggcagaaatccaggcagaacttgaacgtttggaaagagtcagaaatcttcacatacgtgagctgaaaagaataaacaatgaagataattcacagtaagtcattatttgcatttcacagtttcatattattaaaactacccccgccccccatagagcataaacacaatatttccttcttgggttgtctcatcgtacttagaaaagatccaaagtccttcccatggcttggaaggccttttatgatttggtccctggccaccttactgtcctcacttctcttaaacatgtcaagagcattcccttctcagtgggcttttgtgcttaccatttcctctgcctggatgttcctcctctaaacacctaattggcttaattacttatctcactccaaatgttctttagaaaggccattcttagatcatcctatttaaaatagtagtccctagccaggcccagtggtgctcacctatagttccagctactcaagaggctcaggtaggaggattgctttggccaggagttcaaaaccagccttgtcaacatagtgagacccccatttctt

SEQ ID NO: 26547 - DNA, 1033 bp, Homo sapiens
cggagtttcactcttgttgcccaggctggagtacaatggcacgaccttggctcactgtaacctccgcctcctgggttcaagtgattctcctgcctcagcctcccgagtagctgggactacagccatgcgccactatgcctggctaattttgtatttttagtagagatggggtttctccatgttggtcaggctggtcttgaactcccgacctcaggtgatctgcccacctcagcctcccaaagtgcttggattacaagcgtgagccaacgtgccaggcccatcatgcttcttaataccctatttcttcttcctggcctcctgctgttgcttctttttaatttagttcagatattaccttttctgtgactttgactagtttcctgcagatagaatgtattttttttctttgctctgtgtattcatagctgtattataaaaagtaattatcttaaaatcagctgatgagcaaccttgatcccatttaaatctagccttttttaaagactaggatatggcattttgggaaaaccattattctgtttactgacccccaaagattcacatcctttccacatgcagagtacattcaccctatctcaacatccccattacagtgtcagcacaaagtctgacatcacatctaaatcccataagctcaaagttcaattctcatcaaataaatgagatatgagtgagacttggggtataatccaccctgagacacagtttttcttcatctgtgaaactgaaactcgagaagcaagttacctcctcccacagtacgatggaggaaccaggtatctgatgacagtttagagacatttctgttcaaaacaaaaagcagtggaagcaaattcctgcagaatttcaaaatccattcaaactccatttggattcaaggtctgggaataatcttttatgatgatcttctgtgcttctgccttttgggcacaggtttctgtcctctaggttatcctttctttttgatgaagtttagcctgctaacaatctgtttaaactttttagaaattat

SEQ ID NO: 26548 - DNA, 1027 bp, Homo sapiens
gtcatttataagttcagtggagaaaatattttgttagttataagagatagaggaaaacccacatttaatttgttaattataagagatagaggaaaactcacatttatttttaagtgatagacactttatataccatattttagttatttttaacaaagtgaggtagattgtgttgcttctatttagaaataagaaagctgaactaaagttcttataacttagccaaagttaaccttagagtatggatttgaatgtatggatatggatacaaatttccctgtatgtactttccactacacacttaagtaacatttaacagtattatctcatggttaagtaggctttttttttttctcgtatcatactcagatatttaatattattagtcctatctgtatataatttatttagaacattaaaactatttctaagcttttcatattccccagtctagacctcttgcattttctacttatgtcataggctaactgtgatctcagacggcaaatagatgaacaacaaaaattacttgaaaaatacaaagaacgattaaataagtgcatatcaatgagcaagaaacttcttattgaaaaggtaggctaaaagttgagtaaattttcgctttcccttcattagccccttttgctttgtatgcttttataaattaatgaatacaattgagtgatgattttttttctccttttcagagtacacaagaaaagctgtcaagcagagagaagagtatgcaagatcgattacgcctcgggcactttacaacagttagacatggcgcttcatttactgaacaatggacagatggttttgcatttcagaatcttgtgaagttagtcattcttaacatttaaaagtttttagtattcgtttgggttttcattactttaaaagattatagatttgtaattatgctctccagttcctcgctactctgaaatcatagaatttagtacctttgaaagggatatgaaaccaagagtattacagttttagcttagtaatttcttgatta

SEQ ID NO: 26549 - DNA, 1051 bp, Homo sapiens
tatctggggcataatctgtgaattggctataacggttggataataattgccaggcatttacgtggatggtcctttttagtagggattgtgtatatcagggtttgtgttctgccccttttttctcatccaagtttacttttatacactaagtatgtttgagtagtaggaaactaaggaaaaacttaataggaaaaaactcataggaaacactaaggtgatttttttccccctcatccagttaagcatttgaaggtcatcttttaaaggctaattattctaggatttttcatccacttcatgtcaaattctgtaactgaatatcagataatatgtacaaggtcttctctacttggaattttaaaatgtatacaataggaaattttatcttttaaataaattgtgtgtaaataacagtatattaacatctcttgagcactactgaatgctatttttttggtctcgaaacatggttttatgttgactgtgataattttgtatattaaaactgtcatttaaaaatctgttatcttgttttctgtagacaccggagaagaaacaatcggaatcatccaggggaagaaagagaaaagcagaaaaccagaatgaaagtagtcagggtaagcacataacatcttccttcagagcctagtggacacttaaaattaattgttttaatttttaaccaattaatactctaattgtaaaataatatgaagttgtaaattttggtgtgtgcacaggtagttagtgtataatgattgcttttaggcttttcaatgttgcccttattgttttcatttgggtcctagaaagacaagtatcatgtccaaatctggcaagcattaacttatgacttttcatttttcattctttatatgtattgtattgaaatggcttgtttttgaattaaaaacttcaatctcactttaacagaactactcaaacttttcccatttatttaaaaaaaaggctatcaaaataattatgagagactctagttaaagtattatctgtttttctttccatcctttcttgcatacctactttttgt

SEQ ID NO: 26550 - DNA, 1036 bp, Homo sapiens
actgtataagtcttgcatttgttttgttaagtttattcctaagtattttatttttttgatagtattgtaaatgaagttttcttaatttgtttttcacattgctctttgctgttttatagatatacatttggtttttgtgtgttagtcttgtgtcttgcaacctttctgaacttattagctttaatagttttgctgttattactgtatttacctttagtatttaccttttatttttttcttgcctaattttcattgactagaacatccaatacaatgttgaactgaagtggtgagagcacatatattgtcatcttagagaggaaagctgtgagtgcttcataaatgtcctttctcaggttgaggaagtttccttttatttctagattgctgagtggctcttttttgttccttttaaatcagaaacagggtgttgggttttggcagacattttttctatgtctgttcatgatcagtggttattttttgttctgttaatatagctggtgtatgttgaactaaccttgcattcctggaatgaatactgtttgctcaaagtgtataatcctttttatatgttgctggatttggtttgctagtattttgttgaggatttttgcatccatatttgtaagggatattgatctgtaattttcttgtgatgtttttatctggtttcactatcaggtaatattgtttttccagaatgagttggtaagtgttccttctgttctttggaagagtttgtgaagaattagtattagttctgctttacatatttggtggaatttaccagtgaaaccatctaggcctgggcttttcttcgagggtagatatttattcgttttcttgttttaattatactgctactatttctttacttgtaaggactattcagattatttatttctacctttctaccccagctttattgaggtatgattgacaaatagaaattatatatatgtgaggtgtatatgtgatgttttgatatacatatatattgtgacatgattaacactattaagataattaacat

SEQ ID NO: 26551 - DNA, 1083 bp, Homo sapiens
cagtctttggttttcagacacaagacatttctggcttccctcgtccttttctgcattgaatatgaacagacattctccaaggattcctggttcattttaatgaagaatggtgcttaggaaccaacatctaggtgctagttatgcttgttgttataatacataatagtctcttagaagaatgccagctaatgtagaatcagaacactcaccatttgacatccccaatataattattgattaaggcaaggatcatatgttttccattggacatttacatttagtaaaatgttttcaagagcagtatacttacagagtcctaatgttttaccccatagattagttattacaaaagagaaatgtgtctaaaatggacaccatttctcaccaccataataagcaagatcagacttttcattggcatattatctcagagaatctgacattgtatgtgcctcctaaggtggtgcagtaggagttacacaaatcacctctgtttttaatgctggaaatatttgatttgaatttagtcatgagacaatactcctgggacactgctagacaactggcctggactcatcaaagtattcagtgtcttgaagaacaaagagaggtaaatggaattgttgtagattggatgaggctaaagagacaagacatagcaatcagatgtaatgtgtgaatctgaatcctgatttgcacctggactggaggaaaacagttataaaggacgtttttgtgacaatagggaaaattcaagtacaggtatatgttggatgaagatactgaattaatgttggttttactcttttgtcttttaagttgtaattttaaaatataggtgaagctacagaatgtatgacagttgtgaccaatgactcctgtaatgtttagagtgatgatgataatgtgcttgtgagatgcagtattaataggtaggcaaattttaatgatagtagcatcaagagtttgtaatttggaagtaaaaacattctaaggatcaaattgctggtagcaacggtgctctagcagagagggtcgggtagaaaggtaaatacattatctaggagtattgatttatttcta

SEQ ID NO: 26552 - DNA, 1029 bp, Homo sapiens
tgtctcaaaaaaaccaaaaacaaacaaaaaaccctaccatttattggatttaatacatgattaattatttaggatttttacatatatgctttaagagaaatgaatgtgccaactggaagaatgtagttcagtgagttttgacaaatgtatatacactcatgtaatctacattcctcttaagatacagaacattttcattaccctaccatatctgttttataattcactatcacattagcctcacaaaatgaactgggcccctttcactatttttagttttttcagcatcctgtatatgataggaaatgttcatgagaatatgagtagacacgtaaaactgtcttggcctggcctggagcttatttagaatggtggcttttttttttttttttgaatacaggatctcactttgtcgcccaggctggagtgcaggggtgtgatctcggctcactgcaacctatgcctcccaggctcaagcagtccctctatctcagcctcccaagtagctgggactataggcgcttgcaccatgacattcggctagttttttgttgttgctggactttttttgtggagaccaggttttaccatgtacccagactggtctcaaactcttgactcaagtgatccacctgtcttggcctcccaaagtgatggaattacaggtgtgagccactgtgctcagccggggagatcttttactgtgattttaatttctttaatatttagttcattagttcatttcatgtaagcttttaaacttactagtatatagttacaatactttaaaaacctcctttgttattttctttcttcatattctccttttctgttcattcttgccagagctttgtttaatgaatatttcaaataaacaaatttttgttttaatttttttcactgtttttttcttctcccttttccgcagtgatttctgccttcataatttacttgttattttggatttgcttctgtggctcttcttccagctattgagttgaatgtttagtttatttacttgtatataga

SEQ ID NO: 26553 - DNA, 1035 bp, Homo sapiens
tttagtccttcataaaatttaagcatctctatattcttgatagcatttgggaattcttctattatagctttttttgtgtctttttccttaaaatattcaaatgtaattttaattttgaatgcattcaatttgtagattagggactactagcatctttgtaagattaggttatcctatttaagtacatgaaatgtctccctgtttattcagttctccccatggacttcttaggaattttcggctgttagatcctttaaagtttgttgctgatctttttttaattatattttctagttgatttttgctggcttaggatgcttttaatttttatagtttggtcttgtatctggcagtcttgctgttctcttttattggttgtaatggtttgttggttctgtagatttatttaagggaaataattatcttccaaaaatgatagtttaatctcttataccttaaatacatattttttccttatcttggtcatgaccttgaatgctgtgtcttgttcttgctctaaaagaggaattgtctgaaggttctttattaagtgtaatgtttgctgtaggtttggagtatataactgcccaaattaaagaagagcctttctattcctggttagttaaggagattttgttggttttaaaaattataaatagttttgaacttatgaaagtcttttttcagtgttgattaaaagactcagatttttctcctttggattattaatacaataatttaatagattcttaaaatgttgaaccttgtttgtatttctgggataaaccatacttgatatgatatactatttaaaaaacatttatcaggccaggcgtggtggctcacacctgtaatcccagcactttgggaggccaaagtgggcggatcacgaggtaaggagtttgagaacagcctggccaatatggtgaaaccctgtctctagtaaaaatacaaaaattagctgggcatggtggcgtttgcctatagtcccagctacttgggaggctgaggcaggagaattgcttgaactcggca

SEQ ID NO: 26554 - DNA, 1050 bp, Homo sapiens
aataccactacgctgtattattagagtactaacattaatatgcagtgaacttatacaaatacgtaagtttataatttatctgaaactcgtgttggggggggtaagtaactttatgagtttctggatatatgactactgttgatatggtttagctgtgtcgccatccaaatctcatcttgaattgtagttcccataatctccatgtgtcctggaagggactcggtgggaagtgactggatcatgggggcgctttcccacatgctgggtctcctcccgatagtgagttctcacaagatgtaatggttttgtaagtgtttggcatttctcctgcttgcactcattcttctgctgctctgtgaagaggtgcctttggccatgattgtaagtttcctgaggcttcctcagccatgaagaactgtgagtcaattaaacctcttttctttataattacccagtctcaggtatttcttcatagcagtgtgagaacggacgaatacaatggtaaagaaaaacaaacccaaactgagaattggatggatggagattttatgtaagatctttcatttagcagtacgtcagctagtgataaatatatcatgtgatgaactttcaggattttgtacacattttcataattgtaaatgtaaaagtgtctttgaatgccaggggctaccactgtataaaatgtaatctcaattgttggaaaaaaaaaaagtatgtggaaaaaaagactggaagaaaataagccattgttgacattggttatctttgggtggtaggactatgagtgggatttttttggctttaattttttgcatttttccatttttctttaccatgcgttcatgattacgggtaaaaagggaaagaagtgaaattgcttctttcctgacagttttttaggaaaatatccttttgttcataaggcaaataaattgtcttggggaagaaatatgaagaaatatgaagtcagaaatataataattgaaagaagtcttggtataagtcagtatttttaagtgactgtttgctggaaaactatggtgttaa

SEQ ID NO: 26555 - DNA, 1045 bp, Homo sapiens
atgcagctgctgctgggtgtggtggctcatgcctgtaatagcagcacttggggaggccgaggtgggcggatcatgaggtcaggagatcaagaccatccaggctaacacggtgaaaccccatctcaagtaaaaatacaaaaaattagccgggcgtggtggcacacgcctgaaatcccagctactcgggaggctgaggcaggagaatcgcttgaacctgggaggcggatgttgcagtgagccgagattgcaccattgcactccagcctgggagacagagtgagactctgtctcaaaaaaaaaaaaggaatgactgcataccaatacaaagtataaacactgctaatccaaatctagtgcttgatgcttaaatggtataactgcgtctcatacatgtgatcaattctaaagccacagaaaattacaggcactaagatgatgaaagcagcaatttaggatatcatttgaaatctacatctgtgagctacagttcttcaacaggctggagaaacagaccatctaagtcaagcatgctgtggctataaggaacatttattcagatagtatttggtccctattctttgccacataaacagagaggaaaacatttaaattctaaagtatcattatatccacacataatagtgatagttaaaacataagccaggtgcagtggagcatgcctgtagtcccagctacttgggaggctgaggcaggaggatcatttgagcccagaagttgaaaggctgtactgtgctatgatcacaactgtgaattactttttgttttttacatttcaaagatttggcttactgggcaaagggggcgagtatttttatgtcgtttaatctctgttgtcactgttgttttcttagtggaataactgggattttagtctattgttctctgagatgaatcagttgtcagagctatagagttttatagaaaacttattggcatagtttgttcattcagcaagtatttttggacctgaagcctagtaatgaggaaacaaagataaatatgatgaagttagtccttgctttct

SEQ ID NO: 26556 - DNA, 1057 bp, Homo sapiens
aaggggaggcctgaataatccaccccttgtgtagcatataatcaagaaataaccttaaaaatgggcaaccagtagcccttggggctgctctgcctatggagtagccattctttatgttttactttttttttttttttttttttgagatggagtcttgctctggcacccaggctggagtgcagtggcgtgatctcagctcactgccagctccacctcccgggttcacgccattctcttgcttcagcctcctgagtagctgggactacaagcacccaccaccatgcccagctaattttttttttttttgtatttttagtagagacggggtttcaccatgttagccaggatggtctcaatctcctgaccttgtgatccgcccgcctcggcctcccaaagtgctgggattacaggtgtgagccaccgcgcccagcctattctttacttaaacttgttttcactttgctgtatggactcaattctttcttgcacaagatccaagaatcctctcttggcgtctggatccagaccctttctggtatcagtggtaagctctgtttaagacaactgtcatacccaagagaattcttaaattgtggcagttaaaaatgtatttatcccctcgagggccgggcgcagtcgctcaagcccgtaatcccagcactttgggaggccgaggaggcggatcatgaggtcaggagttcaagaccagcctgaccaacactgtgaaaccctgtctctactaaaaatacaaaaaaaattagccaggcgtggtggtgggcacctgtaatcccagctactcgggaggctgaggcaggagaatcacttgaacccgggaggcagaggttgcagtgagccgagatgacaccactgccctccagcctgggtgacagttgttagactgcgtatcaaaaaaaaaaaaaaaaatttatttactcccttgcttcaaaaaggacataagttggcttgcaaatcacattttgtagaaatgaagtttttaagattagtctcatactcattacataatatttattgactacttacatattgagtgctaaat

SEQ ID NO: 26557 - DNA, 1048 bp, Homo sapiens
gtagaataaacagtaaaggagaaaagcaaaggctccctgctgttgaactagggcttggaatgtgaataaaatttaaataggcagacagtaaggaggagagaattctttgaggaaaaaccatgtgagcaaaggcagaggctgctcagggccaagcatgacagtttggctaggggagctgcttcagattggaaagctgttggtaagattaattggggtcagtagtaggagatcttaagagctcaactaagaaattgaaattttatcctatggattaaaatcatgaaagtttttgagcaaggagatgatttgacaaaattatcattttaagcagaattattcatcgataacatgcaggaaggattgacagggagaataatacagcgtgttaggaagcagatttgtttccaggcctaaggagataggggttggtactaagggagtacaaatgggaaacaaaaaagacaggaaatatcaaagatgtcattaaaaataaaaattaaagaggacatagaattttatggccacatggagaggacagtggaagaaaaataatttctctttcatgaggtaaatggtggtacctccgaactaaataaagaaaaggagaatgagctcgttttggaggaaagatattccctctttagatatgtacaacttgggatggctttggcatattttttatcttgcaaggaaaatgaagcacactccattgttgtctatctcagaactaccttaattttctgtaagtaccaggaaacatctgtggttttgaagtttagctttgacatcatacgtcaagctctgtgaagttaccactctgatcatttgggtgatttcttgatactctaggacttttgaatctagtcatttagcaagttggttttggttttttcttctttacaaaatatttttatttttgttacccttatgtttatggtttagatttctttggccttatcaagcttttcttattttgtcttcaacaaagttaaatccagcatataaaacaagatttctacaaactgggtatctttttaatactttgttt

SEQ ID NO: 26558 - DNA, 1065 bp, Homo sapiens
ttgtaacctcccactccaacaatgagaaacctggcttctgccaagtatcacctacttcctaattgttcaattctgatttccttgtatactgatttcagaattgttaaccctttatcaactagagtacagtgcttattaccattcctattgccttcagttttataggcaccattcatatccagaattatttaggtcagcacctttttctatattatttttattctctgaatattccatgttttcacacctgtttaatctttatttgtgctaatcctcctgcctgaaattccctggcttttacccttctctccgtggaatgttactcattcttctatacccagcacaaatattgcctctaccagaaagcttctcagagccaccactagtagacttaatctttcattcctctgtgctccaatagcattttgtacttacctttactatatatcatgtcaggattctttgtttgcatctctttcttcttcacttaatggtaattcttgagagcagaaaccaaatggatttgtctctgaaatcccaggacttaacaataatacatattacgtaacagaaaacctaatagtggctaaaatacaaaaggatttacttttttcacctagcaagaagtcagagatagactatcattggtttacctgttcaatgatgccatcaagaatccaggcttttttccttcttccgtacatagaagtctaaatgtgaaatgccaggtaaataagttaaaaccaatttcattctggcccagtataatgtgtttggagacaacgtccagagaaataagaatagttcagatattttggattgagatggctttgagatgagcttacattaaatcccttagagaaataacttctgagtcccagttgcctctttttgtgtgagtgagtgtatcatgtagccaccattcagggcagtcatggagaacaaacgctaagcatgaaattcccattttgaagctgcagagttactgacgtcatagtgtgatcaaaatgctctgcaaatacttactgtaattattgttgttgttctgttcttgctaataacctt

SEQ ID NO: 26559 - DNA, 1058 bp, Homo sapiens
tcccatgttttcattatcttgcccacattttcagcctcatctctttggccatccctcatgtttgcttttgtggttctgacatgtttgctgactttctcaagccaatgtgcctttatatttgagattttctttatctgaagcttcctttcctctcctcttatcagttgatctcaagactcatcccaggtatcacagctccactgagacccttcccctaactcctccagcttggttagtagccttttctgtgcttccatgttactgtgtatactgttgtggcactatactagaattgtcatttgtctgtcttctcaactaacctgggcagaaactgagtagtaatataattctccctgctttacactacctaaaatgtggttaatgcatatgtatgttgaataaatgaatgggctataaaaaacaatatgtttgtatagaatctattatcaacagctaagtactttttttttttttaactttatttgcttgagaagaaatctcaaaggctggtgctgaactcctgggctcaagcgatcatcccgcctcagcctcctgagtagctggcatgtatagtgggattacaggcatataccacaatacttggcaatagcagctacttttagcttagatgcagatttagtctccacttattccttaaatcagtaggaagtcacaatattaataactttcaaaaaaacttaaatccttaagacttctacctatgaagtagatattttccatttgttgaaggtaaaatggcataaatagatacagttttatgattggaaaatgatttctcttagttttgggcatagaacaaatattagttcttctttttttctattctttgtctgtgttatgtttacagaatacttaaccatcctagccatgatattttaaagacaagaaagaagaaatattaattcaaaagttaataaaatgctttttgttcatatactttgtttaaagaaacatagtataactgaataaatgtataaaatactcaggttattaaacttgaacatttattcagagacaaattttaactaagctatagg

SEQ ID NO: 26560 - DNA, 1051 bp, Homo sapiens
attgattgtgtcaaaataaatctagatgacactattcaactttatagtgactttcttgcctctttccttccttcctttaataagtgtatgaatatgacatatttacatatttggttttttaggtataattaacatttttaaaaggaacagattttagatattcagctcaatgagttttgacagttgtatacacccatgtaatcaccacctaagataatgaacatttcaccccagaaaagtcgttcatgcgtctttccattcagtcccttctcccttaccccatgcaaccacacttctgatttctgtctgaagttttgttgttcttggatttcatgtaaatggagtgcacgagatgcattctttcatggctggcttcttttgtttaacatgttttcagagagtcatccttgtgtgggtatcaggtttgtgtttgttttaaattttgctgagtagtatttcatcgtacgaatttaccacaatttgtttatccatttttctcttgatggatgtttgggtttttgtctgttacaaataaggttgctgtaaacattcttgtacaaatctttttgtcaaccaatattttcatttttcttgggtatctaagaatagaatagagtcgatgtatattcaatttaaaataaactgccagttagttcttagaagtggatggatcattttatagtctcctaagcagtgtacaagtattccagttgttccacatcttcactaatgtttgatatctgtagtgtttttgatagtaatcattgtaggtatgtgaaatagtatcttattgtggtttaaatttgcattcttctgattcctaaagatgttgattatcttttcatgtgtttattggctattcgtatatgtgtgtgtgtgtgtgtgtgtgtgtgaagtatctgttcaagtcttttgcgtacattttattaggtttcatattttttactaattgtaaaagttgtttatacatcatggatacagccctttgtcaaacagatgtgttgtggatatttttttgccagtttgtgacttgtttattacttttattaat

SEQ ID NO: 26561 - DNA, 1051 bp, Homo sapiens
agaagtagtatataacctttgggaatagtagtataaacagattgtgcattttcagatttttatttttatttttattttttcgagacagagtctcgcactgtcgcccaggctggagtgcagtagcgtgatcttggctcactgcaagctccgcttcccgggttcacgccattctcctgcctcagcctcccgagtagttgggactacaggcacccgccaccaggcctggctaattttttgtatttttagtagagacggggtttcaccgtgttagccaggatggtctcgatcttctgacctcgtgatccacccacttcagcctcccaaagtgctgggattacaggtgtgagccacagtgcctggcccattttcagatttttaaatctcattgtgaacattaaccaaacttgtgttttgtatctatatcaaaatcttctcaaacaaacttactcattcagaatttatgataacttggatgtgctatcccaacatgttttttgtttatttgtttgtagtatctataaattgaactctaggttaaattgcctgaccttggctaggtgtggtggctcatgactgtaacctccacactttggaaggctgaggtgggaagatggcttgagcctaggagttcaaggccagcttgtgcaacatagtgggaccccccatctctacaaataataataattttttaaaattgcttgacccttttttaggtggagatggggtaagattgtatgtgtgtgtatacagttgctcagtaaatatctcttatgaatgttgagtgttgtatgagtattaaatatgtaacagtaggttttaaataatttttcctgttattctcataggtaaaccattcttatcagaccatatgtttatttttctattagaaaatttctgtctttctgtacacacacacacacacacacacacacacacacacacacacacagatccagatattcctcgacttccaatgaggttacattgtaataaacctatcatgagttggaaatttttaggtcaacagtgcacttaatacacctaaccttct

SEQ ID NO: 26562 - DNA, 1050 bp, Homo sapiens
atcgttggaaaaaaaaaaaaagtctccctcatacccttgttcctttccttcgaggcaaccagtatttatcagatttatgtgtatccttcccagatactttgcgcctgtcctttagataggtatccttggggacacatttagtgggtagggacagtcaatctctatacttttgcttctggcaataattatttgattttaatatctatcactggagtcttaccaaattcatgcactccacattatttctctggagtcttttgctttttgttgatgaaaacagagttaaaaggtttttatttcactaaaatgatctgtgtaaatagggaagtaatgattttaaactatagttcactgttttttgtttttttttttgagaaaagatgattttggcgtgaggagtttgtcagtgtctaacaattctttcctatatttttcctgaaggcgcttgactttggcagatattgagagaatagccccattggctgagggggccttaccttacaacctggcagaacttcagagacaggtatgagtaatctcataaatatgatcaccttaaaaaaatgctgaactagtagactaaataggagctgacagcttctgaatgctgtaaaaattaaaaattactttccagagaaagactttacttagcttaaagattacctttatagaactactgttacccccacttttatagaatatatatatattttttgagatggagtctggctgtgttgcccaggctggagtgcaatggcgtgatctcggcttactgcaacctctgccttctgggttcaagagattctcctgcctcagcctccccgagtaattgggattacaggcgtgcaccaccacaactggctaatttttgtatttttagtagagacaaggttttgccatgttgggcaggctggtcttgaactcgtgacctcaggtgatccacctgcctcggcctcccaaagtgctgggattacaggcatgagccaccacacccagcctatagaatatttttatgagataactagatttatatttgtgttttgttttttg

SEQ ID NO: 26563 - DNA, 1056 bp, Homo sapiens
attttggggccatacaatattatggttaaaaaaaatcagatgttttctccttagattgtcagggtcaaattgattccagtggttgagaatgcagccaagtggggaatcaggtggaatggatggagagttgcccatagaggtctggaagaaagaagagaacctagcttatttggtgactcaaattttacctggggcatccccctggaaaaactctgggccttgattggggtcctcaggggtgtccccctttagggccccatcttagtctgtcagatgtctctgaccttagatgggtgatggtaccactttgggaaggttctctccaccactgatgacccactgtgagctttccttttgtccctggatgaaggccttgtcttctagcatccatataatttgataaggccatggtttcctgttccactggagtgatagccatgaactttaataataggaactagaggttggatggatttcttttgtcatgtggattacaggtaatctcaaggggggaaaggtagattttgggcatgaaaaatgaaataatagtgttggctattccactcaggccctcgacaagagagggaatgtttaaaaatccaccaccatgacagtggaccctgtgtaagggcaggccattctataaaaataatctggtgatgacaaaagaaacaagatgtagaatgtattctaaagattgtgggccccaaaagtcctcagcaagttgaatagattgagtaggataagggaagtcaaaacatctaagagatatcctttgccattacaagctaactctttaggagaatttgacataagaaaagagggcttaagttgactgaaacatctgtgagtttgttctggaagagctgccactgccaatttcgtcacatgtagggattagggactttaactaggaaagatagaaaagagtacttccccattctgggcagggcagctatccccattcacttcttggccttcaggtaacaccagagagtggctctggctagttgccctcaattaccaaggatctactaggaaacagcctctgaaaga

SEQ ID NO: 26564 - DNA, 1023 bp, Homo sapiens
aagaaagggaaggaaaggggagggaagagaaggcgggagtgaggtgagataggaataaggggttgagatgcatgagagagtgaaatgggagaagaaagcaatctgacagagaagagaagggttgtgatagggttcataaagtgggaaagaggctgggcccagtggctcacgcctgtaatcccagcactttgggaggccaaggtgggtagatcatctgaggtcaaaagtttgagaccagcctggcctgtgaccagtcggagactgaagtgaaggctccctgtgtccagaccctgtgtttctttcttctcctctgttacatctgcttgtctttttctcttggaatttatattctaaactattcaaatagactgttcttctgcctcatttccccctgagagacgtgatcttcataaatctttatgggaggcagagggaccaatagtctttcttctgtaactacttcatgctgattggggcacagtccctacctattggggaccatggaactctagcactgctctgtctagtggagatagggtgacttcttgatggccagggcaggcatcatcatctggaactggaagccctgctgcatgatcatttgaagcttaatcgtctctaggtgagaagaaataatctggtaaaaagatgaacaaacatggtccaaaaagtcaatgcaagtataattattaacaatgggctggccaagggaaggagccatgaagcccagcttggtgcccttgaccaggagccctatgatgtggacagctgttgttatattttagaagtcctgtcagctaattttcgagtggcatccctactaatcctgattggttgatataaaaacaacattcttataggaaaagacataagccatctttttgagcagttaggagatccagtctccttctattttgtacagtgactgctgccaaggagtctgtttgattttgtaaggtgacaatactttgggcagtgtcttccaagctgtctggaagatccttggatgagcattggtaatag

SEQ ID NO: 26565 - DNA, 1056 bp, Homo sapiens
ttgtgaattgacttttatagtaagtatagaactctgtaagaatgtaaataacgttgttagtgcatgaagacaagctgccagagggttttggttgtatgttacacagtgtgactagttcctatctaaaaattagtgtactgtatttagctctttatttaaaagtgaaacactaatttaacttatcttaaaatattttaatagttcagactaataatcatggattttatggggattttgaagctttgtgtcaagaccatatttttaacaatatcagaagcttttaataaggtgcttgctgctgagctaatgatatgcttttgatagtttttcttatacctatcttcaatagacatattcaggctagtgtgaatgtaataatcaagcctcaatcaaaccatacttagtatgacaaatattgcattatactgtaatttaggtattcatgcttctgataaagggtttaattcgactccttgagaaactgggaaaacactattgattttatacgggatgtaaaatagcagccatttatgatgtaagatagaaatcactttctaattaaaattaaataaagagaaattaagaatctcatggccttatatgcaatggtacatattcttaagtgtaaaattatattttttgtatcagttgtgttcctgcgcatggtttctgggcacacaaaaaaattgcagttattttaatagaagcagatgatattgacttttaaaacttctcttaatttttttctgtaggaacattgcagtggtttaaactacttattccagatataattgatttatttttgttttcccttttaagaaaatgtcaaagaaatttttggacagactattattcatcatcatatcccttttaactgggattgtgaatttatccgactgcattttgggcataaccggaagaagcatcttaactacacagaattcacgcagtttctccaggtgagcttagttttcataacaggtatcaatatatactattcttctgtgtccttcgctttgtatttattaagtttattacaaaaatagaagttctcca

SEQ ID NO: 26566 - DNA, 1160 bp, Homo sapiens
aagtgctgggattataggcgtgagccaccacgcccaaccgatagtctttaaatatgaactcatctttcctgagaaatggacctttacatatatttgacagcaggactactctattgactgtgcagtagtcccttctagaggtaggtaaagggctaatagaaatactttctctcagagaaacaggaggtcattcaggaaactaatgaccatctgagaggagaacccagaagtctgggactgagtctacatgccatgttggttgggacttcctctacaagttcctgttgttggtctttttgttgttgttgtttgttttcctttgttttcttttttggcttcccagttgttcctcctctttcctcccaatttttccttcactgaaaaactcttcacttctacaagtctcaccattgtttttgttcagctatgtacaaggatattcaccattcatggtgggagtcctaaaaacctctctgacttcactttaagaactgtgcaggtgaaattcagctactgaggaacttttccccctgacaataagaatgtttggtctcaagcctataagttggttgtagtggctcctgctgggctggaatccttggaataaggatgtcgttgggctgatggtaggtgggctgtgtcacagggctgatggcttgtatacctacaggaggagttctctggccacaccgttggtacagcagctccttccaggctcattcatggaacaggcatggtggcagtcttggagaagagtgccagccccggtcagaggtaattttgtactgcagaaaggtgaacaagaccagtaggaagtgcccataagaaccaggggagggatgagggtggatgagatggggagacacagtatgggtttctggggaaattaaaacctctgttaagacatatttacataatatatatgatttaatgtgtatttcatctagtccaatcatcataagtgactgatacagctaaactgactaatgttacacatctgtgaacatttttacttaatcacagttgtcaccgttacctgctctcctgacaaatcattgtgctcctctcctttgagcaaagagaacataatgacaggctacttttgtatttagccccagttcccttttcaatggaagtataaaccatccctttcataagcc

SEQ ID NO: 26567 - DNA, 1057 bp, Homo sapiens
gcggttacaaaatgggagagttcccttgtagcaggacgagccacaaataaaactcctcagacaccgagttaaagaaggaaggggtttattcggccgggggcatcggcaagactcctgtctcaagaaccgagctccccgagtgagcaattcctgccccttttaaggtctcacaactctaagggggtgtgggtgagagggtcgtgatcgattgagcaagcagggggtacgtgactgggggctgcatgcaccggtaagtagatcggaacaaaacaggatagggattttcacagagcttttctatacaatgtctggaatctatagttaacataaccgattaggtcaggggtcaatcttaactaccaggcccagggtgtggcgccgggctgtctgcttgtggatttcatttctgccttttagtttttactttttctttctttggaggcagaaattgggcataagacaatatgaggggtggtatcctcccttaccctgatcccctcacaggacttgtgacaggggtgtggcttatttgcttggctgccacacacactcaaaccccttacaggatggggggcatgcagacaggcaggtgcaggagccagggcaagcacttttgggctccggccccatggtagcgtctagagctatgttacaattaatgcttttttagcagttactatccacagatgactgttaaaccagctcaatggagagtcagagtgacagccttttacatcctgccaccttggtatctggggccttgtccagtgtccaggaaaaatcaggtcactcggacttgaaggatggtgaatgcaaggattttactgagtgatggaggtggctttcagtgggatggatggggatctggaaagagaatggagtgggaagatgatcttcccctggagttcagctgtccccccaccaatctcttctccaactgtccccagccaaactcctcttgacattcagatgctctttctcttcttctcttctctgctacgctgctctgccactcttctggtcttctgtacctgcttgtggagcttgggatttatat

SEQ ID NO: 26568 - DNA, 1835 bp, Homo sapiens
gagcagtttcatcctacaaccatccccaccccccgacccccatccatgaaaaaattgtcttcctcaaaactagtccctggtgccaaaaagtttggggaccgccgtcctaggaaataccaacaaaaagtcacgtttattgcctgccaagtgagtcaggtttagacaaggcagaacttagtatatagcttggatgaatcagaaagggtgggccttgaaagactggtagaatgtgtccaagaaaactgattaaaagccttagaagtccctctacagtttcaggacgccctcttaacagatggctgtatctttatctgtggttggtcttgtggaatactgactttctgccagcattagcctgtgtttctatgtcacaccaagtcacgtatattttcattgtgtgttaggactcagaataggtttgggtctttcttttaattatgtatacccaattacttagtcctcctcacaccctgatcctttaaaaattcttaagttgtgttaattgcatttttctcaattctactcctagtaactctgtgtgtttttttccatctttattcatttagtaaagttgaaacctttcatagcataatatagtgattaagtgcataggtttgggacttagacacacatgggcttgcttgtctcccagttctgccgcttaccacctatgtgacctttcactctttacctttccactcttagcctgttctctaactataaaatgagaatgatgctagcgtcatcttcatagagtgattatggagataaataagttaatgcatgtaaaccactttccataatgcctggcacatattatattatgtattagtaaatgtaagcactggaagaatcagtagtcttcctacacttgaaaatagttgtcttcaactattgttgtattaatgagttaattcaccttgttaagtcaccttgatccacctaattgtcagccaacatttattaacgaaactgctagtattcgtattgtgccttttttattatgaaacatttcaagaatacagaaaaatgcagaaaacaatgtaacaaatacctaagtatctatcacccaacttttatagtcttatttttacctatatattttttcttttagaaaggaatgatcacagttgtgcctgaaatctgtatagccctgtctcatttcatttgtctccctttacccacataagtaattgcagctctgaatttgatgtttatcagaatgataccatgagtggttttatatccttattatatgtatgcatacctaggattgtttttctgattttgaaacttcatataaatggtatcattctgtacaaaaccttctgggacttgttttaccactcatgtttttgagatgtatccacactaccatctttctctaaatcattcatttaaatgctgtagttcattgaataagtttatcacaatgtatccattttcttcttgatgagcatctcagttatttccaatttttgacttataaacaatgctgcaatgaaataattgacatatttccttgtgtacatgtgagcatttcttgagatatgtatctagaacttgaatcactggccaacaggatattcttaatcttcagtttcaccagatacttccaaattgatctccataacatgcataccaaattatattcctaccagccatttataggagttcacattttttccataccctcccaatcctgccttggcagatatgttttttccaatgaataacaatgaaattttgttttgggatttgacaaaatgattctagattcatctggaagaaaagcaagtataagtaagaaatttaaaagggacctgaaaaactaa

SEQ ID NO: 26569 - DNA, 1029 bp, Homo sapiens
ctatctctgacgttgcttcacatatcctactttggccttcagtattgtataaaattacctatgaagtctgtagtagtatacagatgctctaatagttttagttcctgtctctcattgggtaggtagacagatgagattaacctacatgaaactgcaacagacaattaagaaagtagataaggctgcagggcgtgctggcccatgcctgtaatcccggcactttgggaggccaaggaaggcagattgcttgagcctcaggagtttgagaccagcctgggcaacatggtgaaaccgtgtctctcctagaaagacaaagaatagccgggcggatggtgtgtacctgtagtcccagctgctcaggaggctgaggtgggaggattgcttgagcccatggggcggcggttgcagtgagccaaggtcatgccactgtactgcagcctgggtgacaaagtgagatcctgtctcaaaaaaaaaaaaaaaaaaaaaaaggtagataaaagattttgcgttgcagtctgctgttgaaaaggctcagaaacagagataattactgcttgggatagtaaagtatgggataatagatcttatgatggccctgttaacagaattttcctcagtaggattttatcagcaggttgtaaaaaggaataatgtaaaagggagaaaaaggtcaatgatcaaataagtgtaggaaatagtgggccaaagagggtataagtaccttcaaggcagtacctcttaggacctttaaattaaatgctagattgacagcttgcatctataagttagtgatgtaatgtgtgtgtagcatttcctaaccttgtgccgtttgccatggagtacctctcaggactaatgttacaagagaaactgggaaatactttagtagaaaaatggtggtatgttaatagaagaagtgagagacctttttttgtagcggtgaatgaggatgagattttacataacatttctgttaagtaggattgaggcacactttaaaggtccttgtaaattaggcagtggagcatc

SEQ ID NO: 26570 - DNA, 1029 bp, Homo sapiens
tggcctcccaaagtactgggatgagcgactgtgcctgaccagtagttgcttcttacctccaatcagtaggagacacaactgaaaaggcttttgagtagataattaaaattcatccttttggtaggatccagtcagggttatgaccatcacttccattgttaaaatgtctgaaaggattaaggtaattcagagtaaaggccaacttgagagggaattgcttttcagttgggttagggaaaagagactaaaggtatggaacccctgctaaagccaggtaaactcaaggtacccatagttagagagaaatagacacactgtctcatggggcaagaaagcaaagaaaagtagtaaatctaagaggcatatcttagaaaaaagctttggttctggacattggcgcttggaattggatagaatcaaatagataagccttctaattttttcagggagaggcatagacaaaagtctgaataaagtataactgcttgatacataatgatcttgctctctgccccatacctccctgacctatctgcctgctgagaattctgctctgctaaggagtcacactctctgatgctcacttcacttgtagcgttagaagataacagaccaggaaaaaccttccagaaggcagaacctagaggcacagagaacagcagacttagaaactcctcccaagggtcagtcagagcattccccaccttccaggacagagagcccttgcacaatctgttcagcctggcttatgaattgctatgaactactgactgttgtcttcttttcttcttttgaactggagcattttttatattctgtcagtgtgtattgtgtgtgtgaagggaagtagataacttgttttaataaataggtctctgtgaagaggggctgcatctggacttgatatagaggtgatttccccatcagcgcagatcctgtcctttgatcttgatgctgagactggatgggatatttgggttaccttctgaatggagggacaggtgtattttttcatgtgggaagaataaa

SEQ ID NO: 26571 - DNA, 1056 bp, Homo sapiens
gaattacatcctatttaattagctattaatatagataaaagtaccctacatgcagaaaaacccagagttagattcattgctgaaaacaagagcctggagtagggctcttttttgttaaaggggagctacaaaaagttgttgctgtttgttatcctgaggtatgacttaaatgaagatttacggagatgagacgatgatgcaggaaaataggaggacatcagcacagtcttacgaccaccacatctgaaccaatctgaaccattgaactgttagctgagtgtttggatttgtgatatagccagtattactgcttacaagagttatatatgagttttggggcttgcagaaatgccagacccaaaattgtaatactgagaaagaaagaaaaaaattgtattcaagatgatcctgcaaacctaaattccaaaatacatgaagacaaaatctgtgaaagatagctgataaaatcaacaattaggagatgaattcatgtcagattaaagaaaacaaaacattctgttgaagactttgaaaatcagtatgcttgcaattgtcagtgagataaaagaagcaatagcatctatagaaaagaagtgaaacaaaaacaataaatacggaaaaacaatcaaatcctgtacatgagaaacccatttcattgattctaagacaattttttgaaatcggagtgcatcttgctattcaaggcatgtcagtgtttctctctctttttttttaaactggtagtgctttttcttagatgaaacataaaagtttttcggggagaaaaaagacaacctttagaatggattgagcaaatagtaatatgcttaggaatttacccagaataccacacagagataatgaacgagcagttaagacatggaggatagattgagaaccaccagtgtaggaatttcagaagaaaagaataaagtgaatggcaagagaagcaatgtttgatgaaataatggctaagaattttcttgtgttgaagaagtacaatctacagatcaagttttatttcaagtatgttgataagtagaaataagttcatct

SEQ ID NO: 26572 - DNA, 1025 bp, Homo sapiens
ttttaatggatgtttttcaaatctattctcataatcttagcactcacaatgatcttgggattgcacagtgctcaatagtttataaaatttaatatttttcttctgattcttatgcccctgcaaggtaatgtttttccggttgttgacatgagaaaattgagttgctgtaactcacacaattccacagtgtagccagaactagaactcagttctgagcttttttttttttcttgtgtaatatattgtcgagtgtagttttggcataaatcatctagtagttttctgattcaatgtgttttttccattccatttagaaaatagggtattcagcaaatttttttaaaactgcaaatttattaaattaaaaaagttccttttcttgcttgattcttttccttaaattacctgttgctttttttttttttcccccatcgttgtgcttcacaggtattttaataatgcttttcatttcaggcttattcagaaaagttcggaatacatcactttgctctaggtttagagattttccttcaattaatggcctgaattgctgagaaaaatggcactacagtttatttttatctagcttctggagaggggatgacttgggcaatatttactcagatttgtcatttgcgttagctgtatttattttcaaggaatttcttgactagaaagctgttcagtgatggttgaatatctgcctttattactattttgtaaaaaaaaaaaaaaaacactttaggtgctgtaaatttgactttgttttttttaaagaaaggaaaagggacaaaatgccagtatcataaaattaatttgtgtctgagttactatattctttgataaaagttcaatacctgtaaattttatgctggtcagaaaaaatttcagtggatcctccaggtgagcaataaccttaagaagataaaggttagattttagacacactttagtgtagattttagtatatagatttaaatatttgtagtttacttaaaatgccaagagaccgaaatgaaacattt

SEQ ID NO: 26573 - DNA, 1138 bp, Homo sapiens
gtggatcataggaattgatttgtggagtgatactttcaatagtcactgaagacagaagtttggtatttggtatagtctacaacaaatgcttagtatgtccaggtattttttttttttaagttaaaccaatgttaagctattactggtaaataatttgtaattttagtgcttcgttataggggatgtgaatagttttaatgtcttgttttttcataagcagattaacatgtaaaaatgtaaaattatattaggctttgttatttttaaatacatttatggattggtacgccttctgttcacctcatttcagcttcgctgagagttggtagatttttttatgaactgtatccctctagttccaaagtgccaaaacaaattgactgtatcttaaaaaactactgcataagtaaaattaaaaagcagattgcttctcctgatcttttttgtatttcaaatggaacaaaacttttcttgtaactgtaatttgtaaagtttagatatcagtttacagatgggggaggggagaaggaaggaaatatgggtgaataatatgtgtatgtacatacatatgtgagtctgaggcccaaggatagaatactgtctccaaccttagccagctgtggccatatacttgtagggaagtttccatgcttcttcagctgcttttctgaattaccaaatcactcctgacaacacatattctgccacatgaagacgaactagaatcaatctgataaatctgagatttatcaatcaaatacatcataatttgccaatcatagtaaaatgaaaatagttttgcctaaaaaaaaaaaaaaaaaaaaaaaaacccaaaccatatatttatgatgtctggtacctgcacccaagatttttcactttgagtaaaattggtaagactggcttgtgtgtatttgccttagcaaatagaaaatttgctaaaaatttatttttccagtgcaaatatgaacttaagacatcttttcagcacatcttagaaaaggaaattcacatgagttcatgggcttagataatcttttattactcaaatgactgggaattatgagaggttatagctgtgtttttaaataattgtattttggaataattttaaatttatagaaaagttggaaataca

SEQ ID NO: 26574 - DNA, 1055 bp, Homo sapiens
caaaaaaaaagaaaaaaaaaaaacttactataaagctacagtaatccaagaaagtgtggtgctggtgaaaaaatagattaaaaaaaaaatcaatagaacaaaatggagagcccagaaaaagacccacataaatgtagtcaactgatttttgacaaaggagcaaaggcaataaaatggagcagagatagccttttcaacaaatagtgctggaacaactggacattcacatgcaaaaaactaaatcttgacatacagaccttactctttttacaaaaattaactcaaaatgaatcatagacctaaaggtaaaacccaaaactataaaactcctagaagataacacaggagaaaacctagatgagcttgggtttggcgatgactttttctagatacaacaccaaagacatgatccacaaaagaaagaattgataagctggcctgcattagaattaaaaacttctctgtgaaaaactgtcaagagaatgagaagacaagctacagactgggagaaaatatttgcaaaggacatatctgataaagaacatttctggactgttatccaaaatatgcaaagaacttaaaactcaaaaataagaaaacgaacaacccaattcaatgtcttgaggataggttggagatggccattaaacactcttgggtagatatcagactgggtagataccaagaccaattgttgtgtctcaattggaagctcagaggaaagtttgaggaagcaggtatataaatttagaatcattactatatggatattacttaaaacctgagggccagaatagctcaccttagacaggtgagaacagaaagaggagaaggcccagaaatgagcctgatgcaaaaggtctctggaaagaggaggggccagcaaatcgcagcaaaaaaactgccgaggccgggcgcggtggcccatgcctgtaatcccagcactttgggaggctgaggcaggcagatcacttgaggccaggagttcaagaccagcctggccaacatggtgaaaccccatttctactaaaagtacaaaaattagccaggcgtgc

SEQ ID NO: 26575 - DNA, 1029 bp, Homo sapiens
atcgaaattttttgagagtttcacaattatttgctgaatgtagatttccaatatgatttgttggaaatgcctttaaaatgtccctttgtatattgatttttatatgttctttagatgagctgaaattttgagagctttttatctttttaaaacctttgataattcagcttgaaagttacttaaaaatctatttttttccactgtgaagaatagaaaatcgaaatgaaacctacaccaaaaccagaccactgcttctaaatcaataaaacagtggatgactgttaggaaaaacaaagccacgcttctttaatatctactgatctatgctaaatctgctgcacagatactacccagtgttgaaaatgtactaattatatacctgacatcttaacagatattaaactaagttctagttgagcccaactgcagatcagagaaaagaaactctgtgcttacaatcagtcatcttaaatgcaattagttttctctggtctttcttttcaaagaaagggactaaggctcctcaggctgcaggaaagattcacacagattttgaaaagggattcattatggctgaagtaatgaaatacgaagattttaaagaggaaggttctgaaaatgcagtcaaggtaaagaattgtttttatttttgtatttcacaatgtttccactgatgcgaagttagtcatgataaaaatgaatgataattatcttttaaactgagtgtagtctaaaataaagtaataagatgatcagcgtttagtgttactatcaactgacttaagagctatagatgtttacatacttttagatcattttaaaaatgtgtgaattgtcagtagttttgtggaggtttttttctataattgaaaataaaataaattaggtttaagtaattgtaaataatttcgaagaatttgttcactcatggccaatgaaaaattgtacttattacatttgaatagctgaagtataatatatatgcttataattacttcaagaatagagatagaaagttagttaaataaa

SEQ ID NO: 26576 - DNA, 1032 bp, Homo sapiens
tcatagggaacaacttgtggtaatgtatctttcacttgatataaatttagatttcacagtcctctgtgctggaatcacttcttatattctgaatctagactccaaagctaacttactacagatgtttccccaggtattgaggttattaggataagaaaagcataattatgtcctttttttttttttttttttgagacagggtctcgccctgtcgcaaaggctagagtgcggtagcatgatctcgactccctgcaaccttctcctcctgggctgaagcgatcctcccacctcagccttccaagtagttgggactacaggcatgggctaccatgcctggataatttttgtattttttgtagaaacgtcgtttcaccatgttgcccaggctggtctcgaactcatgagctcaagcaatccccccgcctcggcctcccaaagtcctgggattacaggcatgagccactgcacccagccaataattatgtcttataaagtaagacactgttgaccatagtaatgtgaatctgagacttctttgacattgcagaggattcagagcaaacattttccttatacttcctgaaattttggtgacattttccttttctggttttgaacctgggaaatataagcaggaattttcctatccttactgttctccactatcagcagtataggtagtcaatatctgcctctagtttatcagttggtctgcatagttatctcagacatttttgtactttcagttcatgtgcgtttattttcaaagtcctttagttcagtgcttctgaaagtttaacatgcatatgaatcacccagggagcttgttaaagtgcagattctgatctgaggtggggttcaagattctgcatttccttttattcttttttcttttctttttgatgaggtctcactcatttggccaggcaggatcatagctcactgtagcctccaactcctgggctcaagggatcctcctgcctcagcctcccaagtagctaggactacatgtgtgaaccaccatgaccagct

SEQ ID NO: 26577 - DNA, 1956 bp, Homo sapiens
attctggatactggacctctgtcatatgtatgacttccaaatattttatcccattctgtggactgccttttcactttcttgatagtatcttttgttacataaactttttactttttaactcttacatttagatctttggtccattttaatttttgtatgtggatatccagttgtctaagcaccatttgttgactcttctttacccattgaattgttttggtacctttgtcaaaaatcaattaaccacaaataaactttacaacaaacaacccatccagttaaaaacaagagcggaggacttgagtagacatttctccaaagaagatatacaagtggccaacaagcatgaaaagatgcacaacgtcagtaatcataagagaaatgcaaatcaaaaccacaatgagacatcatcccacacccattgggaagccactataaaaacaacaacaacaacaaaaaaaaaaaaaaaaaaaaaaaacaggaaataacaagtgctggcaaagatgtggagaaattagaacccttgtgcagtactggtaggaatgtaaaaggtgatgcagccactatggaaaacagtttgatggttcctcaaaaagctaagcatagaattactatgtgatccagcaagcccacttctgggtaaatatcctaaagaattgaaggcaggggcttgaagagatatttgcacacccatgttcattacagcattatttacaacagctagcgatagaagcaacccaaatatccatcaataagtgaatggataaagaaaatgtagtatagacatacaaacaatagaatatttttcagctttaaaattaaggaaatcatgtcacatgctaaaacatgaatgaaccttgaggacattatgctaactgaaataagccagtcacaaaaagacaaatactatatgattccacttatgtgcagtttctaaagtagtcaaactcataaaaacagaaatagaatagtggttgtcaggggaacaggaaggtgttattcaatggctatagagttttagatctacaagatgaaaaagttctgtagagccgttgcacaacaatgtaaatagagttagcactgttgaactgtatacttggtaaatttacaagtgttaagatagtaaatgcaagtgttctttaccccaattttttaaaaaatcagttgaccataagtgtatggatttatttctggactcccaattctcttccacggatctttacgtctagtctcgtgccagtgctgccgagtcttgagtactgtagttatatagtcagttttaaaagaggggaggttaagccctgcgactttgttctttttcaggattgttttggctattcttggcccttgcattttcatatgaattttaggattgacttgtcagtttctgggggaaaaaatccgggattttgaaaagaattgcattgaatctgtagatctgtttgaggaacgttgccatgttaagattaagtctttcagtttactcacatggatgtctttccatttacttagctctctaatctctttcagtgatgctttgtctttttccatgtaagagtcttacacttcttttgttaaatatatttctgtctcagtttagtttgtgtcatttgtagaccctgcagtttcagccagtctcagaaagactctactgacgtttttgtcttctttaaggtagtgtttcttccttatgtaccactgggccacacatgctgtgatgcaggccctctctagtctcagcatcctctcctcatctatcccggtatatcagagggattcttttgactttcttccatcttcataaatagtttggatatggaagttccatctctgatcacattctaagaaaatgatatgtagtggtagttaaatcaagatttgtggctctccctataaacttatattttgattataaactacatcagcctattgttgttgtcctctttgaacaaaaat

SEQ ID NO: 26578 - DNA, 1051 bp, Homo sapiens
gtctttgttagtattggcaccctgtgagtcatttaggcttgggctcttcaaatcattttaacatatcttcttttatatatgatattcagttaatcaagtttcatgtttttttcttctaaatctcacctttattcatctcttcctcttcagttacactgcttgtcaagcaagactaaaactgcatcacttcattttgaaattaggtaactgcctcctaacttactgtccttgactctgttgcttcttttcctatgcagggcattctgattagcttcaaacacttccactctgccattttctcatgtcagaatccttcactgaaacatagaagaatatcttcacaacccaggataggcaaagatctcttggataagtcacaaaaagcactaaccataaaaggaaaaataaatggacctcattatgttgaaaaacttctgttcatcaaaaaacaccattaagtagagtagccaccagctacaaaaatatattcacaacacaaatatctggcaaaggacttgttttcagaatgtatatttttaaattttctgcaaatgaacaatataaagaccaatgacccagcttttaaaatcagcaagacttgaacatatactttataaaagaagataaatgaataaacatggaaaagtactcagcatctttaagcgatcatggaaaggcagattataaccataattgaatatgatttcatacttaatagaatggctaaaatgaaaataacaccaccaagtgtggataaggaaggggaacaaaaggaactgtcatgcattgctggtgggaatataaagtggtacaactgctttggaaaattggcgttttcatttaagttaagcatgtatctacactgtgatccagtaattccaactttcagtatttactcaaaagaaatagaaacatgttcatatcttatacatgcatttactacacagagtagcagccttattcatgatagttcaaaactggaaacagctcacatgtccatcaataggaaaatggataagttgtggtctatttttgctgtggaaatcataca

SEQ ID NO: 26579 - DNA, 1050 bp, Homo sapiens
attcacaataagatgcattagaacattcagcagggactctttttagatgagcacagaaattctggagggtgattagttgatgcaccagtgcatagcatcacactaaaataagaatagcttaacaataatcctgtctgtggacaccaaagattatggccacaatgcagcattattattgacttcttttcttgatatttatgtaatctactaggctccaatcactttctcttcacaaacggctgaacttcttgctgaaaacagtttggttatgatttttaatacgaaagcacaacagcaatttctcaaactttaatactaaattgcatttcaaaagacttgtttgtggccaggtgctctgcttttgttagctgcttagattgtgatcagtgaggtaaactcatttatctatttgcatgcaattgagtaatttaccatgaaaagaatgatcgggttttggataaaggtactgcacctgtagcttaagttttataattgttggtttgactattatttgcaatgatcgtagtttcatactgctttagaaaacgacaatacaaaatatatttacttatttatatatgagatgttttgtttttagttaatgaatttggtttaagtttaccagattgggatgaattagtatgaattagattgtctgaacttcaggtgtgtatttctttttaaaaacaatttgcttgtcctatttttaaaaagcaaattaattttgtttgtgtaaaacactataactactagattaggaatagtgatattactttcatatgtcctcaaatgatttttagaaattaccattttaatagctgaaagataaagataattttcaacaagtattggttaagcagttgacagccaacaaaaagagatactgagatatttgattcattcttgtatagttgtgtgtgtatgtacctagcttaattgttgccgtttacggaaaatattgaaatgctcagaaagttagagaagatactcgttaagtctttttggctaggttcgtactcatttttgcttcaagaatattataacgtactt

SEQ ID NO: 26580 - DNA, 1818 bp, Homo sapiens
tgtgatggcctgcacctgtagtcccagctatgtgggaggctgaggtggaaggattgcttgagcccaggaattcgaggctgcagtaagctttgattgtgccagtgtactccagcctgggtgacagagtgacaccctgtctcaaaaaaaaattggccgggcacggtgtctcacatctgtaataccagcattttgggaggccgaggtgggcacatcacttgagaccaggaattcaagaccagcctgggcaacatgttgaaaactcgtctctactaaaaatacaaaaaaaaaaaaaaaaaaaaatccaagcatggtggcacatgcctgtaatcccagctacttgggaggctgaaacataagagaatcatttgaactcgggaggtggaggttgcagtgagcggagatcgaacccaaaaggcagagattgcagtgagccaagatcatgccgcaccactgcactccagactgggcgacagaacaagactttgtctcaaaaaaaaaaaaaaaaaaaaaatccttagcaaactaacacagggatagaaaactgaataccagaggttctcacttataagcgggagctaaatgatgagaacttatgaacacaaagaaggaaacagtagacactggggtctacttgaggaaagagggtgggaagagagagaggagcagaaaggataactattggttactgagcttaatacctgggtgataggtacaaaaaaagcctgtgatgtgttcatgtaacgaaccttcacatgtagccccaaacccaaaataaaaattttgttaactctcatcatgttttaggactggaagagaaaaatgggtgataatgcttttattatttaaaagtgtttttttttcctgagtcttattttgaaaaattatacagaatagtttgcatggcatattccttgcatcatagaacttgctctgcttcaggccaaattgaaatagagacagaaaagaaagagaccaagaaagaggatatggagaatatcagccatttgtttcctttcccgtattcaaagacaaacatctcagttgcctggatctcttgaaattagtacttgtaaaagcttttaagtgttactggaatacattgttaaagccatatctggttgaaattttctgattaagcacaattaaataattgtttcagcaattacacagttcatgattatggtatgtgatgggacattatttttttaaaatctattattaagtaaaatatgtattggtggccaagtataagttttagtacaacttgctatatcttggacattttgcatatatagcttaaagaccagtggggtagactgggaagttttgtcagcttcataattttggaaaacagaaaaaaagaaaaaacaatgctgattaaacattcttagccataagaagatatgtgagtgtggcttagctaataatacctactttcttactatgtatcacttaatagactttttttgctatgaaatattcaatagttacacatttgctattttatagttatttccctgccctgttaacatcaagggttactaattgttgcattagtagttcctgacaaatagaaattatttgatactctaagccatttctgatggaagatacaaagttttgacaaacacgtgtggcacagcaagtgtcccattctaaagagcaaaataaatgcaaaccaccattatggtgaacacaaacagcctgaaagcaagttatcagtaagcaaataattgttgaactgttatgaatggaataggatgttgaaatagggcatgattggctgatgttacatatgtccttgattaccttccttgt

SEQ ID NO: 26581 - DNA, 1059 bp, Homo sapiens
ggctagaattttatgattttaatgaagtgtaatgaattcataaagaaaagatacccatgcaaatatctaggtttgccatagtaacttttcctaattgcgtacagagcattcctgaggttgcagcccaatttaagagcaacttttctgggctgggttacagataagacctgatcttttttcctactctcattccctcttccatatctcagggccttgaaaataagccttttctgcatctcaccatgtttcttcccatcttttatcttagtgggcagctgttgctttggctagaataagagcaaagtgaattggcatatctatatttgagatcagtaacattacttaaactattatattcctttattctaaattgacctagaaagcatgtcccatcaaaaacattagaatgtgagactcaccctcaaaagcctatttaattcacaatgtagtagaaatagaacaatttgagaaatatttttgtatctgtgaccatttttacgaccagttttaaaattctgctttttaaaaatgtgttttaaaataaccgacttatgaactttgcatatactcctgtttatataaggctgggactgcacattgctgtgcaatctgtatttttaatgctttacatcaagaaaagcaaaacttggtaaaaaaaactgtcattataaatgcaaatttcaaatttatgttccttttgaagactgtgagctcattgaggaggtgggtactgttttctttttcctttttaagcaaataattattaagaattattaagcccttctgtgtgtcatgtattatcttaggtggtgaacagaaaaagccctttctcctggaagacttacagtctcatggagtaatagacatccaacaaacagacatttaatataatgcagggaatgattaggaccgtgaataaaaacaaagcagagtaagaggaaactgttttagttagggcggctggggaagaccttatgaaataaggatacatgccatgagagaatccatggaaagctcagttcagggagaggaaactgcaagtacaaaggctctgaggta

SEQ ID NO: 26582 - DNA, 1053 bp, Homo sapiens
ttttacatgtaataatatttgtgaattcctatttggttttcattaaatgggttttgaatattctttcgacaatttcatattcttatcgagagataacaatacagtagtgcacttctggtttcttatgaaagagataattatatacgaaagcactttttttatatgaacataatgctactgaccctatgcatattaggaatttcccttggcctgtttgtattttttgcaatactatttatagccaatgatttctatttgccagatggttcactgaattcaagaaagtgatacatttgggagtgcccgttgtaatcttcattagcaccatctgctgacttactgatttgtgagtgatgtaatttatcaaatatgtcaggactttcatctttttcaaactagctgaagaatttcactccacataaacaggaaaagttatataaaattttttctagcttccacagattaaaaggtttataagtactttttaaaaaattaagtgttccttaggattctgtcatgtgaaattaaaatatatattctctatacatgtacacacatctatgttctaggaaatgaaatataaagtttggtttatagctatccagtgttcttcaaattacaaatgattcatctacacaaagaatttctttgcttccctaccctactcactttgttgaataattcaaaaacaatccccttaaaaatctgcactagagattaaggatctctgagtcatattttgttaccaaaacactgagttgggatgagctacacttttacaaccggagttgatatggtttggatttttgtctctgcccgaatctcatgttgaattataattcccagtgttggaggaggggcctggtatgagacgattggaccgcaggggtggatttccttcttgctgttctcgtgataatgagtgagttctcatgagatctggttgtttaaaagtgtgtagcacctacacctttgctctcttcctccttctccggctgtgcctgcttcctgtttacctttgccatgattggaagtttcctgaggcctccccag

SEQ ID NO: 26583 - DNA, 1022 bp, Homo sapiens
agtaatcaagatgttgtaagtgaatccacaaaccattttttattattacaaattgctgtttcttgaatgagtaaaactatatagaagtttttgttgtttttggtgagcacaagcatttttgaacacttgaggttttcattttctaaacacgatcagctgttacttataactaagattatactatagacggtattaattttcatttgagattgcttactgagtcatggtgtcaagcaggtacaggacattagaactgtcaaactactgcttaattaggggtttaaatttcaatctttgcacccttgctgctctgttagtagaatatgccatccaattatgaaatcagtagaataaactaattttacatattttttacacctaccagccatcaattatgtttcatttttgtgatcctacctttcttgaaactgttaataaaggataattatattttattatttattatactacatatttatgttcaactggaaaatataactaaacttttagatacgcagactgtgtgtgtgtgtgtgtgtgtgtttgtgtgtgtgtgtgttatacacacattttcatatgccctggtgggcttgtagtcatttaacattaccttttgggtaatattatatgagtcaattaatctgagtgatgaaattgattcaagataggtagacaaatacttggaaagtcttttaagttgtttaataatgaagggcaatgtgtcaagttcactaaatgcattttaaatagaaaaatgttttattattcttattataccatgattcagttccttcccctttcccatctttatgtgttcattagttttccacataatttgtacataacaactaaaaatagtttggggatactacacattatgtgcttggtttggggggaatcatggaataaatatattttcttgatttcttgagctgcctataaaaattacagctactatatctcagtaagtgtatatgtaggtggaagtgtgtatatttttgacacacaattttctatttctg

SEQ ID NO: 26584 - DNA, 1064 bp, Homo sapiens
aaatttattacttgacctcagttaataaatcttctcattgtggtatgaatggtaaggtttcctgaggctctgtgaaacaatacagacatcaaagtttacatgaaaagggatgagtcagtttccttgcccaaagggacttctcacacctgtatttggatgattacaggtagaactccctggctctaattgtatagtaaataccatttcccagaccctaatggtagacagactgcttaggagacgccagtctgtgatttagctgtcgccagacaccccatgttttttgtgagaccagttgtgatgatgacatggttatagccaattgaaagtaaacccttgtctaaatagcaaattttaatttataataatgtagaggtatgaatgatcctattttataaaaccaaatcttaataggttttatgtataactaatgatctggcttggggttggtgtgtgtatgtcttggggggagggttgggagggatccagatcttgtggaagttagtgtaattgtagctgaaagatcaaagactgggtaactgaatgatgttccagaagagaatttaccacatagccattttctgtacagtttctgccgcctgctgttcctattttccctcaagctagccattgactaccccctgtgcatccctgctcgtaaaaaatgattgaggaagtatttgtcatatatttatgagtgggaaatattgtgtgatagggaatggcatctactggagccagaaagattgccattttcctttcattcagccactctgctacagctttaaatcctctctgtttatgcaacatagcctttgtattaaagtgcagaataaatttttattatgagggatatgaacactaggttttcatcatttataacactgaaagcagatgtaaatagttaaaatccattttaactactaaatccttttaattgtgttagcatcttgttttttggtaatgtttacatctaagctccatttgcattattagttgcttctttagcaaaagaaaaagtttttgttttttaagattaacatgtaatgttactatagcaaata

SEQ ID NO: 26585 - DNA, 1037 bp, Homo sapiens
aggaaacaaaaatttgtgtgacttgctttatagcgatactcactttattgcacttacttttacttgctttatagcgatactcactttattggaactaaacctgcagtatctctgaggtatggttgtactgtaaaaatatattcttcctccttttatcttcacatttacctctttcttctctttagactgttgtgtgtcctttcaggtctattcatatatgacttaaagagatcatttctaaaagaacgtgatactaatttttggtaaggctgaactctcagtcctcataatctctagttagtggaaccaaattgtttaacagaaaagctgtatctgtgactccttcctcttttgcaccatctacatctcatcctgttgattttatctcttgaatattccccatacctctttcttcctcctgcttttattactacttctttggtttgagcctcacttatgcttaatttatttttgcagtttaactgatctttttgtctgtagcttgctcttgttttccacaaatacaaaatgaagaactaatcatgttattcccttgattaaattacctatttcctatgggatagtgccaacataaaggccatggctcacaaagttctttgtgatttgggtttgcctggcttaccattacttttttctcaactctcctgacagtgaacgtaggactttaaacgtactgattttacatgaggtcatttaccagaactttacctgtttggtgctcttccattcccatttctttttttttttttttttttggaggcggagtcttgctctgtcgcccaggctggagtgcagtggcacgatcttggctcactgctaactctacctcccgggttcatgccagtctcctgcctcagcctcctgagtagctgggactacaggcgcccgccaccatgcctggctaatttttgtatttttagtagagtaggggtttcaccatgttagccaggatggtctccatctcctgaccttgtgatccgccggcctcagcctcccaaagggctgggattacaggc

SEQ ID NO: 26586 - DNA, 1055 bp, Homo sapiens
taataaatgttccaaaatgtattttgaagcttttagtttacatatgattgaattgtctttaacatttaagaaacggtgccctggccaggcgtggtggctcacgcctataatcccagcactttgggaagctgaggcgggtggatcacctgagatcagaagttcaagaccagcctagccaacatggcgaaaccctgtccctactaaaaatacaaaaattagctgggtgtggtggtaggtgcttgtaatcccagctacttgggaggctgaggcaggagaattgcttgaacccgggaggcggaggttgcagtgagccaagatcgtgccattgcactccagcctggtgatagagtgagactctgtctcaaataaataaataaataaaatatttttaaaaataaaataaaatgaaactagtaagagaaagtaaccaacacacagtatgtaaatgagcaggttacccccattggcaagagtaaagaagctggggtaattatcaaccaatttatatcagttactggctatgggctactcctaggagtgttaactccttggtgcctgatgtctttgtggtttgagcatagaatttagtcagactaacagatgcttaccttaagccatcaccatgtactagacccatgatggcaaaggggattttgggcagggtaatcctgtaattccagcactttgggaggccaaggcaggtggatcgcctgagatcaggagattgagaccagcatggctaacattgtgaaaccccatctcgactaaaaatacaaaaattagccaggcgtggtggtgcacgcctgtaatctcacctactgaggaggctgaggcaggagaatcactggaacctgggaggtggaggctgcagtgagcccagatcatgccactgcactccaggctgggcgacagagtgagactcggtctcaattaaaaaaaaaaaagaaagaaaaagaaaagaaaagggataactatatgattatgatatcaactagttactgtagggaagtttcttttagaaatatatttcttaagttctctagcaaatggtctaa

SEQ ID NO: 26587 - DNA, 1049 bp, Homo sapiens
acagggtttcactatgttggccaggctggtctcgaactcctgaccttaggtgatctgcccacctaggcctcccaaagtgctgggattacaggcgtgagccactgcactgggccctactttctaacttaaggaaagtaattaaaactacacatcttacttaatgcaaagatacatattacaagctttaggttaaattagattatggttttgctcaaattgctcaaattgcttttgttgccaagatggtaaggagctttagctagattaagactagagttttaaagtgtttctgtaaaccagggcttaaactatattttcaaatcagagcttttggagtgtgcaataactagttttatacctcgtccctcgtcccgttcacatccccactcgcaccccaatgcaataaagaatttttgtcatgtcatttatggaaaataaataggagtttgtattttccagtgtttattaataaaactatagatattaaatgaattgccaatgcatgtttagctctctcccttctcttgaaatattaatgagctagagaactataagggagttgggaaccagagttctgacataaggtaatactttgttttgaagaatggattggaaatttgaaaacataaagttttttttttagcagtatattcttgtcttgatttctaacattgtatttaataattgatcttctattggtttaggaatctggcccctaacctctgaatgattgtggtgggactctggattagaatataaatactcaaaacatttactgttaacgcgtaggacaaactggaaagcaatgtaaaataatgtagcatatagtttgttttggtgctgtgatttgatatgaccatatatttgtgtaataattttatttctctttttctgaagtttgcattttagaagagtggttatctggttgacatcgttttcttgagttaatttgcactgttcatcctgttttcatgtgtcccatcagaattctaatgccgttcttctgatcgtatgtagagaacagcgattcccttttagctggttcttta

SEQ ID NO: 26588 - DNA, 1040 bp, Homo sapiens
cttgtagactgactaggacgttataagattgcagtagaaattctagaaagatctcagggagatcatacccattttgttgggccagttgaggtgggttacatcagaaaagtattgaggatgcagtggcctcccttacacagtctgctcccaaaggatgtggttgcttgcttgtccttcatctccctaggtcttatcctttcttacatgtttctactctcattttagaactgtgtgttaatgcatttaatggtgtattttgtgaggtatattatctggtttcagggcatctaccatcacagtacttttcatttggacccaagaatgtgatctctattgtgtaatgtggatttaatcagaccatcatcttcctattataacactaggtgttcttggtgagtcatccctcttacatttctgtatttccccttctatatcttagaaaaattagatagaagtcaaaatccattgacattatgaataaaggttataaaatagtttttttaaacagccaggcatttacttgactgattaatacctgtcccatgtttacattttccaagcatttaaacactagtttcaaattccagcagagacagtattttctctcttctcacagcatcaaaatacacttaaatatgggattaaaaatagtttatactttcatcaaaacctgtacatgactcttagtataacttttaaatggcatctacataacaccagtgctcaaatttgaaaccttgaaggctgtctttttccatcaacttgtgtgaatactgactccttccctgttccccttcatcttgggtttactttcttgtttttattatatgctgatctgtctcccctgttaggctgtaatcacttttgaaagcagaaactagttgtgttccgctttttcttatctcagaaatttgccttccagctcctggcaccattctctttgtgattaacatccagtaaacatttgttaaatatgtctcttaaaatatgtatctttttaactatttatacacctccaagtggatgacatgccacatttt

SEQ ID NO: 26589 - DNA, 1035 bp, Homo sapiens
catgtgacctctgcctcccgggttcaagcgattctcctgcctcagcctcccaagtagctggggactacaggcacatgccaccatgtccggctactttttttgtattttttggtggagatggggtttcaccatgttgcccagactggtctcaaactcctgacctcaagtgatcagcctgcctcagcctctcagagtgttgggattacaggcgtgagccactgcgcccagcctgacatttgagttatgaatggtaaatcatttgctagacaatgaatagaggaacggcattctcattcttataaagtgtgtttctttttgtctctgttactgaaattatttaatttgataagctaatccggtcctttgataggtgatactcttgcatatgataagcgcttaaacattatttaaacaaattattttacatttaaggaagaaaactttaactggaaagactttggttagatgaaagggaacaagaatttctttggcgtggactctccagcaaaggcaggaataggatcaacattcgttctataccatctttgtgtcagaaatttcgcttcacagtgtttttcagtacatattatcagtgtttggaaacgaagaaacctttgaaaaagattgttgttagctatatgaccttgggcaagttaatggcagaactcacaatttctgaagacaggactgttgttggcctgaacataccctttctttcacctcttatgtcagttggatgtattttccttaaacatatttgttttctgaatataccttatgcattccacccttgtttttgctgtatcccattttaaatatgggacagtagatactcattattacaatgttttatttaggtaggaagcgtaatatatgagttgtaatactttcagttacagtagaattccagttcaaaatggcttagaaaataaagatagtctatatattggcttgcagttactgagaagataagatacatggtttcatgcaatacatgatcagtgcactgactcagaactttccctaaggtcttaa

SEQ ID NO: 26590 - DNA, 1051 bp, Homo sapiens
atgattaattgaaactttttttgcttctttcaagaattgctctttaccttcgacatttgtgtcatacctctgctattgtatgtcttagcattgcacttcaatttgtaaattgctttcaataaattgtgtaaatttttattcattaatgcttcaagtttttttttctccccatctctttcccctctccttttaggactttaattatatgcatgttggggctgggtgcagtggctcatgcctacaatcccagcactttgggaggccaaggcaggcagatcatgaggtcaggagttcgagaccagcctggccaacatggcgaaaccccatctctactaaagatacaaaaaattagctgggcgtggtggtgtgtgcctgtaatcccagctacttgggagaatcgcttgaacctgggaggctgaggttgcagtgagctgagattgcgccattgcactccagcctgggcaacagggcgagactccgtctcaaaacagaagaaaaattatatgcatgttgaaccattttatattatctagtaggtccctgaggctctgttcgtttttattctgtcttctgtgtgttcagattagtttctgttgatttatctttgacatattcttttcctcagtcatcttaatttggctgttatgtccatatatctagatagatagatagatagatagatagatagatagatagatagatagatatacatattgtgtttatcagttctaaatttgtctcccttcctccctgccctcctttcttcttctcttcttccttctctcccaccatttctatttctctgctgggagtgcctgtctcccagttcattgtgtgcataatttacttttatttattgaaggtagttttaatagacacttaaaatttttttcagctactttcagcatctggataatctcaaattcaatctcacttgttttctgatagcattatgcttgatttttttaggtaattttagattgtatcctggacattatgaatgttacattatggcgattctaggttccagtttttctctcatatgtgtagc

SEQ ID NO: 26591 - DNA, 1027 bp, Homo sapiens
ttaggtcatttcagatttttagttcttcagatatttaactctttcttccctctttcagttccttattttattgagaaaacagaagcagtcagaaaagaattacctccctcttttcccacaatttattcactcaaggatatgatagtgaacaaatgaaacaaaaatctgtgccctcaaagtgcttatatactaaaggagggagatagacaataaacaaggtgtttcaaaagtaaagtatgttgtatattagatggcaataaatactgaggagaaaaagtagggaaggagcatagtatagtaagtgttggggtggagtttgcggttttaaaggcaaggagagagactcactgaagttgacagttgagtaaataactgaaggaggtaagggaaaaaatcacgtaaatatttgtaaacagaggcaacagcaaatgcgagtgccgtgaagctgagtgaggcctgctctttctgagttctgtcaccctacatccacttgcatcatatactctacctttccctctgatcataacaagtgagttgtccctgcccaggccaaccccatccacttgcacgtgaaatctgcttccctctgtcatataggactatgatcctgctgtcatgccctctcttacgtatttcacattttctctctagttggttcccctgagcttgcaaacatgcagtaatatcacccatctttaaaaaatgaacataaaagaaaaacaccaaaacaacagagtcccttggccctcattccctcctctccccagctactgtttcatttctttgtttgccttcacaacaaagctaaaaagaggtcatctccacttcttcacattcgattccttttaaaaacctactccagtgaagttttgctcccaaaagagcattttaaaatgcccccttgtttatgtcaccagtgacctctatgttgccagatgctccttttccatagttttctctgattaagtattagcaaatcatgtttttttttattatttgttttgccatactagaatgtaagatccaa

SEQ ID NO: 26592 - DNA, 1050 bp, Homo sapiens
attagataataaatattataggctttgagggtcatatggtttttgaaactactcaactttgcagttgtcgtgtgaaatatgaatgaatgaatgagcacgtaccaaatatgaagtggtgtgtaggctgagtatctctaatctaaaaattcaaaattaaaatgcttcaaaatctgaaactttttgagggctgacatgacgctcaaaggaaatgcttgtaggagcattttagattttggatttttagattatggatgcttaactgataagtataatgcacatattccaaaatccaaaataaatccaaaatctgaaacacttctggtctcaggcattttggataagggatacttataatatcacttaaaggtggactcagattaatgaaaaatgtatattgtaaacctttggacaactactgaaagttttgaaatagagtcataataataaatctatagaagagacaaaatggaattataaaaaaatccttagcacaagtcagagaaagaggaagaaagaaagaatagctggagtaagtagaaaattgctagcaagatggtagattttagtccagtcatatcaataatattaaatgtgaatattctaaatcagggattggcaaactgctgccggctagtttcatttgtttgtacatatgtgctgtgatcgagagaattcctggacttagagtgcatctagaatttagacagccataaacatgtgcatgaggaagaatttagataatgcacggtgtgatccaccagtttactggtaatttttttttcaagaaacaatttttggttggatgtggtggctcatgcctataatcccaacactgttggaggccaagctgagaggattgcttgaggtcaggagtttgagaccagcctgggcaacacagtgagaccccatatctacacaaattttaaaaaataataaattagctgagtatggtgacgggtgcctctagtcccagctactcagtgggctgaggcgggaagatcacttcagcccagtagttcaaggctgcagtgagctgtgatttcacctctg

SEQ ID NO: 26593 - DNA, 1070 bp, Homo sapiens
atagcctccaaagtaatggttctcaaaattttttatctcgagactctaaaacttttaaaattattaagggctctcaaaaccttgtgcttttgtaggtaaatgtcaatcagtatttaccgtattaaaaattaaaactaagatttttaaaatgacttaataattcattttaaaaccacagtaaacccattatatgtgtacataatatattttttgagaaatgattacattttctaaaacaaaaatatttaatgagaccaagagggattgcttttttttttaaataaatttctttaatgtccagcataagagaggacagctggattcttatatctgcttgtacatttaatctaacactgtatgttgttttggctgaggtatataaagaaaacctggcctcagatatgtggttagaaaagggaagagtattttaataacctttcagataattgtgaatattcttctttgatactacatcaaaacttgacaaataatagtatcttaaaagttaatcggaatgtggaatctgcaactataacaatgaacattctgtactcatattaaagtcccttagtctatcttgtactttgagtgactcttttacccatttggttgtttggaaaatgctgattcttggtgagtgatacagatattccaaatcttgagaccttatgtgatacagtatcaaaaaaatcaaatctgttgatatcaccacagatctcatcagaaaaatctttaaatattgggaagttgtcagggttacagtggcaaatgcacattttcaaaaattataatttttacttgaaagtctgaatcctgccacctcccaaccccccactatcttgccaggtcttattaacacttgacaaggaatggagcattggctgtgtttgagcagctgccccctgctagtgtgtaattcagggaattgggaacatgggaatgtttttgggtggtgtggtctgtgtctgccccatcctgagctttcccccggtggctgagagcctgaattttataatttacaagaaaatggctgccagatacaaaagattaaataaccatagtttgaatgt

SEQ ID NO: 26594 - DNA, 1033 bp, Homo sapiens
caactcatgtctgtagttgggaatagtactcaataaggcaagtctgactctaaaaacagcactgtttgcctttgtaccagtgctgaccaatggaaatataataaaagccataaatgtgagctacatatgtaatttaaaatttttctgatagccacattaaaaaagttaaaaagaaacaggtgaaatcaattttaataatatttaatgtaaccaaaaatattatttcaatatgtcagtatgtcagtatggactagccatatttcaagtacttcttaataacttaatggtacttaatatcttgtggctatttgctacagtattggacagccaagccctgtactataagcatagaaaaaaatttgaaaaagatacattatactattgatagatttctgaaaaatagaactggggtggagggagaaatgggtgatttttatttttcattttagaccctttgcttttaaaaaagcgaatatgtattattctgatttttaaatatgaggaatttttcattttaaataccagttttggatatgatatgtacaaatgattcaaatataattttctagagttctgcattaaaacaatgataggatgattttggcttagaatgatgtgatgtatggagttatcaataatgtatttctaaaatgtttgttttttaagctgggctaatcatggtggttctaccaggatgatttaggtaaggggtttaccctcagataatgaacttagtgggttctgttgttagagaacttacttcctcgattgttctcatagtgttatgtttgtacactctgttctaccataaagtgatattctaagaaactttagtgtagtgagagaaagagagagagagagagagtgtgtgtgtgtgtgtgtgtgtgtgttgtggggaggaggaagggaggctaagggaagggacggctgcccttacctctttgtcctaataacaaatgaatttctttgcacgcaactgacttttccctattctgtgtattcttggtgagggaatattatctagcttcctcct

SEQ ID NO: 26595 - DNA, 1119 bp, Homo sapiens
aactcctggactcaagcagtcctccgccttggcctgccaaagtgctgggattacagtcatgagccaccgtgtccggccagtaatgtgtaaagcttctttcacacacaacatgtatttgcccaggtgtggtggctcatgcctataatcctagcactttgggagacctacgcagatcacttgagcttaggagttcaagattggcccgggaagcacagggagaccacattgctacaaaaaaaaaaaaaaaaaattagccggccttggtggcctgtgccttgtagttccagctacttgcgaggctgaggcaggagaatcacttgagctcaagagttcgaggctgcaatgacctgtgattgcaccactgtactccagcttggatgacaacaagatcctctctctaaaaaaataaaaaagattaaaagaatcaatacatgttacttagtttgtttacccccaaataatgtcccctcccacccctggggtttgctgcctaatgtaaaggtatttcagatccttacccccattagtcatttagagttttcgctgaagttttattttcagtaggtttgtttgcaaagtgtactaatgaggacatgcaagatagtagaaataatgaaagattattttcttgtttgaatatgtgcagatctggagttactgtagttttttaaagtatatttttgaagttactgtatgctaactcgtaactatggattcagctatataaacgggagtttatctttcactaaacaagtgctgctgaggtgaaagttaggtcttattttgacacttaataaacataacaactgtcagaatttgcatgaggaattacaagagctcatcttttaattctggtggtttttttttcatcaggaaagctttgtgagaagtgtttttacagtacaaatgaatgtctgcttattaaatttaatttgaaaacagaatcagtcttcatttatcggagggtcacttatttttcttgccctagtttaaatccttggaatacttttccaaaaaaatattggttcttcattgatagtaaggagctgaaaaaaaaaattcaaagccagttgcagtggcacatgctggtaatcctagctactcagaaggctgaggccc

SEQ ID NO: 26596 - DNA, 1034 bp, Homo sapiens
tagataacattttctttatccattcatctgttgatggacatttggttctacctcttggctattatgaataatgcatcaatgaacatgggtttgtaaatatctctttgagatcctgctttcaactcttttggatatatacccagaagtgagattgctggatcgtatggtaattctatttttacttttttgaggaacctcaaactgttttccgtagcgtctataccactttacattcctaccagcagtgcacggagttctaatttctctgtactcttgccaacacttatcatcttgtttttttgatagtggccatcctaataattgtaaggttatatctcattgtggttttgatttgcatttctctagtgattagtggttgagcatcttttcatatttttttagccatttgtgtctctttggagaaataatctgttgagaacagacatttctctaggtgtgatcattgctgctgaagtgttgctgtttttaggccttcttctccgatggaagtagaaaatatgtaattatactcacccatgtatacatggattggcatttatttctgtcatcttacgtatttgtgtatctatcagatagatgcttttaacagtttagttatatctaattgaaaacattttgaaagaactttctacttcttttcccatgttttggatggatattatatataaatagttaattcagaatgctgtgggaatttgcactggtatccctacttcccattacatgctgcaattttgtgtaaagttttacataaaacatctattcagtcagattgacttaacagagtaaaatagtaatttccaaaataaagtatgtaggtcctaagtctagggggcatacatttagtctagtcactgtgttttttttcttttaatgctatctatcattgctgaaataagttatgtaaacccattcttgcatgagagaaattcctacaactttgaatctttctcctgcttttaagctttaatattaacctcaagggatctaggggtgcgtgtgtgtgtgtttaa

SEQ ID NO: 26597 - DNA, 1016 bp, Homo sapiens
gacagagtcttgctccattgcccaggctggagtgtagttgcctgatcatagcttactgcagcctagagctcctgggctcaagcaatcctcctgcctcagccacctgagtatagctgtgactacaggcacacgccaccccacctgagtaattaaaaagatatatttttgtagagatggggacttcctgtgttgcctaggctggtcttgaactcctggcttcaagcgatctctttgcctcagtctctttgtgctgggattacaggcattagcctccatgcccagcctatactgtaatttttatggttactttagagtgtactctttctacttataaaaaaaaaaagtaactgtaaaacagccgttggcagttccttcaggaggtattccagaaggaagcattgttatcataggagatgacagctccatgtgtgttattgcccctgaaaaccttcctgtgggacaaaatgtgtaggtggaagacagtgatattcatgatcagactccatgtaggcctgggttaatgtatgtgtttatgtctcggtgtttaacaaaaaagtttttaaaaaaagcacacattttaaagatataaaaaagcatatggaataaggatataaagaaaaaatatttttgtacagctatacagtgtatttgtattttaagctaagtgttattacaaaagagtcagtaagttaaaattaaagttgataaagtaaaaagtattggtaagctaaggctaatttattgaagaaagaaaaatattaaaaaataattttagtgtatcctgaatgtacaatgttcataaagtctacagtagtgtgcagtaatgtcctaggccctcacattcactcaccatcactcattgactcacccagagcaccttccaggcctgcaagctccactcatggtaagcgtcctatttcacttttatatgtatttttactgttccttttctatgtttagatatatagtacctgccattgtgttacatttgtctacagtgttcagtacagtaacat

SEQ ID NO: 26598 - DNA, 1049 bp, Homo sapiens
gcataatgaaattaatgtacgtggaagtaacctaaaaatattttattattcagaataagtgtgtgtgctgtttacacttttaaataaaatgctttcccctcccagtgtcattgaggtatacttcacaaatagtaaaattcactcattttaaaggtacagtttaatgagtttcggcaattgtatttggttgtaaacactactttttgtagaatgatcttacttcacacaactgtatcaggtaggattctttgtaagcaacacaattctggctgttttcagcaggaaaaagaggtttattggaataagtgaattacaatctgaacagccaggcctcaagagggataagagccaagtggtgctggcagaaatgggtccatgtggagctcagccatgtgaatccctggatttctgggtgtttctcatttcctgtctctcctgtaattccaattcctgagtaaggaaatccgaccggacttgtgtgcttctgtatagatctacaagatatagattgtgggagggagacggttctctaaaggatggcctgctgatcaaaagtaaggacattcagtacaaaaccatctagagaatctcttggtttttagctgggtgaataggaaggcttactttttagtctgcataaggctgatgacccagaaacttagaggtaatatttatagctaatcagatattgaacatttactatatgccaatcgctattttgagtactttatatatattatctaatttaataagtggtttgacattcccctccattgcaatttaaattctgtgaaggtaggaaggtaccgattgtctcgttcttgcttattggtatatttctagtgcctagactggtgttagaaacatagtagatatttagtaattatttgttaacgggacacgatggtgttaggaacatagtagatatttagtaattatttgttaatgggatacatatttcccctttgacggctggatgtagatttagtgataaggagacatgtttttgttttttgaacaagattttattctcttgcccaggctggagt

SEQ ID NO: 26599 - DNA, 1034 bp, Homo sapiens
gctgccatccatgaaagatgtgacttgctcctccttgccttccatcatgattgtgaggcttccccagccacatggaactgtaagtccagttaaacctctttcttttgtaaattgtaagtttggggtatagctttatcagcatgtgaaaatggactaatatagtaaattggtaccaatagagtgaggtgttgctgaaaagataactgaaaatgtggaagcaactttggaactgggtaacagcagaggttggaacagtttggagggctcagaagaggacaggaaaatgtaggaaagtttggaacttcctagagacttgttgaatagctttgacaaaaatattgatagcaatatgaacaataaggtccaggctgaggtgatctcagatggagatgaggaacttgggaactgagcaaaggtgactcttgtgttttagcaaagagactggcagcattttgctcctgccctagagatttgtggaagtttgaacttgagagagatgatttaggatatctggcggaagaaatttctaagcagcagagcattcaggagttgacgtgggtgctattaaaaacattcagttttttaagggaagcagagcatgaaagtttggaaaatttgcagcctgacaatatgataaaaaagaaaatcccaatttctgaggagaaattcaagccggctacagaaatttgcatgagtaacaaggaaccgaatgttaatccccaagacagtggggaaagtatctccagagcatgtcagaagtcttcatggcagcccctcccattacaggcccagaggcctaggaggaaaaagtggttttgtgtgccaggcccagggttctgtgctgtgtgcagcccagggacctggtgccctgtgtcccagccactccagctgtggctgaaagaggccaatgtagatcttgggacatggcttcagagggtgcaagccccaagccttggcagcttccatgtggtgttgagcctgtaagtgtgcagaagtcaagaattgagatttgggaacctccacctagatttcag

SEQ ID NO: 26600 - DNA, 1050 bp, Homo sapiens
ggattgttgtgtcttcctgggtaattgacccctttataatttatgtgatgtctctctttatccttgatgattttccttgctctgaaatctacttgtctgacattaatatagttactccagccttatcaattagtgttagcatggtatatctttttctgtccttttaatttatctgtgtctttatttctaaagtaggtttcttgtggacagcaataacatatagttgggtagttgggtcttttttttttttttatctactcaaatagtcttttttttttttttttttttaagagacagcatctctctctctcttgcccaggctggagtgcagtggcgaggtcatagctcactgtggtctcaaactcctaggcttaagctatcttcccaccttagcctcctaagtaactaggatgacaggcatgcacaatcatgcccaccaaatatttttttggtgggggacagagtctcggtctgttgcccagctggagtgcagtggcatgatctcggcttactgcaacctccgcctccagggttcaaacgattctcctgcctcagcctcacaagtagctgggactacaggcgccccccaccacacccggctaatttttttgtagttttagtagagacggggtttcactgtgttagccaggatggtctcgatctcttgacctcgtgatccgtctgcctcggcctcccaaagtgctgggaatacaggcgttagccaccgcgcccaatgcccagctaattttttaaaaactttttggagagacaggctctcattatgttgcacaggctggtcttcaactcctggcctcctgtcttggcctcccaaaacactgggattacaggtgtgagccaccacacccagcctctgtcttttaattggtgtgttaagaccattcttatcaaaagcaatgattgaaatagttggattaatatctactatatttgtaattgttttctattcattaccctaattttttgtttcctttttttgtctcttagtttctgttttctctggtgttaattgagcatttgataggaatccat

SEQ ID NO: 26601 - DNA, 1052 bp, Homo sapiens
tcccagtactttgggaggccgagtcaggtggatcacctgaggtcaggagttcaagaccagcctggccaacatggcgaaaccccgtctctactataaaatacaaaaaattagttgggtgtggtggcgggtgcctgtaatcccagctactcaggaggctgaggcaggagaatcgcttgaatctgggaggcagaggttgctgtgagccgagatcgtgccactgcactccagcctgagcaacagagcaagactctatctcaaaaataaaataaaataaaataaaataattaataaaatggtgtagtatttgcatataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcggttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaaagaaaaagaaaaagaaaaaagaatacccaggtgtggtagtgcatgcctgtagtcccagctactttggagactgaggtgggagtaccccttgagcctgggag

SEQ ID NO: 26602 - DNA, 1050 bp, Homo sapiens
attttaatttcaagatactaataaaagctgattagctttagagttatccagacctcatgttcattgtgttcctggcagcaagagggggtctgataattattgtactattcgtgttttgaatttgttccatgctttagcattttctgaacctctttagaacattttacaaaacattttgtattttttaacatttcatgaacacctttagacatattttgtgttcttggttctgttgctgtagtggaaaacttataatactttatcattcagaaaacaaaaaaaaattctgtctgtaaactaaatagtgcctgaaagagaacattgatccatgaaagggtaaaaggtttaagtataagtaattatagttattcattaaaaaaaatttttttttctgtctcgtgtatgccaggtactgtcctagatgttaaggacacaacattgagcaaaaacatgcatagtccctgcttccgtgacacttgagtgaactgaatgtgcaaagtccctgtggcacaaagtccctggggccagtgtgtgtggcgggtgtagaaggagctaaaggtatattggtgggaggtcgtcatttttttctctctctcatgttctaccaaaagttatatttaacttccgttaagtaattactctgttccagatgtgattataaagacttcagtggaataatcgcaagttcccatgtggtaggtattactattattgccattttacaggtgaagaaggtgagacacagaaaagttaaagttaattcgttcaggtcgggcacagtggctcatgcctgtaatcccagcactgtgggatgctgaggcaggcagatcacctgaggtcaggagttcaaaaccagcctaagcaacatgtcgctacaaaaatacaaaaattagccgggcgtggtggcacacgaatcgcttgaacccaggagacagaggttgcactgagctgagattgcaccactgcactccagcctgggagacagagcaagaccctgtctttagaaaaaaaagttattggtttaaagttgattagtagtgctctactata

SEQ ID NO: 26603 - DNA, 1032 bp, Homo sapiens
acccccaacagctacctgagttgaaaattactcatctagcccagttccatcactttacaggtaaggcaatgttagacaacatacgttcttttcatgcctctggcctctgatcctagcagaatcaggacccaacattcagattttacaatgaagctagtttctgaaatatgcctctcttttaaattctttgactgttactgttttctcagagttatatactatgtgttgcatatgtaagtctgaacctttaagatgggttaagaaaaaattatgagcattttcagatcgttctatacataactcaaggttttgataaaatgttttctacatgtattccattgccatccacctcttgagttctttaataatgagaaatctgactttcttccttccaccctctttatctctatgcttttgtcaagcatcttctaggagagttactgttatcccattaagtgtgggggacagaaacatttggcatagaaagctatggatctgcagctgacttaagctgtatattattaccctgacttgggcaccaaaatcacgtttcaaaactcatttgctgccaagtatggtagctcaagcctgtaatcccagcaatctgggaagctaagatggaaggatcactttgaagctaggagtgcaagaccaggctgggcaacaaagcaagatcccatctctaccaaatataaaaataaaataaattagccaggtgcagtggcatatgcctgtagtctcagctactcaggaggctgaggctggaggattgctcgaacccaggaggtcagggccacagggagctatgattacgccactgcactccagcctaagtgacagcaagactgtctctctaaaaaaaaagaaataaataaaacaaaaccaaaaaaagaacctcatttgccttcatacacctgacctgctctctttacctgcatttgtaactttctccccacacacttgaatgccctgtaaatgagaagaagcccttagcctaatgaagcgataaggtaaggtaggtaagagcttttc

SEQ ID NO: 26604 - DNA, 1028 bp, Homo sapiens
gtatcacccgaacctgaaatgaggctaaagacattaatggcgctggacagtggagtggagcccaggctttggccactgctctgctgctgccagctgtgtgacatgagcaggatgcctaacttctctggacccctgtttcttcctctgtaagtggtgatgtagactttgatctctgcaagtctcctgcagccttaaagttcttttctttttaaagaacgtggctgctggaaaagctgacactgagctgagaactccgcttcactgcggaaggccagacagcactgttacatccagcacctgtgggtcatccactgcagaggtggcttccaaagcctctgaggtcagcagtgtggttgtagctctcctctacccaccacatgatctctccccatctccagcttttcttgccttattttctttatctttttatttcccccccttcctttctgattgttctatttgttttcaattttcttaatccatttttctcttcacattgcccaatggtgtaagccacctgcactgcataagactctgcctgcactgccaggcccactgatgggccaagggttttacctgctgaccttttctctggaaaatttccctttaacagcttctcccaagaaggcttaagtctagtcttggcatttgttatttaccatttcagggggaacagtcttaagcttttaaaggaacattatgctgggcagcgtggtggttcacacctataatcccagcactttgggaggctgaggtggacagatcacttgaggccaggagttggagaccagcctggccaacatggcgaaaccccgtctctactaaaaatacaaaaaaaaaattagccaggcgtggtggtgcacgactgtagtcccagctagggaggccaagacatgagaatcgcttgaacctgggaagtgaagattgcaatgaaccaaggtcatgccactgcactccagcctgggtgacagagtacgactctgtctcaaaaaaaaaaaaaaaaaaaaaaaaaaaaaaggaacattatg

SEQ ID NO: 26605 - DNA, 1049 bp, Homo sapiens
tttggtaacaaaatgtgaagctccttcacaggatcagaggtgagtagctgtggtggtctccactgcccaggctggatgagcagaatcgtctgattggcctttcatgactttaaacggagctcaggcacatgtagacatcccaggaccaccagaagcagtggctcccagccccgactgaccccgtgcccacttgtaataacagtattttctaatgccctcttcaaaatcttcagtgaaccttcacaaataaaataatctgacttcacacacaatttccctccaaatcaatgtagtcttaatttaaaagagaaatgaaagtaatttattataaaataacttcagtttgtaagtgatcaggtacaactcatcagaaaacaaaagtacatggtcaggtgtttgcgtgtatgcgtaggatcacggtgggtgtgacagctgccattgcaggctctcttgagttaaagacttcagtaacaccattgacattgtccttgggctcatgattttccaaaggggcaactaactcttggtaaatatctgaacaaaacaaagtatttcatttgtatgacatttgcattaccggaaaatacagggaatgaatacaacagtgcaataactattttgagtttatgtataaattggagttaaggtctaggctcagataactagaaatagttttttcaaccacatcaatatgtaacaggacctttgaaggtcctgtgggacaattctttactgagtgagacagtgtggtacattgcagatcatctgaatcccaggaaggccccccattcttatggcactcacaaatgcccaccatttactgtccacctgcagagtagttgggtctgcctctcccaggcagctgcactagccaggcctggcttatatgcagtcagagggcccctaggggagtcttaggtcactgagcccttcccacagtgttcagatgggtggtgtcaggcccagaggtgcagagctatttacccttgttcctgagaatccaagggaggggcctttagtgtccatatagttctgtcctccagcaggtg

SEQ ID NO: 26606 - DNA, 1066 bp, Homo sapiens
tttcagtctctctctaacttctctactgcctagtctcccactgatgttaacatttaaacgttaattttgtaaagtggaggtatttttcctagaaatgaaatctgagtaattaggaatctgtaaatattttaccaacacttgttaaaggtgttgcattcatgtcctcatatagacccaggatattccttctgaatactttctggaaaaatctctcaagacagtaggctgatggatgccaaaagactcttagcagggaccacattctttatttgttttgcttctgggttctcctgtgtagaagcttctggtccaagcagccctcttattccctttggagagagcatgtttatgactctggtttgagtcatctgggttgctgccgtgacgggctggaaatcaaacatgacatgaagatagaaacacttactagaaactcacgtgtctggccaccctatttcagggggctcagattagctctacttggttggacatagttgtaattctgtacatagtaaactaaactgtgtatatgactaggactgggactctgctagattctcttcagcactaaccaaaggtccagctgacctgtatcctgtcctctagaggctaacagtctagaccaccaatccagggaaagagttacgaattcaggcctcaccgatgtatggggaacagttgaccctctacatccgcagtccagccaagcgaggatagaaaatgtcgttatgcctatgatggttgcctgtactgaacatgtatggacattctatagtcattattccctaaacagtacagtataacaaccgttttcatagcatttacattaggtattataagtaatctagcgatgctttaaaatatactgaaggatatgcataggttttatgcaaatactgtaccatttcatataagggacttgaacacccaaggattttgatatctgcaggggtcctggaaccaaccccacatatgtatggagggatgactctgtcaacttggggcaagggtaggtgctctgcaaccatggagatacagtcttctgctctcccaagagggtgaagga

SEQ ID NO: 26607 - DNA, 1048 bp, Homo sapiens
acaagtttaaattatctcttgacataatttactttaaggaaagtcagtactttgaaattacagagaaataacctagtggaagagttgataagcggacgcaaacttttattgtgaatcttgttgttttagtgttcaagcacaatgaagaacatatggcttacacaaagtcatttattcctgtacttgcatttttcagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcat

SEQ ID NO: 26608 - DNA, 1091 bp, Homo sapiens
ctttgacttccaccctacctgcaatacctctccctcccacccagtgccacagagaatgtggagcagagtcctgccatttgggtaatatacaagtggggcaggcacaatagcactgcagtagcatttaaaaaaaactttgtaaactaggttgacatttggatcacagtctacaaaagagcattctaaatctaaacaaattgactacaggttacaattttaaagatttagtaggaaccagagtcaaataatactcaaatatcaaagataccattcagaattactcatcaaaagttactctggaaataaccaggaaaaaaataaaaaaggacaattggcagacaccaacagcaacgtcaagatgacacagatgttgtaattatcagacaagaaaagcagctatcataaaaatgcccccaacaagcaattatgaacactcttgaaacaaatgaaaaaaaaaaaaaaaggaaatatccgaaaagaaatagatattaggaagaaccaaatggaaattttagaactgaaaaatataataactaaaaggaactcaccggattatgggcttaatagcagaatagacatgacagagtgaagatgaacttgaagtgaagataagtagaaattatccaagttaaacaacaaagagaaaatatgtattttttaatttatttttttttagagacagggtctcgctgtgtcattcaggctggggtgcagtggtgtgatcatagctcactgcagccttgaccacctgggctcaggcaatcctcccaccacaagcccgctgagtagctggaactacaggcgcacaccaccacaaccaccaatttttaaaaatttttgtagaggcagggtctcactatgttgcctaggcttgtctcaaactcctggccttaagcaattctcccactttagcctttcaaagtgctgggattataggtgtgagccactatgcttggcttagaaaatagattttaaaaagtgaactgagcctcagagaccagtgggaccataacaaaggttttagcatttgtgttgttggaatcccaaaagaagataaagaatgagaggctgaaaaaatatttgaaaaaaaa

SEQ ID NO: 26609 - DNA, 1009 bp, Homo sapiens
atttagaaaagaaaagagaaagagacaaaattagctgggtgtggtggcacatgcctgtggttcccactgcgtaagaggctgaggtgagaggatcacttgagtccaggagtgtgaggctgcagtgagctatgattgtgccactgcactccaacctgggtgacagagtgagaccctgtcaaaaaaaaaaaaaaaagatgtgtatgttctagaccttagaataaaactaaaattgacatagttaaactaacagtggagataaatggagtcataagaaatatgcagttaattcagagtataaaacataaaaaaaggaataaaggacaaatggaatgcatagaaaacaggttgatagttacattaaatgaaaatgactcaaacacaccattaaaaggcagagattgtcaggttggacaaaaaagcaagatccagtgatatgctgtgtacaggaaacccacattaaatataaagggcacagagagaagtgaaagaaaaagcaaaattctcatcagaaattatgcaagacagtggagcgacatcttcaaagaactgaaggaaaagaaacattaacctagaattctatatctagcaaataatatgtatatgtagacaataattcaaagaaaattggagtgactgtacttttttaaacacaatttttgaacaaggaatattattgggaatgaagaatgtaaaattaatcaagaagatataacagtttaaaatttatatgtacctaataacaggtgcaaaatacataaagcagcaactgaggtgagggtgaaatagacagaatatacagaaaattagtaagagtatagaagacttgaagaacagtatcaaccaatttgacctaactgatatttatagagtactccactcaacaacagcaggatacacatacttttcaagtgaactggaagattcaccaagatacataatattctggaccataagacaaatataaccatgtgtcatataactgtttcagtcaacaactgaccacagttat

SEQ ID NO: 26610 - DNA, 1031 bp, Homo sapiens
ctaactaatgaatatgaaaatgcttttttttggaagcagtgttactgcaaggggatgggttttttctgtgttttatttttaaaaatcatacagacattgattataaatgtttttaatattacatcacttttgattttatacaaaaatattttaaacttttaagctcatttatttttctttagaaaaaggtacttaaacagtaatggatctttaatgttttatctggtgttaagattcctaaaagaatttctatagtcctatatgctaagtgtttggtcatagcttggagtgatccacagtatctggttctttttctgctattcttttcctcccttaatttcttaactttttgagatttgttttacataaagatccacatttactctttaaatagaaacacttcaaaagcagctttatcacatgttatgtcctgtttatccagcaattccctcacacacagaaaaataaccaactttttaatggggcatctactttgaagaagagatctggatcctagtctgtcactttagctaatgatttttgctttgagcatgtcttaataacctctctgggcctcaatagtaaaatgaaggactcagcttcatagatgaccacaaggtcccttctagctgccataattttctacccatatgttctttttgttaacctttaagaggtttttccgattaaagattctgtacttctgacaacttattccaagaggtagaataggctgaacacatacaggtttaagtatagacgtgaatacttaaatctgctactgactaggattataaatctttgagccaatcaaaccattccctttggccttagaacattgaaagtctgttctagctccctactatacatttctaaggattgtaaagcttagaattataacagaaataactaacatttattgagcatggtgtttcagaagctgtgcgaagtacttcaccaggttatctcctttaatctttaatgcagtcttttagggataggtattaacatggagatctttgggggtgata

SEQ ID NO: 26611 - DNA, 1022 bp, Homo sapiens
gtaggtttgctgatggcttcgtttacattcttaaattttacatcttatccagtgtaaacattttagttaataatatctacattacttcatcttatacttatttactaacagtgtttagtgaaaggtcatctttactgtaaaatttccctccaaaaacaggggcttttatgcaagctgcagattgtttagcaccttcttaagagattttacacccctgttcctttcacccactaaacaggaagggatctctgttctgggtatagtttgcttattaactttagaatggctttgggctgctgcctaagttcatagtgagaaaaaagctgtagtcctcatcccttgagaaagttctgtttttatttataatgtggaaactctacaaatgagcccatgtctccatgtttccaagaatttttaaaaagataactttttaaggtataatttacatacagtaaaatgtgcacagttccatgtacagtttgatgagttttgacaactgtatgcacctgtataaccaaccctacaatcaatatatagaaactccagaaaattctctcatgccctcttgtagaaaatcttacccccacccagaccccaggatttctattaggacaagaaaaattttaaattgttgacctaacaggtgacatcttatttttagtttcttatatttgaagtactcctttctttgtttttcctctttttatttattataagcatatcatctaattatctttaatatctaccttccttaactccaattttggaatgtaaactttctcaggtcatttttcttagggaaatatgagcagcaaaggaattagaggtgtatagtagtgattacaaggcagtgtaacttgttgaagttcagtcgtatcattagggagtcttcaccttttaatcagtaataaatgcttcagtaaatttgagtacacaacaagggaggattcctgggtgcagggagaagagcctctgctctgttgggatcttggacctgagccagattcactcagccagccctc

SEQ ID NO: 26612 - DNA, 1021 bp, Homo sapiens
gtcatctcacctgtctggacttcagtttcttcatatgagataaggcattttctacaaaacaataattatacaggattttaataaatactgcagaaagggttctatgctcaaataggtttgatgaaaatttaagtttttttaaaagtttgatcctggccgggcatggtggctcacgcctgtaatcccagcacattgggaggccaaggtggggcggatcacctgaggtcaggcattcaagacctgcctggccaacatggtgaaacctcgtctctactaaaaatacaaaaattagccgggcgtggtggcacttgcttgaaatcccagctactaggaaggctgaggcaggagaatcacctgaacccaggaggcggaggttgcaatgagcagaagtcgtgccactgcacaccagcctgggcaacaagagtgaaacttcgtctcaaaaaaaaaaaaaaaaaagaataaataaaaaataaataaaagtctgatcctttctataggccttctctgcgttattcatgacttaatatgattatgactctataagagtgctctcatacttatttgatcaccctgccattattaagaacatttttgaaaaataatgtttcatgaaacccacttcgggaaattttgaaccagataatttcctaaggtctttctttgttttaaaatagaaagatgagaattccaagtgtttttatttttttgttgcagtcctaaaggtgtaagttgtgcatctgagctttcgggaaaggcttggcaggatggtttcatggccatgaaggtttttaccatgaggagtgaatcctgaagattcttacttgtccctaggatctggtgtgaaaaatattttttttccaagtgatagctatgtcatttttctcattaactatttcagttgcttcctcagcctgaaatatcaattggaaaacactgaaatagataaaaatatttaatcatgaaattgcagcatcttgagaagccagactttcttcccttctaaaatggcttaagttagcag

SEQ ID NO: 26613 - DNA, 1078 bp, Homo sapiens
gcaagcgtaaaatgctccatcagcacttggcacatgtagacactcaatgtagtttggtggtaatgttattatatagcagccatctgacctcaaggcagcatcctcaaataacttcccattaccttagagtatttgggtacagaatggaaataagaaagtttgtgtccagctcaaattttagtttttggcagatcttacattggcattttgttgctacggagaaaacaacatttaaaaggataagctgtagaaaatgtataaaaattgtttttttatatattcatattgttaggaaccacaaatcttgtttggaagtagccagaacttaaaatccttaatacctgctgtatttaatattcttttcatggtctagttcccattttctgactattggttgattttccatttatggcattttttagtaatgcttgtatttgaataatactgacattatattctttgcagatttgctagaacattctaagtcagcatttgtgaaatgtttaaaaatgtgtacatgtgagtctttcaaaattgatcagcctagtgaaaacctttgttaatgcattctgaacgtgctttccaacaccaagggactttagctaaagacacttagctgtttaacattaggcaagtcatttgacttcaccaggccttggttgtcccccagtcaaagtggaactgatattcacagagatagtaagctgaggtagatacctagaacacccttgtagctccaggagtcatgattccctgtgtattctagcaactttctgtactgaattccctggtcttgttttgtgctggtggacagcgatagctactgagagtgaaattgctggcactgggaagtatctctctgcggcagtacataattaagaatcatttttaaaattactctttgctttaaaccgcatgcatcttaaatctagctggcttaaaatctactcactcaaaaatagatttattttatttacaggtgtcatccaacaggacagggttgatgacctgttcaacagcttgaaacgttgattccctgtcacaatggatgacatttgtaagtaaagacaatcatgtt

SEQ ID NO: 26614 - DNA, 1049 bp, Homo sapiens
tcctattaaaatacatgactgctgaggtctaaagtacattgaatattcttattgatcaacttgaagaaaaaatgttagtatagaaatgtcatctattatggagttggccaattgaatattgactatgttttaatgtggtgtgaggtttattttctcccattttttccacaggtataataaagtggtttaaaaagataaataaaaaaaattatttctatggtaggcatgcttttgactagttgtccctaattattgcaagctcattctttgtgttcaaaggtttaattttatatattccagacgattcagagagattagccacagcttatttaaacaaagaagacacacacaaaacaaagcgatagtttttttttgtttttgtttttttttcagaaagaattcagttgcttacttttcttaaaaacatctttcccatttcattgaggcagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtaagctactatgaaaccacactttatctttttctgtttggggttcttttaagaaagccattattgccagaagagattgatttatccacagtgctttggaaagtatattcatttttcttaatgtctagtttctgtgatgctgagctttgcatataactaattcttgttctattaaaatatgttaggtaaatttttatattcctggttgttttctgttttatcagtttcacaattttaaaactatgttggaaaaatggcccctaataaaaaatagttcaggggattggtcagaagcataactcctggtcaag

SEQ ID NO: 26615 - DNA, 1046 bp, Homo sapiens
tgctagcatcataaaatgagtttggaaatattccttcctgtcttagtctgtttgtgctgctgtaacaaaatacagcagactgggtaatatatagacaattgatgtttatttctcatactactggcatctggtaaatccaagaccacggtgttagcacatttagtgtctggtgagggcccagactgtgcttccaagatggcagtctgaacactgtgttctcacattgtgaaaggaacagaagggaaaaagggccaaaccctgggtgaagcctcttttataaaggctttaattccatttacaaagtgattgtttcataaaggccccacctcttaataccactgcattggagattaagtttcaacattaattttgcaggggacacaaacattcaaataataacacttcctcttcaaatttttagaagagtttgagaaggaatggcaattattcttttttaaatgtttggtagagtttttcactgaagccatctggtcctgtccttttctttattgggaagctgttgactgctgattcgatgtccttgctagttacaggtctgttcagattttctgtttctttataattcagtcttggtaggttatatgtttatgtgaattaattcatttttaggttatccagtttgttgacatataattattcatagtaatttcttttactttttatttttgtggcatcagttgtaatatttcttgtttcacttctgattttagtctttgctatatttttcttaatggcttgtcaattttgttgatctttttaaaaaactaactcatagttggttttttttcctctgttgtttttctagtgtctattttgtttatttcagctctaatcactgctattaccttccttttgctaactttgagttttattggtcctttttttcccctagttccttgaggtgcaaaattatttgattgagatctttcttttttcatgtaggtatttaccactataaactgcctcttagttctgctcttgctgcatcccaaaagtacgttgtgtttttcttttcttttttttct

SEQ ID NO: 26616 - DNA, 1203 bp, Homo sapiens
ttaattcaggaataatcatcttttcagtctttaaaatcagtacatttcagaaactggaacatccattttgaataagaaagagcataaggttgcaaatggttatccagcattttatacccaaattttgccagaacacacagagaatacaccaattttagaatttgccagaatctatcaatagaaggtgggaggggaaatccctttcttcctttgcttccctcctctctgtgctctttcacatttaattataagctatttcactaaatttatatatatgatttgagtgttgatatatttacagtataggtaaaaaggtaatttatatcattagataatagatgtatattatatacatatggtggtgatattcattaaccaacaaatacaaattttgaggatttgttgataaacagaattaagtacagtggtgttggaaacaggaaaactagaagcaccaacacccataaccattgaaggttaaatgttaaatgtagtcattaactgaatttactcatttactttgcagattaagaggatgaatatgatatatacaaaatgtgggcttctgtgtagtgctgtctgtgtgtctttctaaaaattgtgtaaaagcatgatgtgacaaactgagttggactgacatcatgattttcagcacaaatacatgtattggttactaaaatactttcattgaaagatatatattaagttcatatagttatctacccaattaaactgtcctctctatcccagccaaatgtcaccatatgctttttagaaaaccgtgatttaattgtgtttagattttaagaaattagcaaagctcaggaagcagtgacaggctggtaacatgccttgaaaacagtatgagataaaataggaacttgattaagaagagggaggagaatacagataaagatgtgaagcaaagaggtttgtgttttctcttttataagtgtaatctttagcatatctaatacatagagaagttaatgcgttatgtagcagtattcagttctacctcaggaatacaaaccaggctctttatactatactggggcttataatgaacatatgtagatcttatatataaaggagttttttttttaattttagatttggcctttgtgacttctcattttccaactcctataatttaaaaaaattgaagcccaaaattattaagaactttataaatgtcatata

SEQ ID NO: 26617 - DNA, 1050 bp, Homo sapiens
agtttgctatttgaattaattcttcgtaaggttaagtttcacctcccctttttaaaaattctgattttcacttacatttacttatttaaatgtaggtctatcagtaactttgtttttattaccacgtgtactatatataaaatgcagaaaagtaggaaaaggaaaatattacctataatctcatggccctcaaagacaaacattattttttggcatttattaaatgtatttttgttgttctccctgttgctttgtttttagaaaattgcaatatccttctaggtgctggagatacaaggaaaaacaaaacagtcaagatccctggccttatggagcttaacagtttattaggtagagagaggattagactttaatgaattgtcccacaaatgccaagctaaaaactgaggcaaatgctgtggaaggaaagcaagggagatacgagtgcataaaggaggatctgatctaaacccagagtctcactctaaatctaaattgcaatcagggaaggcttttctgagaaaggaaagtctgatttgagaactgaagcgttgtgagagtgatctaaggaaagagagtgagtgagagggcaaagagaaagaacctagaagcccgaccagcatgtccatgcaagggctgcagtgcacatctctgaactgaaagaagagggtggccgggagcacagtgagttggagagggaagaagtgaggctgcacatctgcttcttgtaggcccggttaagaattttgctctttattctaagagctgggctgtgacataacccaagcttgaatttccttttggtttctgaagaataaacagctgaagtagatcaatagtggatgcacacaagaaagttacttgttaccttttctcttagtaacctcttcatgtccattgccctatatattttgtgtatagtatttatgcaaccatttattatatttaccatgcaagctttctctatttttgttggtctttgacataatttaatttttcctggttacacttcagtgaatctttttctaagtgaaaattttattttataaa

SEQ ID NO: 26618 - DNA, 1063 bp, Homo sapiens
tttgtttgtttatgtggtaaaacattttataggcaccttttattttcagttagaaatcatttttcttctcttcacttctcatttttcctacccattttatggtatcaatgaaaaaatgttaactactaaatacagaaaattggagaaagcaaagcatgtaattcaatacaagtactcattttaaaacatatcttagtcacattgagttcaaccagttttaatctgtaaacagtttcctattattattaatttataaaacttagaaagaagcatataaatgtttgtgtaagcataaagatgtttttcctatagcatgtaacacttgaagttcctcatttgatgtatttgcaagtaaactaatttggggttattaataatcatttttatattacaaattccttaattatccaagtactgttatattgtctctgagtttgaaaagatgattccaaatcaccactgaagtaatcataccttagatctcagcaaaacatctaaatgctattgtagaggaagaaaaacttctctaccctattagattcagtagctgggatttttggactatactgacaaaaggcagattaacaggagaaagggtttatttcacatgcacatggagagggggatctcacagaaaagaagtgaaaacaccaaggaggcagttagacttgggggttatataccattttaacaaagggtgatagagataagagactacacaaagaaaaagggatttgggcttggcagggtggtaagttgtgggaaggaaatatgtgataaataagaatttttagtaagatttgttatgcagactcaggtcatctcaggagataagaattgtctctgcagttggtttcctcttcctagtatggtagaagagtacatctttacatatggaaattttctttacaaatgtaaatttcttttacaaaagggaatttatgctatgtttttagacagaaaggaggagtacagaaagtgtctatgtttgatgtttctaaattgccttcagtttaaaataattcttatgccaatgtagcatgttttagggtagtatattgtg

SEQ ID NO: 26619 - DNA, 1057 bp, Homo sapiens
tttatagggtattaaaaaacaactttgtaaatattctttattgaattagtaaaatttgatcgtagatagtgagctaacttatttggcatgctgaaggttaatggttttctttgggaaaatgtaaaacaatggaaaacaagctgcatttctagtactggtaactagaatgctgtagcactgggtaggaaggcaggtatctgaaagtttatcttactacaaatggagtaatagaagtaaaacaatctgtgtaagtttcataacatatctgattctcattttcctgatttttttccctgtaagtcacttccaactctatgtaggtcttttataagtattcctccactttgctggtactcagtttttttcttgaagattttgtaagtttaaactttattgatttgttgaagcttagctattaccatattgatattttctatggcttaaagtgcagtgagaaaaataatttagaaaacatagtgaaaatatgtgtttcaatggaaaactgccttgtctacatgcagcacattttctcaggttatctgattctagcctttccttggctttggcctattttaaactctgtaacttgtagataactggtagtaatgcatttatagacatgtatattttgccttgtccagcgaaggttcagtcatatacctctcccatgcataccattgtggaaaaactcattttgcccttatttgcacatacatttcaaaatttctaatctataaatgtgtctgttcttcagattatcttttgaagtggttatatcatctgcctgatcccctcattgattaatgcttacaattaaacttttaacgtgtttatttttatatctgtatgagtcatgattttcatttgtgaattatctttaaacaacggttagatcccttactttgattttttcacttaaatgtaactgtatcttaatatgatgaataatttataagaaacttgtaaagtttgttattcaattctaattttgacttaaaatatgatagcagtgtatatatagaattactatgattattttcctaagccacgaggcagt

SEQ ID NO: 26620 - DNA, 1046 bp, Homo sapiens
ttgcatgtgcaagtggcctcacttttctggcattttgaggtgtgctgtcctcttctctgcaataatcaccaagtaatacactgcttctgttatgtcatgcactttgcttttttgtttccttctctgtgtctcacctgacatatccatacctgactctcctcctggtcagggctctcctagaaagtggctatcttgggagaaataaattggacacaggtcagacaagagccacaagtatatctgctggtataaaaaagtttcctgtgacacctcgtcatgggtcagacacttaggcattaggccatcgactggataaaaaagtatcctgttaaagataaactatacgcatccatgaccacttcccctggaaccctgttagggcagggcttgaatttatagccactctccagagagagactccaacactaagaggaaaacacaccatcagagttcacaaacaagtagtaagatatgcactggagtaaaaatctgtaatatcctaatgtagatgcacatttgtaaaactgaagatcacgatgacaattccaaaaggaacttctttaccagttaattattaaataaacagattggtagtttccacaccttaaccactactggttacttgaatctaaggtaggaaaatagtgaatacaaagaagtttgaattatgaaacttatgtattatccttttccaatgcagtctgattttttgaaaactgaaaaccaaaaaactaatcttaagaagctgagtttttcgcaaagggttttctcaaatatttttcctttttttttttgaaatagagtctcactctgtcacccaggctggagtgcagtggcatgatctcagctcactgcaacctccaactcccgagttcaagtgattcttatgcctcagcctcccgagtagctgagactacaggcacttgccaccatgcatggctaatttttgtatttttagtagaggcagggtttcaccatgttggctaggctggtcttgaacttctgacttcaggtgatccgcccaccttggcctcccaaagggctgg

SEQ ID NO: 26621 - DNA, 1074 bp, Homo sapiens
tgtagagagtagctcaaaattagctccttttattgtcatgttagactctgggttcattattgccagatctgagttttcaaaagaggctggaattctcttttgcttttgttgtccttaagtttcttaattttttaatgttaaaaacctactcaaatgtaaaagacagcaaacaaaacacatgtggaccaattttgacttcaagataccaatttgtgatctttggacttgatgaacaatttattgtctgtagggattgagaatttcattaataagtatatactcattgacacttctaaggtgactgaaaatattaagtactttaatcatatattccctcatcttgaatttagctattaatttttggtgaatcatttaatgattgtgcttatttaaattcagctgagttccaattcaaattatcagaaattccaaactgagagagaaggacctgaattagacctcattactttgtataactttttaatgatctttttgataggtgttttttgaatccaaatttgttatatttgttataaaatatccaagacttgactaggcacagtggctcacacctgtaatcccagcattttaagaagccaaggtgggagtatcacttgagctcaggagtttgagaccagcctgggcaagatggtgaaacccggtctctataaaaaatacaaaaattagcttgacgtggtggtgtgtgcctgtagtcccagctacttgggttctgcggcataaggcttgcttgaactcgggaggttgaggctgcagtgagtcatgtgtgtgccactgcactccagcctgggtgaccaagtgagacactgtctcaaaaaaaaaaaaaaattaaaaaaaaaaagagtcttaaagatagattaactgttagtaaccactggtagccaatcaggaggcatttgtctaaaagttcctcgttatgaaacagagctttatcctttgagacgattagaaggatttgaaagaaattgaaaagtaaataaccttatgtgacttaatgttaagaaaatactatataccctttgaaactctgatgaaagcaaatttgaaacccacatc

SEQ ID NO: 26622 - DNA, 1035 bp, Homo sapiens
taacattactagcatagtccccctcaaaacctctcttagtcactgccctcttctgcctccccagagtttatcactatcctgacatctaacactataagttagttttgcccttgtgtttttttaatgtcttcttttttctctttggtagtggttataaaatgtttttgtaatactagagtcttcattagaatccagtttagccaagtaaaatgcttctgaatctcattggtgggggaaagggaggaggctgtacatgtgagggaaaactgtattttaaaatatgttttaaattttaaattaaaaaaagaacacaatatttcttgatatataactgtttattttaaactgctgaaatatatcaatagcagctaaaggtatgtgtgtgctcttgcttacagaaaaagtgacccacagcatcctaaccttacacttgttttgatactcgccagcaaaggaggaagagagtgaatgggtggggttaaggattactgggggacatttctgggtcacaaagtgatatagccagaactctggaatttctctaaattaaatgttttatgttaaaaattagtgtgaatttgctggccatcagagaaatgcaaatcaaaaccactatgagataccatctcacaccagttagaatggcgatcattaaaaagtcaggaaacaacaggcgctggagaggatgtggagaaataggaacacttttacactgttggtgggactgtaaactagttcaaccactgtggaagtcagtgtggcaattcctcagggatctagaactagaaataccatttgacccagccatcctgttactgggtatatacccaaaggattataaatcatgctgctataaagacacatgcacatgtatgtttattgtggcactattcacaatagcaaagacctggaaccaacccaaatgcccaacaatgatagactggattaagaaaatgtggcacatatacaccatggaatactatgcagtcataaaaaatgatgagttcatgtcctttgtagggacatgggtgaagc

SEQ ID NO: 26623 - DNA, 1030 bp, Homo sapiens
atatttcacatgatttagaataatctaatctcaaatccacaattgcagtttattatagttatggatgtttggaccctggaaaattaaccttttaatttaaattaaagtaacagtttgattattgggaatattgtattgaacatttataatgatttgcttttggaattatactgatgaatagagtgaaaacattttccagagagtccacaagatggcacttgccaacttgtttcctctgtttttccttaacttatggaaatgcagcaaaatttaagaaggaacatctaaatatttatgcccttaaaatgctaaagtttagatttctagaagctttagtcaagactccttgaaattgatgagcttcaatttaacattttaaacagtgttcatttccggtataggagccaaaatcctttgttgaagatccgtaaaacacactgggatctgtagaatacaaagggctgcctgcattcactatgtttgcctttacttttaaagtaataatatgatttatgaggcttgtagtctatatgtctcatttctagacatcttaaaatatggacatttattagaacaatgggtattagtaattgctctaaagtaactgttattttttatttaaaaacaagatgatgtagttggaatatattatgtaatttttaattatgaatgaaatttaataagtggaatggtaatgaaggacgacaggaatctacccaatcacagtgttaattaaattaggcttcttttttactcttgtatatttgacaattaatactgctttagatgtttactgtttacattaacattgtcattagggaagggaatgatgttgaaattatgttgaggttggtagggaagttttatattgtttattgctttctgaaatcttgtcaataatttcaatggaaagagctacatgttcatagaagactaaaacattaaagtgtatcaactaaaatctagagcaaattaggtttaggtctatagcattctgatttttctcagcctcatcataaaaatcatcaag

SEQ ID NO: 26624 - DNA, 1033 bp, Homo sapiens
tcacttactctggaattggttccttttgctagcttatcttttcccaaaagtttcctgtgaaattacagttacatttatactgttatattttataaaaacctctttatccttcttttaactttcaaaccagaggagaagggacactaaacagtatctataaacacagggcttgttataatccaggttgattttctggcccctttaatgttgtcatgtgtccagtagtcaactggaaacagaaaccttctggggggaccatgctaaaggtaggaaaaatgatgggttcttctgctctgagagctgttctctcttcttttagacttttctaggctgttagcaaggaattggtgaagggaagcctttctttgttcaggtctccctttcagaccctggtgggttagccaagttcataggacgtttacatattagtcctccacttaaaaactagcttgtgttttgaaggttgctgaatagatgtcactaagtagtagaccaaaaagctcaccctaatgattgttttacagaatggaatatattaaaccatgacccttttaaaagatgcagtcagtggtttatatgacatttcacttattgcttattataatatttaattctgaaaaaaatgttttgatgaaattgactttactactcctgtaagttgttcctataagatgattttgcctcttaagtctttggatggtatttattactattctgagatttgtatctcaaatttggatgttataaagatgtcattatatatgtgtacagcatatgtaattaaagatgagagccatgaaaatgcaattcatgtttcttttatcataatgtttaaaagttgactagatattttaaagttattgtatattcctgggaagagaaatgcttctctgggcgtgtcggttcattttttttagttgaagttaaaaggatagattatttcaaaagaacaagaaaaggaacaagatggattaataatacagtggtaaaaagaaagggggcaacagacatcgctatacagtagggacacttg

SEQ ID NO: 26625 - DNA, 1047 bp, Homo sapiens
ctgaccctgtttggtaagtgcagccgtctccccgcgccgccgcaggtgggccgcgtcccggggctcgggggcgggggcctggggggcctgggcgcccggggagggggcgcggcgcgtggggtcggggcgggccggggccgcagagttggggcgcccggggcgccggcttgctccctcgcgcctctcccattgtttcctctcccggcagggccgatgggcgtgtgctcccctggccaattctcggctgggaggctcagaggtcctgggtgttttgcaaacgcacaaagattctctaagatgccaacttgggagtgaagttaactggttgttttcaaacctgcctttcccgtcggtaaataaatccttggaaagtttatttattttgaacgaggtatctgtgagtccccagcctccttggaattgccaaatgcatgtgttgcttcctgttggactattggggaattttttttttggactcagtatattccgttggaaataagtatgatttgtgaactgaatatgggttaaaattgaaaatgtttgcactaacgaatgagagcagacagaataaagttggttaccagaagataactgtaatctcaggagactgagtattcattaagaatgaaatgttatttttgtggtgtaattactgcagcactgttgcttttggtggttaagacttcaagctgtttttttctcagtctgcaatgacaatgggttgggaaaaaggactgaaaagatacattctttccttttacaaaacgactatggtacatacgtacctgactttaagaaaactcaatatgtgaacattagacgttcaaagtattcagcttttttgaagaagcaaagtacaatgatatgtaattgatagctacgagaacagcctaagtaagttattcacaatatcaagtttccagttcagttttaattatgtcatttgatcaaacacgttagaggtgttacatacctcaaatgctttttgaggtaaatacttcccagtgaattaagctgctagaatcaaagtgttacttttatttaact

SEQ ID NO: 26626 - DNA, 1060 bp, Homo sapiens
tgcccagagaaagagagagaaagccagagatgtctgtcttgcagactggcaagagggagccaggacacagctcggcttgcttacacccagagggaaagagttaagctggtgaccctgaaggcagagcgagcaggagagtgcagctgtgtgtgggagcgacaagaactgcagagttagagcaagcaacagagacagacagtgtaagagagctgctgaataaagctgtatttcacctacctgtggctccccccacttcctgctgctgagtgttctctcagctatctcccattcatccacccactccctttggacctcagcatgggctggaacctggacttgaacctaacaccctttctctacaaaaaattaaaatataaaattataaccaaaacaggttaaaaaaaagttaggtataaaaaggggattaattcagcacagacttaaaagacaactctataggaataatttaatatttgataaaaagataatttcttagaaaatgtcatttatccaagatgactctgtaaaagttagaaaaccaaatagatctgtaaacaatcaagaaatgtaattggtgattaaatatcaaaaaacaaaatgagagagacaagcatctacttctagaggctttatagggaagttattacaaaatcacttaaaaataatatataactttacagaggatgggcagaaaaaaatctcaccaactcattttatgagcttaacacctaaatcagactgaaacattaacacccaaaccagactatgacagtttggttatttttattgttcagtggtattccactgtatggttatatcacaatatgtatatccattcacccttgatgagtatttagatggtaactaggtttttgatggcaatgaataaagctgctatgagcatttgagtaaaagttattgcatgaccatgtttttctgtcttttgggtaaatacctaggattgggaatcttagatcctatggcaagtgtatattcataagaaactgccaaactgttttccaaagtgtgtgtaccattttacatgcccaccagcagtgtg

SEQ ID NO: 26627 - DNA, 1050 bp, Homo sapiens
aggctagagtgcaatggcgcaatctcagctcactgcaacctccacctcccgggttcaagcaattctcctgcctcagcctcctgagtagctgggattacaggcatgcgccaccacacctggctaattttgtatttttagtagagatgggtttctccacgttggtcaggctggtctcgaactcccgacctcaagtgatctgcccgcctcagcttcccaaagtgctgggattacaggcatgagcaactgcacccagccaattactgtatttttaaagtaatatctattttgttaattttgttatcttttacttgaaatggtttttacctgtttatagctttgtcttgcagttatgctcattatgggggttaattttcagtttataaatgtagcatgtttccttatgaacaaaaagcagattccttttctttactaacagtagctgcttaacagttactctgtgggtacaacttgataattatttttgtgtggatttggctgttatattaggttggtgcaaacagaatcgcagcttttgccattaaaggtaacggcaaaacatacttttaatggcaaaaactgtgattccgtttgcaccaacctaataacttagatactgcaaaatgtgtgtggagtggaagcacaataaattaatgaaagcacacttttatagctagagaattatttactcataagttaatgatgtggaaaaggttttattggtccgttgacttatagaaaatgagattaaatcttttatttctggtaccagacaatattttatttcagtatttatcacttgaaataggaaaaaatagcaataattggaagatacattataatacctttttgatttaatttctgaattctatgatctatcttccacgtttttccactgagtttttaactatattctagatgaaagaaaggggtattagtgtagctgccatcatctcatgcattttattctgagtttgagatctaatacttacatttgaagcttttactaagaatcttcctaagcctttgtttttccgtcaaactgatagaata

SEQ ID NO: 26628 - DNA, 1045 bp, Homo sapiens
gaatatacggtgattcacaagagagagaaaatgtccactaacatttgttcacgcataattactgcctcagttgaaattccggtgatcttttcatatatgcttcagtttttatgggatctggatcacatatgatagacagtaagaagataggcctagatgaaaaggaagaaattacaagttttgaaatagttataaaaatttctgaattgttcttagttgaagtgaatggaaatacttgtactggtattatttgggggtcttttttaaaagctcttctctcactcacccctttctgctgtactcagggaaggaagaaaggaaaagattgccaagaatatgtgttcttaacacttaacaccccagacagttatgtatttctaagaagtttgggaagcactgggtaggctgcaacatggttctcacatctctatctctcttttgtctctcagttgcactcgctctcactctcttattagcctccatcccctcaaagatgcacctctataagaatcttaggaaagtgtaatatacataactctgactccaattcctgtaataatatgtatttggggcccaagaactacatctcagttattaagaacagtatcagcaataatagtctcaggtctgttggatccctgaagtccctttcattgctgagatactgtggtctgattatctgtgcaaattatttcatatttacagatcataacaaaaccaccttaaagatcacatatgaccattttcactaaagaaaccaatttctatcagttaacagatatgtttgttttgtacctatgtagcaaatcattatatcagttgctaaaaggaatacccaaaagtataagataatctctgctcttagagagcttactaactggttgggagataaaatagttgcatatgacaaatttttattgatagcataataagcttcattcaaattgttgcttgataaagtggtagacataaatatctagggcctcattctaatactaggtctgtcatgctctgaatgtgagtccagtacaatccaataattaac

SEQ ID NO: 26629 - DNA, 1104 bp, Homo sapiens
tttttcttctgttgtatacccactggcatacttttcaagtcagacccattgtaatcaatgtaacagcatggagcaaacattagagcttcctcactggatgagtactgtataccctagggcagtcaaggaaggataatgaatgaatactgatgctgcttttaagtgctttataaggtagtaacttgccctactaaagattattcaagagagtgatgtttatgtacttcaggctcccctatgtgcagttactgtatttcattaattctgagagttaagctcttcactgtaaaactttaaatgctcttcaattctatgataatttctacctaaggacttaaaaatcttttccaaacacataatttactaagcctcacatttctacttctagttatatttgtgcacattttaaaactagaaatgaaagccccaatttatcactatagactgggtactagtcattgtattttgatgtctaacattctatttataaaatatataaatatgcagactggcgacctcccaagactctctccctttgttctgacccacacttttccaactcaggtctttctactttaaatacttcttgatcgtttttctaagtattcctatctggttctagccagctactactttagtcccgcatttaatttcagttttaatccatccacttccacattatcccatcaattagggtcctaatttcctatgttttagctactaatatagttgtttctgattgtttagaaaaggaactaggaatcttatcttgattctaaaaaattcagtttttcttatggtcttgagcatgtctctgttaggaatgcttacttgttccccggtgctgtaaagaaatagcacttgaacataaatttaatttcctcagcaaggccaatttttttactttctgcagaaagggtacactcgccagcagttttcccatgagagtacactgaacaaaggagacagggtcatttataacctgacgcatccaccctactgctgtgtccagtttccattggctggaatgggacctcacattctgtatttgtcctgattggctagcaacttagaagttttaaaagaggcaaaggcagaggagaa

SEQ ID NO: 26630 - DNA, 1025 bp, Homo sapiens
aaaacaaatatagaatgtgaatttaagatagtcttattttcatgctatttcacacaaaatataaaattactgcatcaccagattccatttctttcagttcttactggtagctcccaagagctctctgatgacagtttttctcattttacaaattggagattgtcctaagtaaatccataacttttctcttcttttcaatactgctacacaggttatgcatttaagatgcaattaaaaataattaaattttgctatttgctttgctgtggttagaaaatgtatttttaaatgatatgattataggagtaaaaatactattgtatttttaagagacagttggtatgaatctcttttttaaaatttctcttcttttgtttttcttagccctgtaccaggcccatttcctcttctgttacatcttcctaatggacaaaccatgcctgttgctattcctgcatcaattacaagttctaatgtgcatgttccagctgcagtcccagtaagaaagttagactatttaaatctctatcgcaaaactgatctttgtagtcagaaaataaagttggctgcttgactggcttatgaaattgaatttaacataatattgattagcagttgatagtatttatttgttatcattgtaatagcatataccattcaaggtatagctattttttctcttctccccaaaaccttaattttttttttatactgagatcttcttattcaacccatatcaatttgactggacttgtagcattcaaatattaacacagatttcaaattttagaaagatatttgtactagaatacttgtcaggtaactctgtggtatttctattagtatggaaattgtttataaagacacactctgaatttttgtggtcaagtagggtttgtagaatctttgatagcccagcatgttaaaatgtaaatgttctagaaaaataatctttcactttccctgtgaaaagaccccgcaaaaaagttttttgaggggtgtgttaaatatataaattttgaaag

SEQ ID NO: 26631 - DNA, 1031 bp, Homo sapiens
agtttagctgatactcctattttgtttttaaataatcaaattaaaagcatctaagtacacttagctatgacagacataaacatgttttaaggttttgatttcctctaaaatgagttctatcagtcccatgggatgttctgtgaaaaagtattcaaatagcaaatagctttggcaaaaatgccatactctgggtgctcccctagtcattttacattagcatattaaagactgtgaagagtcctgccaaaaaaaaaaaaaaaaaacaaagaaagaaagaaaagtatattttagcatttcccggatttgtttggccacacctttttttctttagtgtctactgacatccccgttgaaatgttttggggagcattgctattgaagggttaacaagctactatttgaaaaagaaacagtgttacagaattattagttgagtcaaatatatttgctatatagaatttctagaaagaaaacaagttgatggatgggataattaattgagaacttttaaatcgaaatttaaaagtaggaaagtaatcctgactcagagatgtctttttgcatttgttttgttcaaatcaggatccaaaaaggtccttaatttggttgtatgtttattaaatttcttctaatggaaaacagcaaccctcttcctttgctcttcttttcatctccatgacatttacttgttgaggagaccaggtcatttgttctaacttacagtgattcatcttagtgttttttgactttacgatggtgggaaagtaatacagtcagtatactgctcaattcatggtggggttatgtcccaataaacccatcgtaaattgaaaatatctgtattggatttggatgattgcctcctggtggtgttgtttaacttctttttctgtctcctgaatttccttgtagttggagctagggaggcttgattagattcactttcgacttttgacattccctgtccccacccttaacaacctttggtgttaatttaagactaatctgtgaattcagatgctgtcagcctg

SEQ ID NO: 26632 - DNA, 1050 bp, Homo sapiens
aggctatacaagcatggcactggcatctgctcagcttctcaggaagcctcaaggagcatttactcatggcagaaggcaaagcaggagcaggcacataacatggtgagagcaggagcaggaagagagttgcagggggcacacaattttaaaaaatcagatctcctgagtattcattcactgttgagaggacagcactgagccatgagggatctgccccaacacctctcaccaggccctacctccaacattgaagattacaattcaccatgagatttggcagggacatatattcaacctatatcacactccagagtctggatgctaagtgtgcttattggggtttcagtgttcccaggccctctcagtggacacagctagggacctacatgaccacatatgcgtgcatatacacattaacatctatatttctgtatctttatgttgagagccataagttaccattagtatcttcaaatgtcatctaataccaaggttcattctatatttataattcccttcaactgtagtatgaattcactcttacctagcacatccttgatatgtttacttatttgatcaatatccacgtatttacataatgaattgcctggtgccattaggcactcacctttcctctccatcaagtagatgtcttcctgtttgggtcctgacaccctgtgctggactagtgccactcctatcctttacttcatgtggatgccgccttagcccacttgggcattgacagctcacatcaggctgccttcccttcttttcttatccttctgagactccaacattaaatgcagggctgaccacccctttcccagcccaaccctcaactcatctatctcccagtggacatctttctcactctgcttagactcagacactgcagtgggctgccctcaggtagcctgtctgagctacctcccgtgcagacactctatatttgttttctctggtggcttaacttttatgtgaattttaagttggaagatgtgttttgccggttaatttcttccattttcttctattcatcttttctta

SEQ ID NO: 26633 - DNA, 1035 bp, Homo sapiens
tctggacaatgcatttttgtatggtatttccacaatggaagaggtaatcattaaatgaaaattgttattctttctgtcatcacactatacaataaagtatatctgaattcctaaacacaaagcagaacaccaattcttaaagctatgctttgcctttaatagaaatatttgtaagacagggaaagccagaagcttgagggttaatggtgtcttgattaatggaggttttaaggcactcttattttaaattatccatttgttttgttccatggaagcttctacaacctagggcaactcattctaataagatttgggatggggataggtatggatttcttgtgaaaagtgggagaatgagggctctgggaaagtaggcagatcatctttgggaaagcaaacaaagggaagatgaagatacagaagctgattttcttaaaacttgtcttgctcaagtatcccttggaaagccttagtgtgtacctttagtaatacataccccactttgtctgtatcccatactgcctccttgaaagactgtccacctcctgcctacctcctgtcctcccacagggacagaagctaacttctctccaccacccaggattgcccttgcatctgttacacacttttgaggccatgcccaagagaggattaattcctttctcatactgatgcctactttttgggccctgtttcttgtcacagtatttggctcttaccaggaaatttgccattagcagtgtttgcacatttcagcagagattctacccacaggttagtgatatccaaatatagccatttgctgcataacaacattttgagtcagcagaccacatataagatgtggtagccatcatgatatagtataacacattactcacatttgtagtgatgttggtgtaaacaaacctactgtgctaccagttgtataaaagtatagcatttgtctttcattaagacaaggaaaaaatagcacaattacgtacagtatgtaatatttgataaacaatgatgttactggtttatgtatttaaa

SEQ ID NO: 26634 - DNA, 1068 bp, Homo sapiens
gtgtgtgtacgtgttttctatgttcgctcgtttaaccgaacctaggaggaaaaagagaggaggagctgggaactatttttgtgcccctaggtagtataaaattggctttctttaatggagagtcttaaaactggtgaggccaagagcaaaactactgtgaatatcatggagtaaaagagattactcctgatggaccttaggcatcagaaattttagtgaaagaaatgtttctcttaaaattcaacacctattttaaatagtgatgtaaagcatttctttacatgtaccttcaggttttctaatgctttcctggctattatttaactggtactaagggattgactaatccctaaattataatgtgaaagtttaaatttcttagaggttttaaattatggagacggtcacaatgcatgcatttaagatatacatttaaaatcagaacaaaaactgactttctttgagcacactttttgtcctatttgaagaaacatgaccactggcgttatcattgtgagtaacagccgttctgatctttaaatagccatatagctttggtctcttgaatcaaaattatgaaggtaaagctttatttataaaagcttgttaaaaagtcaaacctacaggtttaagtgtcttaaagtacaaacacagaagcagttttatcatgtattaatttttttttccttacttgaggaatccaccgtaaaaactttgtttcaaaaatgttaggaacatccttgtaaaatacgttttaaatatacagattcccctctgcagattaagaaagttcatggatctttaaggccatcagtagttgcgtaatagttaagaatcctcgtctttgtaaaataatttctaggaatcttccaaatttaccgtgatgtgtaaaagagtttctgagaatcttccaaatttaccatgatgtgtatgttgccttcctaagacgtttaatcttgctttgagagaatgctactgccattaagttttaagaactgatttaaaatgtaatatcgtggaaatttagaacttagttgttatgtattttaattgtcaggaaggagcttt

SEQ ID NO: 26635 - DNA, 1332 bp, Homo sapiens
ggttatgccaggtaatcatttctatccctaaataagttaagagcatgcttgcagtagttggaaacttagctactgaaataatagctactttgcattaagtgcttactctgtgtcttgcattatatttaaagggctttgtatgcattatctcacttaattctcataacaccatttggggtgttatgagaataacatctatgaaggactagagacacagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtg

SEQ ID NO: 26636 - DNA, 1034 bp, Homo sapiens
aacattgtgaattttttggagcacattggatgcagtggctctcaaacctatttgactatgaaaatgagttttgttgttgttgttgtatatatatatatatatatatatatatactttaagttctgggatactgttagtttatttttaagaaatacagccattgtcatccagggacattctgtttctttagatgactgatgatgtctagtacaatagattatgaatatgaaagatcccccaacaaatggctctccatcagaaaagaaacactcttgaaagtaaacatagatatttgtagtttacaaactgcatttgtgtggctgaagtgataacttattccagtgcattgatgggacacagtgaattaccctgttaagctgtgtattgtgacctagagaggccttgaacatgcatggccctgatctacctaagaagagcctgctgggccgggcacggtggctcacgcctgtaatcccagcactttgggaggccgaggtgggtggatcacgaggacaggagatcgagaccatcctggctaacatggtggaaccccgtctctactaaaaatacaaaaaattagctgggcatggtggcaggcgcctgtagtcccaactacgggaggctgaggcaggagaatggcgtaaacccgggaggcagagcttacagtgagccgagatagcgccactgcactccagcctgggcaacagagcgagactccgtctcaaaaacaaaacaagagtctgcagccctggggctggtcttctcccacttgagtccactcccccttttcagccttttgagttttgttaacactcttccctttcctcttctccagctgctccctctatctgtggagagatacagacatacagacatttaactgtgaaaaaggtaaaagcaggcacagtgcgaaaagactggcaaagagaaacagagatggaggtgaggagttaatagtaaagacagaggagagagacacgctgaccacaggcctctaacagccatctttcaacatgcatgccgtggttgtttat

SEQ ID NO: 26637 - DNA, 1713 bp, Homo sapiens
cctgccacacacacattttaaaagtaacaatagtagtgttttctgtgttttgcatatgcagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagctaggccttttattcttgaagttgctatttctcatacaaactcattttatgcattagacacacagtcactattgttatggagaacatagttgtatcagaagaggtatagctttgggtgtggatgtgcgtgtgtcaggggaaagatattctgattatatgatgattttcataaaatatagtatgctgagtttccgaaaatcctaaatgacttagaaatggtgctatatgtggtttgtttgacccctgcaaatctcatgttgaaatttgatccccattgctggaggtgttttgagcatggagcggatccctcatgaatgtcttggcgttgtccttgcagtaatgagttcttgctctatttttcctcccctggaagctgattgtttaaaagagcctggtatcctccctccctttcttctttgcttcctctctcttgctgtgtgatctctgcacacaccagctcccctttgctttctgccatgagtggtctgaggctctcaccagaagccaagcagaggctggcaccatgcttctagtacagcctgcagaactgtaagccaaataaacttcttctttgttttttttttttgtttgttttgtttttttttcagtaaattacccagcctcaggtattccttaacaacacaaatgggctaagacacagggtcatagggatagcaggcacctgagccaagccagaacttagatctcaactgttaatgcaggatgatttgtattgaaccatgaattttacactgcctctcaatgttggtgtcagcatttaaggttatttaaaaaatacaacctgaaggttacataaagtttcatttaaaaaataagaccttataagtctacttttatttccagtggacagcaactacttaatcgtcttaaaactttcttcttacaatattactttacaatattacctgttggatttattatctgtgtacaaatcagttagttgaagggccaaagaataaaggcattttgtgaattatgaatagctattttgaaatggtcatggagactagctactctagaaaattgggagaatatactgtattaagttactatctggtataacttcaattaattgtgaaaattgtagcagagatctagatatagtttatgaacttctaaagagacattaaagggaattcaagtacttgtgtaaagatgaaccaaggtagagatgattgtgaattggtgatctgctgtatgttacagttatgtaatttgacttgtttcaaaattattaaagttttaagtgtatgcattctactggtcaataagtaaatatattcaggctctgaatgtagacagataaatatataaatatagaaagtacatttgttagaatacaaacaagaataaaaattgagtacagaatgaaaaccttattaaattttatcactccatatattatttgtctcatcctaatttctttcctcctcagaaactaatctacattttctactttaatgctattttaa

SEQ ID NO: 26638 - DNA, 1025 bp, Homo sapiens
tttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttct

SEQ ID NO: 26639 - DNA, 1028 bp, Homo sapiens
aactcatcacaatgttgactcttaatagaatcatgtatttattattctatcttttaaaataaaaaagcccctaaaacctttagtacaaccgtattacagaaaaatgattcattctttaacactaacgatagctgatgagctcaaaaataaaaaattgcaaaaaaatgttataatgttttaaagtttacgaatttgttttgggctgcattcaaagctatcttgggccacatgtggctggtggctaagggttggacaagcttgaatgagagaattctcaagaattctagtttcttgttcctgaatcttgaggttaatatgttgagtttttggaaatagtttgtttcaggcccattctgagtaattgagatgtctctgaaaattatgttaatattttaggcactgttgtggactctttctcctacattatatttttttaaattgcacagtagtgctatgaagaaagtattaaaatatctatgcagaggagaaactgaggctgacaaagtgctaacaatcttctaagaatagaaatgtgcgttgaacccagatcttttctcactttgaagtttcaaattcatgttctttgcactgaacagtgtatttaaaacatattattacttaaatgttgtatggatgtgtgttaattaagctattatatgaaaatattttgttagaagtaaatgcaaaaaatgggaaatagatttgtatcttttagtacttaaaaactgattttatttaagataaataaaaacatagatacacttgaatacttgctgaataatctaccaggaatgcaatcattcgataaagtagcattttggtttggagttttgtgtgttgttttaaagatcacagtttaatctttttaaacctagtagtagttttagtctagagttatctgtccaaatcagtatgactgtttacatttacattatttaaaatgaaataaaactacagctgggcgcagtggctcacacctgtaatcccagcactttgggaggctgaggtatgtggatcacttgaggcca

SEQ ID NO: 26640 - DNA, 1031 bp, Homo sapiens
ttttgagatggaattttgctcttgttgcccaggcaggagtgcagtggtgcaatctcgggtcactgcgacctctgcctcccaggttcaagtgattctcctgcctcagcctcccaagtagctggtattacaggcatgcaccaccacacctggctaattttgtatttttagtagaggcggggcttcactatgttggccatgctggtcactacttgatattttattaaaagtggtttccttggggatgcatccctttaatctgaatagatttgtaatgtaatttgaaatttgtaaaattgtaatttgtaatgacagatatgaattatcaattgattaaaaagtaaattaggaaagagcatcttaacaatattttaagagcttaatgtaagtattattattataaagttaggaagtaatctttagttatctaaaaaattcccaagtctagatctgtgtgcattttaccattcacgtattttgtggccctttaacaaaacttgagtttttaataatcactgagtaatctgtgcaagcagataatccctctgcatccatgagcattccttcaaaacagttcaaaaatcaagctctatcaaaatacatgagtcaagattacctctttaaatggcttcatgaaaattttgtgctttttcagaatattagtcctatgtggtaatttccagcattccttgggaaatctgtgtttttctgaatcttgagaaaaatcacttgagaaattgggaacatgaggaaaagtgttatagttccctgagaattaaagcttaacaatcaactacagatgttactagttcaaaggaattcactaatgtcagctgaaggcaagagcaagaaattctgacatgctgagttacaggttaatgttgacgtttctgggaacagtacagaatcatagagaagtggtacaatctaatcagttttgtgggcatttatggcactctcttattaatggtgagtcattcttgcaaataaaaatgtttatatacctactataatttatataaatgtataaagta

SEQ ID NO: 26641 - DNA, 1084 bp, Homo sapiens
cgtatttcttctagttttgctttacaaatgttgatgctttgctctttacatgggtatttctgttatatcttcgttagaaacacatcctttaagaagaatttttaattttgaaaaaattatagattaacagtaagttgcagaaaaaaatgtacaggcaggttgcaggtaccctcacctagctcaccccaatggtaacatctatatggtagtttttccttcatccatagttttgccctctgcagtttcagttaactgtggtcaattgcagtctgaaaatattagtttttcgagagagactacattcatataacttttattgcagtatagttatacttgttctattttattattagttatttttgttaatctcttactatgcctaatttataaattaaatccctatacctacatggtatgtatttataggaaaaaacttagtatatgttggatttggtactgtccatggtttcaggcatccactgggggtcatggaacatatatcactgagattaagggagaactactgtagtaaatttctagttagcctggaaaacgggaagatatgcctttataccaacacgacctataaataactgacccaaagtgaatgtaccacaaagtaaaaggttttaattaattataaaaaccaaaagcaaaaaaagttgtttcaaaacagaccaacgtctttcatatcaacaaatattaagccaggaaattgacattgcttcaatccacggagcctattcagagttcatcagttttatatgaattcctttgagtgggttttatatttctgtgcaattttatcgcctgtagctttgtgtaaccaccgcacaattcagatccagaactgttccatcaccacaaggctcctttttgctactcctttatagccatacacatcttcctccactttccgcattcctaacccctgccatccattaatctgttttctgtctccacaaatttgttatttcaagaatgttataagatggactcacatagtatgtaacattttgaaattggcgtttttcactcagtatattcttgagatccatccaagttgttcagtgtgtcaataatt

SEQ ID NO: 26642 - DNA, 1066 bp, Homo sapiens
tgggcatggtggtgggcgcctgcaatcccagctacgcgggaggctgaggcaggatcgcttccatccaggaggtgaaggttgcagtgagccgagattgtgccactgcactccagcctgggcgacagagctagactctgtctcaagaaaaagaaaaaaaaattatataaatgctcttttcaaaagtaagaggagataaggtagtctaggataaactacttatttttttttactccttattaccataataatagagtctaactatacttggtacacaatttaggttttggggtattgctggaacagccttgttttggatcagcattatattgaccctgttatgaccttataataatctgcccaaggatcaaatttatctcttcttgttttgtctttcataataggttgaaccatatgaaattgccagtattcaactgcttggacttagcaaaatgtcagtttcatatggttaaccctaatgttaacaactcttatggaaactacaatgaactgatattcattaccctcttggattgttgagtatgtaattggtaaatattttttcaagtgttttatgagtgattttggctggttttcattctagatgtataaaaaatatcattggcaaacaagctttgctataatgaagtattcttagatgtccttttaaaatctgatctgcaaaaagtactttaggaatttagaaagaagataacctgttgattttgacctccagagtcttaagtgaacttttagcaatagcaaatcagaccatttttagtctgtaatttttttcaatgtgttaattcttttgagtaatcattcctaagaattttttttggaggaaaacgtgtgttttttaaattttttaatttaatttaattttttttttgagatggagtcttgctctgtcacccaggctggagtgcagtggtgcgatctcggctcactgcaacctctggctcccgggttcaatcaattctcgtgcctcagcctcctgagtagctgggattgcaagcgcatgccaccacgcccagctaatttttggatttttagtagaccagttggc

SEQ ID NO: 26643 - DNA, 1046 bp, Homo sapiens
tcggttcccatgtattttccatgtatttgaaagaaaggagagatggattagaaaatagctacaactacagcagtaaaaacagtttgtattgagcaatcactatgtgccaagcactgttgtaaacaggttagaatacattaggtcatttaagtctttcaacatttaagggggtccttaactatccctcttttacagatgaggaaattgagtagcagataggttaagtaactgatttgtccaagattttacagtaagtgatgggccacaggacttggagttaatatgtttgggtggaaaggagagcaccagtggttgaatacagaagaggtatgaaattaaagctatggagaaatatttgatttaattatttaattttgttgtgttttcacatctgttagaaagtaccacctattacatatgcattacagtaaaacagttcctttaatatcagaatttgatagaaaaattgctgaaactgtgctggttgactgttctttgattatgaacctgaaagcatggatatggcatttaatgactatcactctaatattgttttagagtacaaatttaaaagcataatcccttgcttcaggggtcttagaggctaagatgtagattgtttcattaataccaaaacaattctttaagcaaataattgtcaaaattggtatagtgatattatgcatatatttcatattgtacttactttaaaattgacatgcagtaaacaaataaaggctgtgcttgcagacttctagtaccagttctgtccctagctggagctacatgattttggcaaatcatttaacttctctttaatgcagatttaaacactcaaatgtaatcaaataaaggaattgggttacacaatacattgtactaatactatttcttgtgcttattactcacttttcatttcagtagatttgtttaccaacaatttgataatgtcagaggtggtttcatatattttacatataaatattcaaatctaatctatacaaagcagactttatttctgattttgtgttattcataataactgg

SEQ ID NO: 26644 - DNA, 1050 bp, Homo sapiens
gacactcaaatgctcaattccctgttgaagaaatgaatgatagaccttatctatcatttatttgactcatgtgtacacccatgtatatcacagacatttttatttaattattcaagaattggcacatgagaagcattatctaattcctctgggaccttccactggcaaaaataaatgcaatgactgtggctaccagatgaattttgccctttttcttatatttgaaagtaatgactttattatttctgaatttaattatttaaattttaagcaaaacagaaaatcactacaaagaaaaaaatgtcaacaaaatcttactatgtagaagaaaccgaccccttccctcagctgccgccaagctgctcggtccttccgaggaagctaaggccgcgttggggtaaggccctcacttcatcctgcgactagcaccgcgtccggcagcgcctgccctacactcgcccgtgccatggcctccgtctccaagctcgcctgcatctactcggccctcattctgcacgacgatgaggtgacagtcacggaggataagatcaatgccctcattaaagcagccggtgtaaatgttgaacctttttggcctggcttgtttgcaaaggccctggccaacgtcaacattgggagcctcatctgcaatgtaggggctggtggacctgctccagcagctggtgctgcaccagcaggacgtcctgccccctccactgctgctgctccagctgaggagaagaaagtggaagcaaagaaagaagaatccaaggagtctgatgatgacatgggccttggtctttttgactaaacctcttttataacgtgttcaataaaaagctgaacttaaaaaaaaaaagaagtaaccatcattaatattaggtgaacatctttcttgacagctctatgtagacactcagatattaggagtgatcggtgcataaataacttggtacatagaaataattttataaaactggatacatattatgcatgctatttttaaataaaaatattaaatttacatttacttagacgtaataagagaga

SEQ ID NO: 26645 - DNA, 1031 bp, Homo sapiens
atttttaccattaacgacctgaggcaggactggtggaggtcagttcattagttactgatctcaagaaacaagtcaggactattttctaatgtgcttctttcaagttagtgtggaaagagctgatgcatctgttgtagctgacggaatttaaggaactgaataattgacaagatttccagaaaagcagggtcgccagataatgctacctgtttgcgaatgattgttaccgtaatgctctagagagctaatcctttctcggcctagtcagatgattttaaatcatttgattttacagagctttagtttcagttttttaaatgaaaatggggatgggattaggtcatcttctaacacccacgacagccataaattgataatctatggatccatatttaaagttactgataaaaataaccacaattgaccagcctcccttccctgttaggaaatgctttatattttaatttagcaacccatgtgaccaacccttttagaattgaactggctctccctaggaaaggttagaaatctaatcagttatagtaagtttctgttaacaaatggggagtggtcgacttggagtttggaaaaggggagcgtaaagtctaaaagtttgttaatttatctagccgttgctccaggaggacctgtgttatagtttggaaacatttacaaagggtatttttgtggggcagaaaacagttagcagtccttaatgtaatttggttgaaataaccgttcaaaccagactcctcctgttgctttgattcctttttcgcaaactttcttatgttctacgtatccaggtgctcctgatggccagcaatagacttgagacattggaagaatgtatagccttagcgtctatttagtgttaagattttgtaagtctaattactgtgaaatagtcctggtaactttatcgattctggatacaaagaaaaatgcaaagtgaaagacctttggaaattgctattcacaccagagtactctatgagacattacataggtgatcaagaagagtgatcacc

SEQ ID NO: 26646 - DNA, 2017 bp, Homo sapiens
aaacagaaggacttcagttaagatttaggctctatgcaacatacacttcttgcattttctcattcaatgtcctttcctttttttttttttttttttttgcaagaatgtagctgacattcagagtagattagtaccttcaatgtctgtgtgaaagaaatgaccttaatatgaggacaatattgactgtgtatttagggggcccactgttaaggcatatagaattttgctttatttcagacctgacaatctcttgtctgctctgcttccgcataaaattataatactgcacatggatgtaaaacccaacctattccctgcctgagggactagaatagagggaagaatgactatagttctttgttgccttttgtgaaggtaacaggcacagaggtatgatgcatgatggaattatatacctcttcttgaggtgtttgagggctgactaaggacctgtactttttttttggtttgttttgcagtactggggccagggagccttgctgttgtgtctagagagtgttgaagaaccatgaatatttcgcaaaaagaaaataatttttttaaccattaaaattcctggtagtgacttcctctggcaagtaaaaaactctcattttccttaaaaaatgagagttttttacttgcaataggaaaacttgccaatttttcaagttatttttattcttgatgattctcaatgagacataattaaaatacacatagaaaaaacaaccgtaggccaggtgcagtggctcacaccagtaatcccaacactttgggaagtcaaggtgggaggatcactagagaccaggagtttgagatgagcctgggcaacatattgagacactgtctcctcaaaaaattaaaaaaattagctggatccagtggtgcacacctgcaattgtagctatttgggaggctaaggtggaagaatagcttgagcccaggagtttgaaggtgcagtgagccataatcatgccactgtactccagcccaggcaacagagtaagatcatgtctcaatgaaaaaaagaaaaatcaaccctagtggactggaacagggctggtttactttgtgtcagctgcagtgcccccactcgccaacccacatgttcttctcctgctggttcccaagcagagaccagaaccaagaatgagaatcatcctgtgggtgcaggttgtatcttatcctccagagacagcacttcaccctctgttagaaacttctttaccacactgcctgtttggtgaaatccttagggcagtgacttccaaactgtgatccaggggccacccttggtgggaggatcaggaaggagggggaatgtatcttaagaaaagttgggggaagctcatatctcttctcgttgatcctgagaagtaaagtctttcctcctcagagagatgcgggtagacatgactcgcctagatagaagctcattcatctccctcccttctgcctctgcaggactcttggaagtctgggtccccgggagtatgcggctcttgctctgtgctacaggtttccaaagttcacttgataacagtacaattgtgctgtaaattgtgcagtaatggagactgaggaaacaattagtctttcatcttcattcatgttaccagctcacttcctatggtgtgaaaagagccagactttggagttaggagacatctgaatacagacagaactggcaagattatggggaagaaaagggaaaagtaatgaatattttcaaagaggttaagccatttggccaggacaacactgcttgcaggtagcagaactgggattttgactgtccataatccctattctctgcttgttttactccttccctctcttctttcttttttcattgtctaatgacctacagacattctgtcagctgctaaagaatgagggactcctttataaagattgataggacagtgtcgctacttaaggagttccttccatgtggaccagtgggggcgctgttgacgcatggggctggacttctctttggagcagagtcctg

SEQ ID NO: 26647 - DNA, 1026 bp, Homo sapiens
cagcagatgcacaaacattataaggtattttgccctttgctggagactaaggatgatgggcaggaagcttctaatctaatctagtaggttttgcaatttagaaatgaaaatttaggtaaaattttatgatatccctgaaatagaccctgaagtttagaagaagataattttcaaattcttggcctaatgaagtggacaaaatgctaccaaagttcctcagactctgaaattctgtaatttattgtcaccaaaagtcaaatgcctagaccagtgttgatcattctcatgctgagagtaattagtgaatttgttcagggtctggggggaccccaatttcaaagcaaatggaaaccagagatggttgttctgtcaatccaattgtcactttatagtccctaaataccaaaggctaagctttggcaaagttgggcagtaaaaatctacccttactgcaaatctttctccttttgatccttctctccccaatcagttctatttcaatccagaaagtcagcaactttgaactttctcttccgtctgtgaaaacctattggtaagtggtagatatttacagcttagtaaatacataagtgtttctaaatatctaagtgtttctcccaaggatatttatgttaaagttttatatctaattttctaataaaagttttttctccctattgagggaattgttttccatttatataaaattattttaaaattatttgtataaatttaaggggtacaagtgaagttttgctaacatggatacactacctcctggggaggtctggacttttagtggaaccctcactggaataatgttacaatgtacccattacgtaatttctcatccttcttcccctcccctcccacccttctgagtctccattgtctattccacactctaagttcatgtgtacacacactacttagctcccacttatatgtgagaattttatgtttcacgatgagtaggtggagaagatgtatttagggagtaagacagaggactttcttaggttccct

SEQ ID NO: 26648 - DNA, 1035 bp, Homo sapiens
tagagagttaattagaaaatgcttgtcatttatttcataattcgggggaaattattttgttttataacacttttaaaaaatatttagctttgcagttcctgaccccttaatgcctgacccttccaagcaaccaaagaaccagcttaatcctattggttcattacaggtaagttgtacagttctttgcctactgatgaaatatataataagtttgtaatgtcagaggggctaacacaaggaattaatattttaaagacaagatagtgatatattttgttttccaacttacgatcattagattaacagagctaacttgaaattattttcctatttatgttctgggttttctttcatatacagtatttgcctttggcttatagaattctcatttaagatcaacaggccctcagtgcacatgggtaaagtgttttatactttaagaatagttcttgctactcttgtgacaaatctctttctacttctgttgagacagaagactttatagagagcctaaatcaaatcagtgaacctaactgaagaaaaggagtctatttgcttattctaccaaaaaaaaaaaattttatctatacacacacaaacacacacacatatattcagctttgaatttctatatgcagaatatccttcttgcagattatccatgtgctctgttaggccatttccctccccattattcagccagtcctttggtctccttttcctgcacagtgagcttttctatagttttcttcaccttctgtcccccactttatgcaagtctgttgtttgctgtccctactcctcatgtgttcttggccagctgtgggtttggaagtctatagctaggaggggagggactttaggaactgatggcagtgaaacctgtagatggtctcctctggtgttgccaaagagggcggtagtagcctgtttttctagttgatgtctgataccagctcactgtggtttaatgcaagaacaccattcgtagcacaaaactgcttcagttttggtattggggtataaaaatataaa

SEQ ID NO: 26649 - DNA, 1050 bp, Homo sapiens
aggctgtcagaataaaattatgcacattttgctatcaaacaattctgctgtaaatggttcctttaaaagaaacttcttgctgcagaagaatttcccctccaggaataaaggaagagtaaaatactaatctgcatttcttcagaggtgtgacacggtctactttattaccatgttatataataaacatatataatgtagaaataaggatttttatgcaggtatgcatagaattatatagaactttaaaaagttattttttaaaattttttcacatggtgaatattttattacagtatataaccatgtagtatataacatgtacatatttttatgtacagtatataacgtacatatttttattacctagtatgtgtatgtaaaatctatagtgactttgttttgtgtattgaaaacatctttgtaagctgcacatttttgtgggagataaagacttctttttttaaatcttaattcaggtgaaggtacaagtaagaagctggcgaaacatagagctgcagaggctgccataaacattttgaaagccaatgcaagtatttggtgagctaaatttctttgtattcagcagctcaaaaatatcatggctgaggtaagattaaaaatttgaacatgcttacaaaagcaacaaagtgaacagttgttagcatcctacctctcaaattctatttccttatgaaaacttatcatccattaaagaaaactttatccaatcaaatccagcaattagctattaaatgaaggtgctcatgaactaggctttactgtttttttttttttaatgggatacaacagtagaaaatcagtgcttcttgcaaatattaatattaacattttgtatttagactttgattatttctacattgaagaaaacaaagtgtgagatggagaaagatccactaaaagtactcttttgggaattctaattttgaagaagcaggcagaggttttcttttattatataatgtataccaaaagaagagaatgttaagtgggatattaattcttgacatatctttctaaagtaagattttt

SEQ ID NO: 26650 - DNA, 1047 bp, Homo sapiens
ctttaggtccattgtgctacttttgattctgtatccaaacaaaatgaggaaggggagaaggtcctcatatattacataataacttctagtttttgaaactgaacagatattttgtatattatccactttttaaacaagaagaaacaggttcagagagattataagtaacatgcgtatagcaatgaagtcacaaagcaatgaaattttaaagttcatgctttcttttggtctgtgagcttgagcaaatgataactaaagttgctcatttgtaaatgtggacattatttttcttatgtatctatttaattgcaaacacagaaaacattggatgctaaatttaatttggaagaatgccaagaaaaaaatttagtaggaaggctcaagttctaccatctggaaaatctgaagacagcatttgtttgtgtccctggaagtttggagtcttttattttaattgatgccactttaagaaaagtttaaaactttttgtgtgaggcagttagattgtaggtgctggccggaagggtccccatgggaaccatagagtcaacactgcattacttactttagctagtctatttctagataggaagaattcaagaaaagggagggtttttccctctcaatgtgttttagaccccaaattaacaacctatggcaaccgttctgcctacgccctcttctcacactaccatggcttcctgtgcaagcttatctgcctccatggcttctgatactgtctaaagactaatattctgaaatgtctgtctacatcccaagcccagttacagaatagtgtatcagtctgtgcttgctgagcatctttgcctggatgacacagaggcccctcaagcctctcattgtcccaaactgaatccatcttttccctcaaacccattcttcttgcattccctttctatgtaaaggctccacaatcacctagttcagtagaaatgtaggcttttgtcttcctaactacttcccgtctttctccctcttgtccagtctgttattaaactctatccattggcgtttaataatccacta

SEQ ID NO: 26651 - DNA, 1026 bp, Homo sapiens
aactacacatgatataacctttataccatcaatatatttttctcatcatgtcttaatgtattttatgccattttaaaaaatgtttttcctgctgaatttcctgctcaaacagtatgatcaccgatgaactgatatttacacataggctatctcatgtagattttttatggtaaatttttgcttctatttgtattcactgcagttaatagatttgtattaatctgaggtttttctgtgtgttttgatttttagaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttattta

SEQ ID NO: 26652 - DNA, 1035 bp, Homo sapiens
cttccttcagtgacttcctgtttgctcagatggagtttgtcttcttggaataatgtaggagacccttcataatccaattcttgcataattttatcttctataacattcccataaaatcacacagttgtttttatctccctgaaagcatcatgctgtttcatgcatccatgactaagaatacttgtttccttgttttctgctcagtgaattcctacttactcttcaagactcagggatacttactttactttaggaagcctttttggacttctaaggcaagttagtcacttgctcctccctactctcataaaacattttaaatagctttataatagtacttataacatctctgcaaatgggagcatcttgatagtagagaccatatcttatattttccccagcacacattatctaatacctgaatacagtatatgtatgataccatcttcatcaaagtggcctacattgttttttagtttcatatttaaaaaataattatcacttcccttcagtccattgtagaattactttaaccaagttgaattttaatgtcatgttatagcttttattcagagcatctttatttttttttaaaaaaaagccttgtgatacctacttctatattgttattaagctttctttaaggacatcaagtatagtagagcacagtgtctggtaacatattatcggtatttgagactgcagtgggagtcccccatcccacctgcagtacgcagaatttcatggaaatgaaggaaatggaccagagttaagttaggttaagttgccttaaaaatttaaatggttatattatccaaaaagaccacaatgagattaaaaaaataatttgaattgtgtttctctacacccagaggtcagtagagtttttttgtttttttaagccctccatctagtttttaagaatgtagatggagggttttaaaaaaaatcagaattaaatattattttaggtactataatataatgaaaagcgttaatgtttaaatgtttctttagctgggcatagtgatgcac

SEQ ID NO: 26653 - DNA, 1075 bp, Homo sapiens
cttctgtggatgaggtgataccacacagaaagctgaaaagatgtaatctaacagcatgcacttcaaaggggatacggttttttgaaagaagagggaaaataaatggtctgcaagtagtgaggaacgaggcacccaaacccaccttcaggcttgcagtatgtcagacatggaaacagtaatcagttgagaaggctgcaggggtgactgagggcggacaggtttcacttagagcaaggaagagaagagaacatttagaggtcagggattgagttccagggatcacaggattaggaactttccaccctcaattttaataattttgccttagaaaaaaaaaatcatgtattacttagtttatctggagaaattataaaatgtaatctcttccaggaactaatttgagccttagtttactttgtaacatcttgattacaggaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatgtaagtgtctattctgattcttttcttttcttcaaattatctgaacacttacctacacgtaatttttttcaggtttgcatgcctcctaaattatttttctgaaccaataaaatgaattactggtgggggtaatgagataaaattctttgattttttttaaaaacaagtattttttaagtcattctgcatgcaattcaaccttttattgtctaactagagtgttccaatctagtagaatattttattttgactccttctcaatgtttatgctttataacttagatggaaatggaagtctcaatacttttttgcattctgctgacctgaatgtacttctttgtcttcctggtgcatgcatctgtgtgttctgtcttccagataatgcatattctaatgattcgtccttgtcttgtaacagtgtagtcttttcaagtgtaattgtgat

SEQ ID NO: 26654 - DNA, 1035 bp, Homo sapiens
aaataaaacagagaaaaaaaaacattatatataactgctatatatgtgttagtcatagaattacttagaattgatggaaattggaaacatcctatgttcccgacaatagagaattgaagtattgatagcaggtacaatagttatttgaggcagtacgttacttagctcttaataagagtgggttgattggttgcttggttggacagatagaagagatggaggcaggcaggcaacaggattggccttctgaaaaaaggatttgcaaagtcattgaaaattatgttataataacaatagccaagtggaaaaatcattaaagtattatagtttaatgctaagtgaaaaacgggatgaaaactacttgttatctatgagaattggctataacactgaaatctggagtagcatatgaaaacccttacgcaggtgaaaaattaatggaaggaaatagaatatggttgtcccttggtatttgtggtggattggttcaaggacgccctgcagactgtggataccaagatcaaagatgttcaagtctcatataaaatggcataatatttgcatataacctatggatactctcatatacattaaatcatctctagattacttataatatctactacaatgcagatgctatgaaaatagctgttatagtgtactggcttattatttgtatctttaaattgttgtattgttatttttttgtgcttgattttttttcccaaatatattcaatctgtgattggttgaattcaggcatgaaaatctgtggatatccaaacagggctgagcgcttatgtgatttttctttatgatgtggtatttttatataattataaaaagatccataaactgttagatttagaaatatatttttttaacctggtaaaagcagaaatgtatatctgcactgctcttttctacgttaagcctacccactgggtctataatattatgctgcagagatatccccattcacttcttgggagctatcctgagtttagatttaggatataaccatacatctattct

SEQ ID NO: 26655 - DNA, 1031 bp, Homo sapiens
gattagtaccatcagacagaaatcccacagtataattttgctctacagggaaataggattgtttggcacagtatcctgagtaatgaattcaccaataacaaaaatgtgattgataaaaaaaaatataaaccgtatgtatgccatatttaatatgtagtatagtatttctaaggtgcgtatatttatgatatatgatatagcattttaatatactatctagtttacataatatatatgtacacacacatacacacatatatatattaatatgtacagttttcctacttattgtgatacatacatttttaaattccatttataacctggtagatatgtaggtagataggttttaaaaacaagggactagaattgggaatattgagaagtgagaattacatttctttacagatattaatttcaagtatcttttatttgtaaagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtaggtgtctgatttgaatatatttaactctttttaattccttataatttctactatgtgactgactattaagtcttatatacactatatagaaaaccttagaacacatcaaactggattctaaaacttttaaattatgtattgttttacaaatagtatttgaattaaaagttatgttattttcacagtgatgacattgagcattcagcttagtgtaacaatgaacttcaaaaataactggttcttggaaacgtcatcagtggtctcagtgtattcttgcaataaataacatttcattattgatacttgatttattcttaatttctaataacttagttttttggttaatttaggtattacaaagagtatttctatccta

SEQ ID NO: 26656 - DNA, 1043 bp, Homo sapiens
ggaacattagaaaaactttaaaatggataactttttgattgccagatttactcttcatagggcttatcattttaatgtccttagctaattttaagatgatgtgaaaattttttattacttcattgcattaaggaattgattattgatttttattacaaagaaacaagataaaatatttttgaaaatatttcatctgaactgctggtacctgttgttttttaaaatgtggtattagaaaaaatttttgatgaattttttatcaggtatctataacttattgaattggttttaaatattgtattaagtaaatgataatgtgtcatcatgttggaaacaatattgcatattttaacctaattttacctcctggttactttcgtggattttaatagtgggttactaaatgtttcttttcttttaacctttttataggttattttagtgtccgccaacaaattgactcgttatatagaaccatgccaattaacagaagattttggtgggagtctcacctatgatcacatggactggttaaataagaggctggttggtatattacaatgagataaaatgttattgcatagaaataagatatattttgataactttatcattttagtctattaaaatatagattatttttctttttacaaaaatggagaaatatgtgcataccacattatagcataatagacaaatactgtgaagtcagacttacttgattagaatcctgattctagttgctaggccttcaacaatgcgtttaatcttgccttggcctgattcccacatctgtaatatggtgatagtaatagtacctacctttgtgtgattatgggtaaaatgaaatgaatatacatataaagcatttagaacagcaccagacatgatatagtggcactgtataagttttagctattactgttctgtcattagtagcatcagtaaaggttgtaaaatttttaattagaataacagtagcataatttttttttttcttttttttgagacagtcttgctctgttgcccaggctggagtgctg

SEQ ID NO: 26657 - DNA, 1050 bp, Homo sapiens
aaaattaagtttaatataagggacatctgtctgtaagtgtttggatttatttctgggttctgtgctggtatggtataaaaatagtcacatagaccaatggaacagaatagagaacccagaaataactcatcctgtgatttatcatcttacgattttaaatatgaaataaatcatcctatgattctaaatatgaaaacaaagaaacaatgacactgttattatggccttatagtatagtttgaaatcaggtagtgtgatgcctccagatttgttctttttgcttagtcttggtttggctatacgggctcttttttggttccatatgaattttagaattgtgttttctaattctgtgaagaatgatggtattttggtggggattgtgttgaatttgtagattgcttttggcagtatgggcattttcacaatattgattctactcatccatgagtatgggatgtgtttccatttgtttgtgtcatctgtgatttctttcagcagtgttttgtagtttgtcttgtagaggtcttttgcctccttggtttggtatatccctaagtattttatttttttgcagctaatgtaaaaggggtagcaaacaaaaacataaagtggggaaaggacacccttttcaacaaatggtgctgggataattggctagccacatgtaggagaatgaaactggatcatcatctctcaccttgtacaaaaatcaactcaagatggattaaggacttaaatctaagacctgaaactataaaaattctaaaagataacattggaaaaacccttttagacattggcttaggcaaagatttcatgaccaagaatccaaaagcaaatgcaataaaaacaaagataaatagctgggacctaatgaaattaaagagcttttgtatggcaaaatgaacagtcagcagagtaaacagacaacctacagagggggagaaaatcttcacaatctatacatctgataaaggacaatatgcagaatctacaatgaactcaaatcagcaagaaaaaaagcaaacaatcccatcaaaaagtagg

SEQ ID NO: 26658 - DNA, 1051 bp, Homo sapiens
atgtcaataaatatttaaaagaaggttttgcagaaaataaagaaccatataatttttaaattaatataatctaatataattatatatatttgtgccattttgtacttttaaatatttgtgctctaattcacggtgttatttcttactcattaatcacttcactgaagattttcaaagctttttttgtagctttggaaaatatttctttagaattttcagcaattgtgtcattgtttcttcgttttcatatttagaatcataggatgaaaatgaattatacgtaatacatgtgatctcaatatgattttgagggggaatcttttctaattttgttcttacttttagttgataattgctctctgaggatggactttaaaaaatttgattatgggctgggcacagtggctcatgcctgtaatcccagcacttggggaggctgaggcaggtggatgacctgaagtcaggagttcaagaccagcctggccaaaatggtgaaacctcatctttactaaaaaaatagaaaaactagttgggcgtgatggtgggcacctgtaatcccagctgctcgggaggctgaggcaggagaattgcttgaacctgggagttggaggttgcagtgagctgagatcgtgctattgcactccagtctgggtgacaagagcaaaactctcaaaaaaaattttttttcattatgtttctttctttgtttttttcttctttgccgggtcatagaacatttccaataagataaaactgatcctttgatttgcattgctttatatttaaactttcatataggtttgctatctatggaaattagtggtctcttcaagggctgtaacagaaaggaatataggaagccctaccagtattttgtaatttaaaaagctgtaatgaaacaatttatagaaaatcacctagtctgggattcctaatcttgttttgttgcattaccctgaaatgtgtcagttttctctgttttcttcgagtttttgcttttcaaacatctagaaatctctacacagttttcctttttcagcattccagttct

SEQ ID NO: 26659 - DNA, 1037 bp, Homo sapiens
ccaaattagatacaaaactaattattgttctatagatccataagttataaactttgaggttgtctcttattccactggacggaaatatatcaatctcgttagacaacaattatttgcctttattctttttttttttttttgagacggagtcttgctctgttgcccaggctgtagtgcagtggcgcaatcttggctcactgcaacctccgcctcccaggttcaagcgattctcctgcctcagcctcctgagtagctgagattacaggcatgcaccaccacgcccagctaatttttttttttttttttttactagagacgaggtttcaccatgttggccaggctgatctcgaactcctaccttgtgatccacctgcctcggcctcccaaagtgctaggattacagacatgagccaccgtgcccagcctatttgcctttgttctaaacagaatctacaagttaacttctactcctacagagcttaatacctactgatcagtctatagagagtcaatcaaagatacaaacccaccactgcatgaaagaacactcagtaataatgtctgcctgtttctgagatttaggtagtttttcttatagatgaattttattttttaataggaggatattttgtaaaacttgattttggatatcagtgacatactgcattgatcactgcaagataatataagctgtttcttgaagtttgatattttagtatcaaagtaagtatcagtctctctttaaactttgtattccaagccaagagcaacattatttagcattttcctacatgattttgtaaattgttccagaggatttatatccttaatgaaggaatcatatttttaatactatcttttaaaaaatatggtttttttttttacttaaaatatattaattggaaaactttcagatattagttgactagtttgggagatttgtcagttgctcagatttatcactcagctggaaatcataatcagtttggtgactttctctattaaacaatttcaaataaaccactggtgaataacaa

SEQ ID NO: 26660 - DNA, 1056 bp, Homo sapiens
ttagacaataagcagttaagcaaacgtaacagcccatggtgataaatgctatgaagaaaaatacagcagtgaaagagactgagtcagatgatgccactttaggtagggtagacagggaaggcctctctgaagagggaatatttgaatagaatcttaaataaactgagggagcactcctaggtataaggcaaagggcattccagatagaggaaatagcatggacaaagacctgaagtggaacagacttttcatattgcaggagcagcgagctgttgtggaggagtgagctagcaggggaaggtgtaagatgagatctgagaggccaacaggggcctgagcttgaagggccttgtaggtcttggtaagagatttgaatttcattcagagtgcaagagaaagtcaagcaaggagccttgtaatgatgatatttcagaaagctggatagtttggcgttgttaacaatgcaggcggtagaacttgttggatttaagatgcattttaaagttagactctataggacttgataaaatatatgtgaaatatttattaattccataaatgttcatttcagttcattaggtagtataagtaaccatatcaagtaaatgtgaaattgtattcgtcaaagattagctttttgtcctcttcttcaagttaataatcatgtaaaatcttggtctcattgtataatgactgataaaaaacttattttagtgagaaaattgattttacgtcttttgaagaaattctccaagatgattgtgttagaaaaaatttttcatactgtagaaaaatcaaatttaataatttcccaactaaaaattaactcttacagtttaagctaaacatattcctagtacagagattcagtaaaacaaaaagtaattcacatgtacaatttatgctgcattttttatttgaagtattttctgaatcaccttgtctttcaagttcttctttattgccatgtatgttttgaagtctagagaatttcttctttattattttaattcttctccaaaaatctcttatgtagcataatcttgactgtctggt

SEQ ID NO: 26661 - DNA, 1035 bp, Homo sapiens
ttttaattgttttgtttatgtggttatcacatatatcaactggtgtatgttaaaccaaccctgcatccctagtatgaaacccacttggtcatggtgtattatctttttgatatgctattgggttcagttagttagtattttgttgaggatttttgcatgtatcttaatcagggatattggtctgtagttttctttttttgttatgtccttttctggttttggtattaggggaatactggcttcacagaatgatttagggaggattccctgtttatcttggaatactttcagtagtattgataccaattcttctttgaatgtttgatagaattcagctgtgaatccatctagtcctcaacttctttcgttggaatttttaaattactgtttcaatcttactacttgttattggtctttttagagtttttctttcttcctggtttaatctaggagggttgtatatttccaggaatttacccatctcctctgggttttctagtttgtgtgcataatggtgttcatggcagccttgaatgatctcggttataatatctcccatttcatttctaattgagcttatttggatcttctctctacttttcgtggttaatttcattaatggtctattgatttttgtttatctcttcaaagaaccagcttttttttcatttatctttttttgttgttgtttcagtttcatttagttctgctctgatctttatttcttttcttctgctgggtttgggtttcatttgttcttgtttctctagttctttgaggtgtgaacttagattgtcaatttgtgcactttccgactttttgatgtaataggcatttaatgctatgagctttcctcttagcaccattgttgctgtatcccagaggtgttgataggttgtgtcgctattattgttcagttcaaagaaattttttctatcttgattttattgttgcccaaaagatcattcaggagcagattgttttaatgtatttgtatagttttgagtattccttttggaattaatttccaatttt

SEQ ID NO: 26662 - DNA, 1035 bp, Homo sapiens
cttgggttcaagtgattctcctgtctcagcctcccgagtagctaggactacaggcgtgggccatcatgcctggctaattttttgtatttttagtaagagacggggtttcaccatgttggccaggctggttttgaactcctgatctcaagcaattcacctgccttggcctcacaaagtgctgggattacaggtgtgagccactacatccagctggttttgttttatttaaaaattaattaattcattcagttttttagagatttagagacagaatcttgtactgtcacccaggctgtaatgtagtggcaagatcatagctcactgcagccccaaggtcctgggcttagtgaggctcctgctggagcctcccaagtagctaggatacaagtgtacaccacctcatttgtgtgtgtgtgtgtgtgtgtatatatatatatatatacacacacatatatatatatttttaataatttaaacttttattttagattcatggggtacatatgtagtttgttacatgggtgtagtgcatgatgctgaagttagggtatgaatggtcctgtcacccaggtagtgagtaaagtacccaataggttgtttttcagcccttagcccccacccaccctctcccctctagtagccccagtgtctcttgttatctttatgtccatgtgtacccgtagtttagctcccacttacaagtgagaacatgcggtatttggttttctgtttctttgttaattcacttacgatgatgtcctctagctgcatccatattgctgcaaaggacttgatttccttcttttttatggctacatagtattccatggtacatttgtaccacattttctttatccagtccaccattgatgggtgcctagattgattccatgtctttgctattgtgaatagtgttgcaatgaacataaaagtgcatgtgtctttttggtagaacaatttattttcttttggatatatacccagtaatgggattgctgggtcgaatggtagtcctgttttaagttatttgagaaa

SEQ ID NO: 26663 - DNA, 1046 bp, Homo sapiens
tatctcttagattgcctgggttttcctttttgttatggctactagaaagccagaactagatttgtggcccactccataccgtaaataggtttttatattatacaatttttagcctttttcttggcaccatttttggttcttttctctattctttgcctttatctttagtttgttaacttgttatagttcatttattgtgtctttaatcctttgcagaacaaaatggggtatatacaaatgtaggcatacctctaagatattgccagttcagtttcagaccaccacagtaaagcaaatatctcaataaagcaagtcacacgattttctgtttctcagtgcatataaaagttatgttcacactgtagtttacaaaatgtgtgatagaattatgtctaaaaaatgatctacgtatatcttcatttaaaaatactttattgcttaacagtgctacggatcctctgagcctaagtgagttgtaatctttttgctggtggaaggtcttaccttagtgtttatagctactgatcaggatggttgttgcttgaagtttggggtagctatggtaattactttcttgcctttttctttttttttcataagggcagccccctgaaccagaataggttcaagatagactccctcattctatgacatagaatgagatgtgtcctgattttaaataaaattgaaaaaaaaacaacaacccaccagtgaagtatgccacattgatggactcttcttctcatgaaagatttctctgtggcatgagatgctgggtggtagcgtttgagccatagtagaactttcacaatttgagtcagtcctctcaaaccctgccactgctttatcaactaagtttatgtaacattctaaatcctttgttgtcatttgaacaatgtttatggcacgttcactaggagtagattccatctcaagaaactacttgctttgctcctctgtaagaagtgactgctcatctgtcagtttttttttttttttttttgaggtggagtctcgctctgtcgcctaggctggagttcagtggc

SEQ ID NO: 26664 - DNA, 1082 bp, Homo sapiens
actaaatacgtgaaaaaattccccaaggacctagaaagcatttcacaactctataggctgtttttatgttccaaattccaggaaatcgttttgttgaatatttattcaaacattctggactaaatttaaccttaaaaattgggcccactctagtttttccccagcattagaaaaatgaattgattgcatttaccaaacattttagcccctgtgaataagaattgaatggaataattgatgtaagagattaggagctagtgatggactaggaatctgacaacagaatgcagaatgtagaaagttgtaagtagaggtcacaaagttgcatctacttgggttttaattcattgctaggcatttaatgacattttaaacaggtaatctactaatgatatatctgaaaatgaaatgtccaataattaagaaaacaaagtattgcattttgacctttttaaaaaatgtatttttataaggacttgttgaagcttttccactctctaaaaatgaacttggtattaatgacatttcttttgaaaaaatgaaattgtaccaaactaatccgatttttagaaagtttctctgttatagtagttttactttactaaaaataccattcatctgtatagtagctaacttcaaagatcttttaaagctgttacaagcaacatgagcaacctcttgaggaaagtagaatatttactaataaaaagtagcaagcagagaagtgagccatgattggaccactgcattccatcctgggtgacagccagactttgtctcaaaagaaaaaaaagcagagacttaaatttttataatagttttctttgagatataattcatatgccatagaattcacttttttaaagtatgcaattcagtagttttaatatattcacaaaattatgcaaatgtcggcactaatccaagaacgttattaccctaaaaagaaccttgtacctggtagcttttgttactattcccccttccccatatttgacaaccactaatttactttatgtctctatggatttgcctattttggacattgcatgtgaatagaatcataatatgtggcctttagt

SEQ ID NO: 26665 - DNA, 1039 bp, Homo sapiens
ttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaat

SEQ ID NO: 26666 - DNA, 1028 bp, Homo sapiens
ataagctgagaaactacgataaaggaaaaatattttaaattcagttttaaccccataaatttatttaaattcttaaattctcatacttttcaacgctgctttgaaaaaggattgcagccagtgaagtatgtcacatgtttgacgaaactatagtttgtacagtatagcaaataaatcttatccattttttttaacaacacttaaatgtaagaaatccaagtgggcaagatattcaggtataaatgaatcaccacttggctgtacatattctattgccacagcatctgaaaagccatctgttgcatctcggtgaaagattcatcgttttgtgtaaaagctggtgtattactacaaaacccaaaggacattgtggctttaaatccctcctgatgcggcttctttgatgttttttgatgcagcacttcattattgcttatcaacttcagtgcagtgctcaaaaggatttatttttaaatgtaacattctgccaggctgctgccatggtggctgctgtcggagctctttagggagaaccctgagcttccctaagggaaattcaggcacgtaactgccaattgttagattttatagactcagagttctagatatacatttttctctttggcatcactagagtctgtgttagtctcccctattcacttcctaaattcagcaaggaagcatcagcattaaagagaaattttatttgctcacaaatcattttgagcaaaatcaagctggcagtagaaaaaaaagaactcaaaaagcatcattgtcatcctaaaattatacaaacttgacagtatttgaagatattcttattgggaaattttgcctatatttgtcaaaacattttattagaattaatagcattgactgcattttttaaaaattctgctcatttataacatacagaaaagtgcacataagtgtgcagttgaatgaatgtacacaaatatagcatacatgtgtagctggccccccagatcaaggaaagaacatttctggcatcctagaagacactctga

SEQ ID NO: 26667 - DNA, 1107 bp, Homo sapiens
tagtatttctcatcacggtggagcaggatgcagactagaaaacacatgaactagagcgccacaaacaaacacggcaggggaggcagttgagtcgtctcaggaatattaagaaaacaagctcattttaatgggttttagtttgggctgtatttttaaaatatctttctgaaagcatgtcacaatttactaatattattttttagttttcaaaactttgtattcattgagtatgtcttcatcctaaagaatctaatataaaaaaaagcactttactaaccacaaactagtttgtaacagggtatactgtaattaccatggcaattatattagacatctttttttattcttgctaacttggaattatttcaagattttctctttggactgacattttcaaatcttgagctctagtgaagatgatttttacttcttcacattgtgaaagttgaattaatcttttcagagagtttttcatatggttaatttttggtattgggacacttcaacttagaatttgaacttcaaaccaagaaaaaaagacttatggggcaataatattatttatctttctttttctgactgtaagacatgaacataatatatatttcatatcaacctcataaaacattccaatgttcccaggccacattaaaatgcaaaataagatggtattatataacttgtatcaataggacccatgaataattggcacaaagatatctgtgcgtatgtcgtgtgaaaagctcagatggagtgactacaagaaaggtggatggaaggaacatgaaagactaatgaaatcataatttcaagagtaaagctactgactgtgaaggatacagattaactttgtatatgcagtcattgacatattaagttatgcctgtatccaaacttaggtgtcaacatagtacattttatatgtaaaaaacagtcaaagtaatatatacatcctagactttggctaccactaaactgtattaaagtgttgctgtaccttttaagacaaaatgatgcagtaaactcaccataaaaatataaaacccagatttgtggctgttaaaaatataaccaccaagggaagtagaacttttctgaagatataaa

SEQ ID NO: 26668 - DNA, 1033 bp, Homo sapiens
aactttttaaaaattcaaacattatctgcacagtgatactttgaaactttgtgaatattctgtttcccagatttttccctagtggttttagcatccattgatgatcattgcctgaattggctattactatgtgatagtgaaattctagttttctgtttctaccattacttttacatgtattagttcatttgcctggctttccctccttcctctacccttaaatttttagaatcactgtgtacttatggatatattttttcttttttactattacttttttagcttgataattttgttttttctcagatttattaaggtataattggcaagtaacttgtacaatattatattttgatatctgtatacattgtgaaatgattaaatcacactaacacattcatcaactctcacatacttattttttgtggtgaaaagatttacagtctactcctttagcaatttcaagtatataatacattattattaactgtagtcaccatgctatacaatagatctctgggactccatcctgtctaactaaaccttgataccctttgaccatttttgatcatttcatttttttcttttctttctccccctttttttttttttttttttttttgaggcaggatctcactctgtccccagactggagtacagcggcaccatcttggctcactgcggccttaaccttaacattctggactcaggtgatcctcccacctcagccttctgggtagctgggactacaagcacataccaccactcttggaacaattttttgtattttttgtagagatgggattgttgtcatgttgcccaggctggtctcaaattcctgagctcaaccaatcaggctgccttaatctcccaaagtgtttgaattacagacatgagccactgaccctgaccatttcccaattcaatagtattataatccatttctgtaatttttcattttgatactcaaattgtgccagatgtgatcatcagcaggagcccttctgagttggcttgtttcttttcaacttgt

SEQ ID NO: 26669 - DNA, 1042 bp, Homo sapiens
agccagccatgaacctgtctatagcagcaccagctcctagttctgaactcaactgttttcgttcttctatgcatttagaacagagataaccattactttagtcaattacttaaaaaatttttattgagcatatattatgggctaaatacaatgttaggaaggccccaaggatatcaaagtgaacgaagcaggaaagaaccctgtccttaagcagtttacgtctcaatttttttttccctgcctaaactaagactttaagaactcagagactcttctagaaatccttaatcttctgatgatttttttttttttttggtgctttgctcaattctaaacaattgagatgaccaaatcaataggtaaggtatttatttatagtactctattatgtatcgttgtcattcattcattcaaaaaattacttctgatcatctactatggttagtatatgtagaaattgataaattagtaaaatatcttagggtttagggttctgctcatctagctaaaagcagatatgcaaataactacaatggcaaagtgtcaagagcaagggactagcaaatgattccattgttttggatgagggtgactgagagttatggtaataaccataacacccaatttcctggctgctcagacgagcagtttaaagactcactgctagtaatgtgtgcttttatttaatgggaatcccgtaagtactcacttgtaaaaagcagggtttcccagaatccattggcacaaactgttcaactccttgacatacacacagaacaattcagtcacagtgttaacactgtttgggataaactatgtgactgtgaattagggaggtcagaagaaagtatgtttttagacatcattggatgtatactttttattcgtcctatagcctatactttagaaccatactcattgaaactgtgaaaaatgaaaccacatcatgaaaaagttttcctgataatagcattatttgtgtatcttaacggtagctatggactctttatagctacttaggaaatagctcttgtcatgtttc

SEQ ID NO: 26670 - DNA, 1050 bp, Homo sapiens
tgcattgctgggcctgtgataggcaaacttttgtatataccacagcttcctccacttgtggttacctttctcctgtcctttcatgcaatggattgctactttgcaagacaatctgaaactgctgtaattcctccaataatgaacatctgcttcactaataacaaatctatatcccacacctgtttatatgctggcttagtatttaatgacttttattattaaagccaaatcacagtggtttttaaaaagtgactttaatgccaaatcatagtacttctttttaagtgtaaattttcaaaaccatttttaaatggcaattaaactcaatacatggtatatgactcaaaagtgatgtcatttatgtgattcaaaaatgatatcactcaactgagggaacaatatgaacagctatgacacaagttcatgcacacactgatattgaccaccacagtcgtgaatacttccttgtgggtagttattataagacgcaaatgattatggatgcacactgatttagagctgtgaaaatgtgtttgaaaagtcttagattctaattaatatggcaataaaacaatttataatggatattatcctcatcctagatgttagggtaacctaataaggtagagcaatggttctcaaagtgtagtcccaggacaagtaataccagcatcacctggtatattagacagggttctccagagatacagaatcaataagatatagatgtagatatcagatatagatatatgagggggattaagggaattggctcaacaattatagaggctgagaagtctatgacaggctgtctgcaagctggagacccaggatgctagtggcatggctcagttcaagttcaaggcctcagaaccagggaatatacatatatttgatgtatctattgaatatgcaagaggcctgaatttcataatggcaaaaataggccttggtctcttttgtaattgtcatccttagccatttctctttctttgttccctttgctttaaattatcctgttttcatagtccttccccattttccttttac

SEQ ID NO: 26671 - DNA, 1091 bp, Homo sapiens
ttactctgaaaattgggacacattgtctctgctttatcatttccaccattcttgaaactgaatttattcagcattccacaaagacgaattgtctttctttgctatagcactctactctctatcatcatctctgagtgtctccaggttctttaggtaaagatatataatctgaagatcaaaagatgacattaaagagagcaacattaaagaaagcaacatttactcaagaccagggagcccctggcacatagcatattgatgtggcagtttggatttaagaataaggatgcaaaacctagagtgaatgaatatggtatatactcaggcattggaaaagttagatggaaaggattccataccatacgagcgatggaatgtggatccagtggaataaacgtgacctgtgaggacacagtcagcaatttgttcataatacaagggtacattttgaagtcatgggctgcagaacttgaggagttagtacagagaaggatcatttaagacagatagatatatgctcccttccattcagggaaagtcatttgcataaggtgctttttggaggcttttttgatgaaaatggtaacttttttttttggcaagatctgttttgtttgtgtgtgtgtgtgtgtgtttttctgtttgtgtatgttttgaaaaacatgttatttaaattttctcctcaatgaagagagcagggaatggggaattgttatttaatggagtgagttacagtttgagaaaatgaaaaagttctgaaggtgagtggtgtcgatgattgtataacaatctgacatttatgagcaactctttcttcctcgtttatttcttaagttagtttttactgccaattattgaatttccctgttcatacaccatttctggtattcatctactcacaaatatatgccatcaaccgccaacagaggatacgtgatatggaagtatagatgaactcatataaatatatagccacctttagggaaattacacaagaaacctccctgctcaagtggatcagggttgtcatgtgggtatcatgtcaagtggatcagggtgtcatgtactgtttatagccacaccccctacat

SEQ ID NO: 26672 - DNA, 1035 bp, Homo sapiens
gtaagcaaaacacttttaagacccagtatttaaaattctcactattgatgtgtcaacatgcgtgtggataaataaaatcttagataaatgctttctacattaaagaacaatatcctttgcaatagtagtaaagattattcttaagaaatactgatgcttcatatcatattctatttaaaatattggtagaataatgaagtctcattaattcaggatttactaaatgagatattatgaatgtcattggctcagcatagcataaacattaggctacctaatgagaaacctgtttgccaagaaatttagtagcaaaaatgtcttcggatgacaatattaatttatgtaaggaaaagtcactttcaaggattctgatacatttatgcaagtaataacagctaataaacaacatatgatgtaataacaaataattacatacaacgtaataacaaattatatatgatgtcctatgcttttcgctttcctcatcctcataattgtttttgtaggtataatgagaggtaggaaacaactcagaaacagttgaaactatcatgagaaggtttttgtttgtttatttgtttgagacagggtctcactctgtcacccaggcaggagggccatggcatgaccacagctcactgcagcgtcaagctcctgggctcagttgatcctccacctcttaatagctgggactacaggcgtgtaccacctagcctggctagcttctaaaaaataatttatagaaacagggtctcactatgttgcccagactggtctcaaactccggggctcaagtaatcctcccaccttggcatcccaaaatgttaggattacaggcatgagccactgtgcccagccatactttcttattctctctttctgtctctccctctctccctccctctctccacctatccatctatcttggcagaacaaggtagaagtgctgccattaagcaggggaaaatatttacataaaatctaaagaaaattggtgtctatctcctcaaaagattaagctttagaatgtgtata

SEQ ID NO: 26673 - DNA, 1024 bp, Homo sapiens
ctaggttttcttctagggtttttatggttttaggtctgacgtttaagtctttaatccatcttgaattgatttttctataaggtgtaaggaagggatccagtttcagctttctacatatggctaaggaacaggcttttttagtccatagccacttttacactcaggcagtatacatattctattattgtacttatactgtgtattatttattttacaatatctttctcacctgttagtatatgagtactttgaggatagggtctatgtcttgagtctttaaatatgtgactctcaatataatacctggcatatgataataagtcatagacttaaaatgttgactaaaggacagaacacttgaatatagaatctgtgaatacttgtgcagaactcaatactttatttgatattgctgttcataaaaagattcattcttcaattaaaacatgctattttacttacctgtcagatggataagatcaaaccgtatggtagcacaatgagctacctagtatgtgggcatggggcactctcatacattgttatgtggagtatgaattgattcatttaatatttgcagggcaatgtggtaataactattaaaacttaaaaggtgtatctcttttgacccagcaatttcactaccagatttagttaacagatatacttgcatatgtatacaaagacacataaaataataaatttccttgcatgtgtgtatatacatatacataaagattttattgcaatgttatttgtagtagaaaaatacaggaaaaaatactcagcaatagatgataataattatggttcatccatgccatgtgatattatgcagtaatttaaaataataagatatgtctgtaagaactgatatggaataatgtgcaaaatataagaaaaatttgcaatatgcagaacaaagtatatattgtttgtgtaaaaggtgtgtatgtttgtatgtgtgtatgtacatatatacatacatatgggggaaggaggaggggatcaggaaaaagaagaa

SEQ ID NO: 26674 - DNA, 1046 bp, Homo sapiens
ctcagctgtttaccaaaactccattcccacacccaagctatcccaattttaaccacactggaacagaacagaatgttctatcctggatctgaatgttactcttagatattgggcaacctccctgtggaataaagggtcctttgctgagagtgttcatgtcacttcaggccatattgcaaaatcccctttgcccactcagcttctgtattacctttcttctcttttctcacttactaatattcccctcctcctttttgttaatatccttaacagtcaaaactagacatcagtgtataatttgattctcaaaatgagaaaaaaaatcacagaagtgaaccacatgtactataacagaatgtggtgttaggagaacctgcagttgattaacaaataatatggacaacatatttggagtaatttcttaaacctaacctttctgtttccagtctaaaatgccacctcagttctctgtcagttatgcaacattcaaaccaggaacctgttttgagcctgaattgatcagttgaatgtgagtgccattaacccaagttttggaaatggattaagtctaccatcccaagaaagtacttcttacaaaaccatatcttctttgaattaaatgttactcccaccaaataatctagttcatttttcagtgtctattgccctagtggacaaattcctgttttcttccctttttttcttgtctgttaacactatacccttatttcaatctgatcattttaaatctctcaagatattttttgcctccactcatcaatctgtttcccacttttgactagtcataaacgttattgtgttatgcgttacttcttctactagtttaaactgatgttggtggccttttcttgtatttaaactatgctctttaggaaaagattctgatccctttttaccttaaatagtctactcccgtccccatgttggcatcaatgtcctcctacttacttcagtcctatttggttgtgtgacgtgtttgttatcgcaaaataccaatgtgaatccataatctaaatttcaatccc

SEQ ID NO: 26675 - DNA, 1100 bp, Homo sapiens
taatattaatggcaaccactatgaaaactatacaaagagatacaaccaaaatataaataaataaagatggagtcctaaaaagtgttcaagtaaaccacaggacagaaagaagagagaaacagaggaccaagaagcaaaggaaaaaacagaaagcaaataataaaatgtcaaacttaaaggctaacatcaataattactttaagtgtaaatagcctaaataagccaatcaaaagaaaaaatgcattaaaaaaaaacccaactatatgctgcttacaagaaactcacttcaaaatcaataagaggtatgttgaaagtaaaaggatggaaaagaatatatcatgcaaacagtaatttaaaaaataaaggcaggggtagctatattaatatctgatgaagtagggagtaaagaaatttactagggacagagtaagacattatgtactgataagatattcaactcaccaggaagacctaatgatcctaaatgttcatgcaccagacaacagagcctcaaaatacatgaagcaaaaactgatagagcagaaaaaagaaatggataaatttacaattgcagttggggacctactctcagcaactgataggattattaaacaaaataagcaagaatatagaggatctgaacaatataatcaactaaaaggatctaattaatttatatagacctctactcaataacagtataacactattttttccaagtgcctatacagctattcacaaaggtagaccatatattggaccataacacaaaccttaatgcgtttgaaggaactgtaatcatatacaatattttctctgaccataatgaaatcaagtagaaattagtagtagaaaaacaacaggaaaattaaacaatatatctcttaaataatctatgaatcaaagaagaagtctcaaaggaaaaactagatgaaaattaaagcacaacatagtaaaatatgtgggatgaagctaaagcagtgctgagctggaaatttatagccttaaatgcttatatttgaaatgaaacaaagttctcaaataagtaagttcccgaccaagaagctagaaaagaatagataaaccaaaccacaagcaaa

SEQ ID NO: 26676 - DNA, 1046 bp, Homo sapiens
tgttcacagcatctttaccaagattccatctcaagaaaccactttctttgctcatccgtaagaagcaactcctcattcattaaaattttgttatgagattgtagcagttcagtcacattttcagcctccacttctaattctacttctcttgctatttccgtcacgcctgcagttacttcctccacttaagtgtttcttgaacccctcaaagttatccatgaggattagaattaacttcttccaaattcctgtgaatgttgatattttgagctcctcttatgaatcacaaatgttcttaatggcatcgaaatggcaaatcctttccagatttattttctttggattcaccagaggactcactattgatggcagccatagcctttcaaaatgtatttcttaaataatacgttttctttgtgagcatatagattttaaaaattttattgaagtatagtttatatccagaaatgtatgcctgttgtaaatgtatagatcaatggatttctacaaattgagtatacctcaatttgaacatgtatcagtctgctttgtgcttacttcaagtcattaaccttccctttgaacctccactcctcgaagctaatgactagcctgacttctaagagcattgatttgttttacatgttttcatgctttatgtaaatagatgaaattgtataatttgtaaacttctggactggcttattttgctcaatatttatcttgagattctgtgaatgggtaaatacattatattatgtctgggtacttttgagtttggaactattatgagtagtgcttctatgaacattatagtgaatatgtatccatttggtgaatatatctacatatttctgttggatatagtatacctaagaataaaattgctgggtcttagaggatacatatgcttagcttagtagacattggcaatttccaaaatggctgtaccactttatacttccaccggcgtatacaagttttggttgctgcacatcttcatgaaacacatattttctgtcatttttactttaaccattctggtg

SEQ ID NO: 26677 - DNA, 1040 bp, Homo sapiens
atacagcatctaagatcttcatactaaggtatgaagatagtcttggtgacactgttcagctggatcaagccaaaccctgtcactggaattttccattacaccaactagtaaatacctgtaattgctcaagccttttaaatttgagtttcagttacttgcaaccaaaaacaattctaactgaaacaagacttaaaaataactgcaaaccattgtgtttgcaaatatttggaaaccatcatttttgagaagaatgacatgctatttcaatgattgacagaggaagatcttagagttggatgttgggtcatggaggtagagaagaatgaacagtaaaatataagaaaagttgtctaagaatgcctctgtcaaaattattcttggcagacaaatgcatatttataggaaaattcatcatcctacaggattttattatttaaaaatataatttgaaaatgagtgaaacattaaattctagacaattgggaggaaaaaaaatcctgaaacaaagtaataccaataaacagaacttaggtagattagtattctgtactaagagaaaaaatgggaacaaataaaaatttgtgttaaggaaaatgttacttgatagtgaaccaaattttgacaaaaggcaaaggaggatttataaatgagctcagctttgtggccttggatagcctggaaaagaaaagtaggtataaaattaaacttgctatgttgagacacagcaaacattttcatctttttatctagaactaaaattcacctgtttgtgaaacttgtgctgcagctttgtaatacagcatagcagttctatgtggtattttatggtaactgaagaatttgatatggggggataagacccaggcagaagagtaggtctcactttttatcacctcaactgctttatctcactcatggaatcaaggttagtgaattggaatattttttcggctagaactttctgaccagtgcaaagttatctttgattcagcgtgaattttgagctcttgaacacttactgtttttctcccctccgaaaa

SEQ ID NO: 26678 - DNA, 1047 bp, Homo sapiens
atgggcacatttggggaaacaaaaactgaaaattgaaaaatctggtcaaatattcaattgtgcctaaataaaattataaccaagtatctgattgaatatatatacacctatacatacatacatttatacatatatatacacacatatacatgtacatacacacactttttctctggatactttgtctctgtataataaggactatattaaaaagtgatatactctgagaaatgtgaaataatgggttgtgcagattttaaagaagctataaattaaccttgaaaaatattttatataacattgttattttcaccccaaagcagaggaatttcgaatgaataaaacatttcttgttgaaggtaatgtcagcaaaatcacttcaattcagcatggttcatttactcatgcaacaaaaattaattgcataatgtgtattcggttaggtcttgactattttctctaagcatatcttattttaattctaggatgctttgatttagtgtggaatgtgatgattattataaaatgtatacttggccatttaagttggttatttaaatcattagcctgaagatcatgcataccctggaatctcacagggtggctagaatgtggatttgtaagcttttgaaaatgaggtggtgggttgcttgacatctggatttgctttctgacttggtagactaaggcaagatgcctagaatagtgccctttcctttcctaaaacctaataattatttttgaaagttccacaaaacttgcttttatctaaattccacttttgaaaggtttatatacattaactttttttacatgcaaatactgaccctggaagtgttaagctcctttcagtcatttatactgtagtctgatgcattttaatctgattgctttccttctaaatcctagaagagctgtagtgagactgcattttaaaaggagaagtgaatctgttgtagcacgtagggaacttcaaggaatatcctggaatggatgcctagtgtcctggggaaccaaggtgggaggagggggagagggcgtggtagg

SEQ ID NO: 26679 - DNA, 1026 bp, Homo sapiens
ttttaaaataagttcttacataaattaaaagaaatgatgaaagttcaagcaaactgttttagaatttgtcaggactttaaatttgatgtaagaaaaaatagggaaaccaattttaaatactgaaaaaagtcacgtgaagagactacacattaaataaaacaataagctctggctcaaggacagatagatcactgaaaaaaagtaaccaagaattagatcatttaattatgtaacagatgagattttacctaaaacatacagaaaagaagtattatgcaataaatgactgagataactagttaccaatatggaaaaggtcacttaaaatcatgccttatttcgtacatcaacataattacaagtgaattcaagagttaacatttttaaaagtcactacttaagaaaattagaataatttgagtacatgatgcagagatagagagttaggatatactatgctaaaaagcaacaacaacacaaaaaattacaggaaacaacgcatttgaccagatacaaaaattgaagcctcaatatgccttcctaaaggaaccatgtacatgtagcaagttgaaacaacaggctagataaaatggtttgtataatactatgaataatgattagtatatatcacatataattctgaataggcttataaaaatatcaaaatagttaaagaacatgttagaaattcgaagttattaagctgcatgtaaaaatatttatctttgcctttaaaaatgtaagaaatatatattaaaatgaggtgcaacattcttgccctcaaaatttgcaaatctaaaaaccgtaatgccaaatacctggaggagtattatgagaagggcactttcctatattgctgatggcattgtaaattgatataacctttttgggaagcaatttggcaatgtgttacaagaatcataaaaatgttcatactcttttaacctagtaattctacttctgggaatctatcctaaggaaataatccaaaatattttttaaatgctatatgcctgacagtgttta

SEQ ID NO: 26680 - DNA, 1050 bp, Homo sapiens
aacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttaggtaagtaatgctacatcgcaggtggctctagggctgtcaggaacaatagtttctcccttcatccttaatttggggattctgccactaagctacagcagagcaatcaagagtgcttaaagtttaacttcaggcatactgagggagcctttttgttttctgttttctgaaactttgtgcacaaactcttatcaactcctgaaaatacattttacaaaatcttaactattcaaacacataagtgacatagtactggaaaaactttggaaacgttatgcaatctctagctgtttctgtaggctgttgcacagccctctaaataggaaacgttgtgcttagttctttcaactgattacaggcaagggcagtgtttcagtgctgtgaatactacacctttctggagtgaagtgtcgggagataaatttgaacttgatagctactttactagagtgcacattttacagctcgctcaggaatatcagaccagcagttaaagaaacaacagggtgataggaaaaattttacactgtggtggaatctgtgaccaggcaaaatgtagatacagtataatggattgagctaaagtttaattttggagggaggtacaccctttctttaagaaagcagctgtttcttcattgactctttaattctggattctttagttacctattatgtactttagaatttaaaataaaaaataatttaaaagtatctagaaattgaaccctatttttgcccctcaaaacagaagatttttaagaaagtcagttatatatcagttttgtcttt

SEQ ID NO: 26681 - DNA, 1055 bp, Homo sapiens
tgaaagaggagtagatagtttatacttccattttataatttttgttgggaaacattactattatataatccccatcaagtggtaccataccataacaagtcattctccctctacttgtatgtatccagtaatactcattgtctacaggcatactctagcctgcctttggccaggtttaactttagctagtttttttgtttcagttggaatttgttgctatgtccattttagtgtctactttttattattgatgccgttcagcgtctaagtaagcataagatgattctttatcctactacttacctttgttgcttttcctgaactccttccttcttgaatttgtaaactgaagggaaacactaagcttatataaataattttcagatgcttttattgaaacaacaaaaaaatatatgtagcatagagcgtctggatttcatgaattgtgtttcctacttgccagattgtaatttccaagcatgctcttatctcattaacacaaagaggtctgtgcctgacctaggatctttcttttttttttagaaacttgtggtggagaatgttgatgtgttaacacaaatgaggaccagctttgacaaaccagaccagatggctgcactgtttaaaagattatcatgtgggtaactcatgatactttttataaacataagaagatcttgatactcagtatttagctttggctcaaaatttgtaacataaatacaagtagtaaattatgaaaagtactctttagcttatgaagagaactagaacatttttgcagtcaaaggatcatataagtgtgtgtgtggcttatctgtttcacaatttttcttaaccatactcttagtctactatgtgtcgctagttcatgaatattaccagtatcaatttggttttgaacccattaaatttaatacagtaaatctacattaatttagactaaaaggattagcttctgagcctgttaactttctaaaaatcaactttatacgtataagttacatacaataaaatgtaccatttaagcaaacggtattttggattttgacaga

SEQ ID NO: 26682 - DNA, 1024 bp, Homo sapiens
ccaagaatgagtttcagataaggtgtgatgagtgagagtacatttatctattctggatactgtacttactgacacagtttaagatagcatgaacacatttggtagctatgccatactgttttcacaatcaacttgcaatcagatgaattgtctctttttttcacttatgctaaccttaaaccatggctttccacatcttatattttgtgaaatttttagacctgagtgtatgctttgtagtttttcttagtagagtttatcttgttaggtattgtccattattctagggtctttttttgagtacagattttatcctagtcttttaacaattattttataaacttaactattttagccttgtctgtaagtatgaatgttatcaaatatattctcattcttgagaagaaatggaaggtgcttatgttttaacatttctctcttatattttggagtggctgtattctcgctcagatattaaaatttaaagttaggggaatgcggaacgactgtaaacaatgttgactttttaaatatccttaaccaagatggttaaggatgttaaaacattttttcttgaaaacttttgatgttagctttctagtaatctcctatgtgattcttttcttacttgacttttcattttaccttcataataacttccatattttattaatgatttaatattgtagtaatattttttggtatttgtttttacttttttgcttctcaaatactaaatcctgacttatttaaggattatgtttttcagaaggcttcctatgaaatatttatatttttaatattgtgccttcatcatttagttcttcaaaacaaggttaattgtaaggattccattttctggaattgtataatgttttatagtgattttgtttgagttctctcctaataatccagattgtttagtattcaactacttgtgtattattaagaacttgagaaggtgtttatttgtgactttgttttctcagcctctgtgtactgaggcatacttcatacgtattct

SEQ ID NO: 26683 - DNA, 1028 bp, Homo sapiens
ctctatgacgtgtttcttcacacaagatttacccaagatctacccgtttctgttttcaccaagctatgtgcattacccaagctagctaagtaagctctgtatctcacttatatttctgtcttttaatattgttgtgatatttgcaacacagcctggattcagctactgtttgcttgaatagttagtatgctttcagagtaattggtgtaatgtaagatttcattcttttctaaatttagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaagtaagtatccacttatattatacctttttgctccaggtaaaatatttatttcatttttttctattgacattagtactgaggaaatgctaataattgtatattcttcattttccagccattttaaaaaatatttctgagcttaattaacctgttagttgcttatttcatctcaaaatacagattttggcctttagaagaaaatatatgtaatagttgatatttgtctttttatactaagtactgaaggccaattatatgtttaaaaaattttgtgtgttacattataagcaatctgtaatttttaatttatttaaagttagatagtggagactttattttggcatgtttttgatatattagaacatacccaatgtcattattataaaacagaaataacagaccaggtagcattcagggatctttgcttgcttcattgtttggaggggaggtgtaggtgggtaataattcggtaaatattttttgtttaaagtatagttcctactttcttgctaaattgagcaagccattgcccttttatagacaactttccttctctcataacagaaagtacttcaggaattgggcgtgattatctttatgagtgcagaataagctctacctttgtatattaagtcagtatattcattac

SEQ ID NO: 26684 - DNA, 1049 bp, Homo sapiens
actcctggcctcggtgatcttctcacctcagcctcccaaagtgctgggattacaggcatgagccacagtgcctggcctgttttgctgttaaaaataaataaataaaatttctatttgtttaattaaaaagagaaaatataagaagtatttttttgtggaagccatttttagatggatacagtctcaggaatgactctcaggatgaccatacttttctggcggtctgcttagtactctgaggtgcttttgcttttcttaggttctttccttccaacctcaaaatgcataagcacttttctcttttttgttctatattctctagggagcttatttttagaaatgaagacttttataaataaaagcattaaataccttaccagttagtgggagatcagggaagtacacttgaaataccaacatcccaaaatgttaaatgtgtatatattataggttattttcttattacaaataaagttttaaaattgacacctctttgtttttaaaaaggcaatgaaacaatacaaaagtagaacttgtaaaaaaaagaagtggaatttcctctgccaaaggatatacatgtttaaaactttgaaagtcattgtcataaagcttgaactgcttcaatctcctgttctgggtttataggagtgcctaaaccaatacttgggctcagagaattttagagatttagatgcatttcagatgcacccttacatttgagttattcatgtgagaattttagcctttttcagtcactgcaaaataaaaagcattgagtgaacatgaagaatgtagacctgattattcctatgtgtagatttttaaagttttttaagatttttataagagcattattagctagctatctgatttttttttcatgtaatctatacctacttgtgttagtttcctagggctgccataacaaagtaccaactagatggcttaaacaatagaaatgtattatttcatagttctgaaggctggcagtctgaaagcaaggtgttggcagggttggtttgtttcaaggactgcaagggagaacctct

SEQ ID NO: 26685 - DNA, 2006 bp, Homo sapiens
actttaggaactaaaatgtagcattttttgtagttgaagcaagagagttgtagacacttttgttcttcattgttgtagttgacctctttcacccaggctttatggaatttattttcactaaaatggggaacgtgattgcatagagatattgagaggattgtgtgagagacctgtaaaatgtttggaacaatcgatgcctgacacataatgtatgctcagtaaatatcagctcttattagaaatactatgggtaataatggggaatattaaagttttattatatttattttgaagaagtgatctgcaagcttcctttgttattcacttaatatttaatgtacagcttctggctgtgaggcattgctacatattcttatgtacattatcttggttaattgtccatgtcagcttccatttcgatgaggagggtattaggctagagatgttaagtcatttaaccatggttgcataataaggtatgctttctagcatcacctaccaaaacatatcatctgacactggtagtctttgaagtttgtcattataatcccttatctgatagatgtttgcattggatacttcctttgtccagaactgtatgatatggactggggaaattaaaacttgagtttggtacactgtctaattgtgctggagatagctataatagaagatagaaagtgatagctgctgttagacattatacatgtttagaggagggagatgttagcatttcagggaaggagtgcaatcaggtgcggttttctgaaaatgggattagcatttaaactaagtgctttaggaatagtggggttgggacatgtttaaatggtgggattctgacattccagtagaggaacagtaagaaagcaggaggtgtgtatagaaaatagtgaatagattgttttggctaccgtatgtagtgtgtgaatacatgtaggggaaatgtagattggaaaagtaagttagggccagattgtggagggccttgaaagctagactgttttgaatttaggcatctagtagttgtttgataaatgtttgtagctaagtagagtctagttatatatggctttgggggaaataaagttgaatgagaaatgtagcctatgagattgtattaaaaagggagatgatgggcatgtagaatggtagaaagaacactttcagaagtaaagagatgagatttccaatcttggctctgtcattaagtagttgtaactttaagaaggttcttttaaggtctgtaggtcttaggttcttaatatggaaaatgaggtttgtatttaagaccatttaaggctcatagtaagatggtgaccgtattatttattgttcagactaggacactgaagttggaaggaaaggggacacaattagtaaaattatactagggcaactaaaataaattgggattattaagcccaatataaaccaaattatacccttcatatcttactattatgaatgtactttcacctgttgtattttgaaactcaagtttaaagtactgaaaagcaggaaaaaggactaagacatcaattctaaatgtttaatgttgtcgaataaggtaataagtattcactttatgtttttggagtagtaatgattaaaatgtgcatataaacatggaatcgttctgaaacagataatgttgtgcaaaatagagtcagctactctcagatgaagctaaaaatagtcactacaagtatatatcttaatttgtctggtatttaggggtagtaatgaaatatttcatttgtgaatattttcttttttctttttttttttttgagatggagtctcatctctgtcacccaggctggagtgcagtggctcgatctaagcttactgcagcctcctcctccctagttcaagcgattctcctgtctcagcctcctgagtagctgggattacaggcatgcgccaccatgcccagctaatttttgtatttttagtagagacagggtttcaccatgttggtcaggctggtctcgaactgctga

SEQ ID NO: 26686 - DNA, 1033 bp, Homo sapiens
ttggttctcctatgaccaaacttgttgagtccggttaggcaaaattgtaacaagtatattttctaacacactgtacgttaaaaggaactctcatcaggagcaaatgataattgatagagaaataaaaactcttaagtatagcaggcaaggaccatttaatgtcagattatcttgtacaagtcagtagcatctgaggccatcttgacataaataaatctgtataattatcaattacaatgatgacatctaatcagtaagaaaagcttgatttatgcctggtctactggttttgaaagtaagttaatcacatattagaaaggttttaaaaaattattaaaattgaatgtaaaggaactaacctatttatatttctatttgtaatggaaaatagtgccattaagtgaggtaaattgtgttatcattaatgcaatgtgataccctttatacaaaaatgttacacttgaccaaccccactataccacggtatataattagtgatttttgtagtactgatgataaaattaatttcaaagtttgctttaatttgaccatctatagccagaatcttaaatttccaaaagttttagctgaggcacattaatgtgctcaggtggtgaaatagaaattattttaatctatattgctgaacttgatattaattgtgtcagttacctattgctgcataacaggtcacctctaaatttcatggcttaaaacgacagcagcttgtttcttatgattctgtgggttgactgggtagtttctctgctggtctcactggttttaggttaccgcagtgcattccactggtgcattctgggggatgggcccagctggaacagcagggatgctgaagtgccctttctctatgtgatacgatatctcaggcttcctcacatacagcacgtcagggcagtgttccaaaagagcaaaatcagaagttacaagaccttgccctggacttagaagtgactcgttgtttctgctgctttctgttggtcaaagcaagtcacaaggccagccaagatgggaa

SEQ ID NO: 26687 - DNA, 1039 bp, Homo sapiens
tttcttagtatactgaagaatggtcatgttcagaatcttcctgatatgtttacatatctttatagtaatttctatgaataactacttttgggaaattagagttattttttgcctcagtgtggcatttttatataaattttgactcagaatctttctgcctgtcttctctttttatttttttctctgatattttcttgttactatctttgctgcctcttttgctttacatacaaatttagtttagaaatttcctctcacatatgatcttcataattttgagaagctctgttgaaaagatatatcgtcagctggtccaaaaatagtgagttatctcaattgattgttctgcgtcagttacagatccagctccttgttctactctttgcccccttctcactactgcacttgactggtttaaaaataaaaagatacattgtcacctttttgttttctcaaatcatgtatgttcattgaagatttgtatttagcctgttgatacttttgcttaaaaacgcttccatgtagaaagaaaatgctagtaagaactaatacaaataagtcagataaagtgctttttaaggcatttttttaaacaaaatcaagtctgtttttggggagtacaggttagtagaggtttcataaaagattgtttttgtagagacgagatctcactatgttgtccaggctggtcttgaactcctgggctcaagggatccttctgcttcgacctcttaaagtgctggaattacagacatgagctgctgtgcgcagccagaaatattgttttataatatatcaatatattaaagcattataattagttcctgattgcaaaataggtgattcaaaacttgcacttcttaacacttttgtttgtgtggagaactcttttttagttactgacattaattggctacctcatctgagagattatatactcactctaaaagagagattttgttatgaaaatctgtcttaaattaattttatatacacttctttttcttacagctcataaaatttctgacatgagctcttc

SEQ ID NO: 26688 - DNA, 1043 bp, Homo sapiens
ttcttttgaactagggctcttgtattaaaatgtttaaagtgaatgaggaaaacattttggaaaagacatttaaacataagcttttattttataacacttagaaagaaacatgtctagtactctactgaatatttaattttgtaatattttattagcttcagatgaatacaatcctacctcaaaccaagaattttttttctttttcttttttttaggtttgagctttttccttcactgctgttctgcgctaactgcttcgaaactttccatgcatttttttcagtagaagaacatctctgtactgtctcccattgcatatttcagctgtgacaatccctgcactttgcctattcattttatcacctgctcaccaaaaacaataaatatctctttaatttctaattgcagatttgctatttttgattttagaagaagggtgcatttcacttttttttattactgttgttttataggcatgtggagaccccaaggcaaaaccatcctatcttatcgacaaaaacctggaatctgctgtgaaattcatagtcagaaaattccctgctgtagaaacccgcaacaacaatgtaagttatctaaatttttctattgcttaattttaagcatcttttagagaaacagtggtcaacacagtgcttatagtagctcttatttacctaatttttaacattttgatatacagattatataccttaagggtttttttgagacaatattcttatgtccgagaccggaaaaaaataactcttaacgacattgccactttattacagcaaagatcttagattactatatatttattccctttcaaattgcaacaagagtaaggtaatagatatgtatatattccaaattcttgtgtggatacttgggatatttttgtttcttatagtcataaacttcctgttgaagttagtaaatgtctgcatagagcttctgttgttttaagtagttagctgtatttagttttaaaatgtgtttgtttttctagtattttcataattgacaatgatttctaaagatta

SEQ ID NO: 26689 - DNA, 1760 bp, Homo sapiens
cttgaattcctgatctcaagtgatcttctccctcagcttcccaagtagctaggagtacagttgtgcaccaccacacccttataatttttttttctcttaaagccctgagcttacttctctacaagctaatttaaaacatttttttgtagagacagggtcatgctatgttgtccaggctggtctccaacttctggctcaagccccttagcccccatttctggaattacaggcgtgagccactggacttggacaaaatgaaattctgttctttctgttttcagtgtaagaaggaagagctgctcatttatatatgtgtatgtgtgtatacacacatacgcacacacatacttgtttggttatcaaccaacgaagttgtttatatgtttacattcttaaacagtaaaatttgtggttgtgggaaatggatatggtgatctgtcattttcattatatgtgatagtccctaatagaggaatggatagctaaatttttcaatagttagaatatgaaagacaacacatatgaaaaaactgaacataatttggaatcactttaggattttgcactacctcaagcatgtttatgacacttgatttttattatgtgattatgtaaggcaatgctaatctatagctatttgtgtttgggcaaatttttagtatgtgattattattcttagctattatatttggggagaagaatataaattggaagattttaagaatattttaaagaaatgatagtctactcaaagaaagttggatatattttaatatttatgatgttgaaatggaatttacatagtagtaatgtcagtctggctaaagattatgaagttctaaatttcttaagattttgttttatttaattatatttgagaattaagagatttcttactgcattcctatttccatttggaaaatataggaatgttaacattgatttttatactttggcatggtaggaagttaggtgatgtttgaaaaatagttacaatttgagctgaaatacaaaagtcatccaataacaatttatttttattctcggctaccgtttctttttaaggtatgtaaaatttcactgatggttttgctcctgtttttatagctgcatgtagtctttattttccttctttctagtattattttaagttggtttagaaagagcaccaagaaactgacctgattgtacacgtacacagtagtgtttatatgaacagtataaactctataaatttattttatactaaaactcgctacttagaatacctttaaaattgtagcaccatataattctaatcttgttctgttattcatagtctgcagtgcataagttttcttctgaaacgtatatcatagtttgacaatcattgtttacacgtaattttctctctttttattacaatgcttccccagcaaggacaagtttggaaggtttgcaaagcttttcaccttccctctgcccgcttgcccgctttcagatcagtttcatgtttcataacttctctttctgcaatccacaacatagccatagtaaacaatggaaaactataaaattgcagtagtgtatttcctcacacatggcagacagatgtaactttccaaaggacacatccttttcaaaatgcaataaaaagaagttaaatagaaatgttataattttagtaattccctaaggaataacatctcgctagcaagcagttaatttaatgtcacgtaataaaacaggaacagtattcaagattatattctgtattgtaa

SEQ ID NO: 26690 - DNA, 1064 bp, Homo sapiens
tgtcctcaagtgatcctcccacctgagcctcccaaagtgccaggattacagttgtgagccaccatgcccaatcagccttcttacctgaattatttgttatggttctttgccaggatatattttacctagctgataacttttagtcatgtcagtttatttttttcatagacttcttcttttttgcctaagtattccccatacaagtgtctctcttgttattaagcaaataaatcaagtaagtggattttagaaaaaagataagatggggcctagtacttctgtatgtattaacctcttatttttaattggcattttttgggagctcttggtatgccaaatactctcgtaaagtctacaggtaacactttcatgtagtgaacataaaaactttttagcataggttgtaattattatctgtttaacagttgaagaaactgaggcacagatagaatgacttgctcatgggtacacagctaagtgatggtgccaagattttaaacatggacagcctgtcttgaaactcaggttcttaacaattaggttaaactctgtacagttacagcaaatgtagactttaggctgtatttaggctgtatttagatgtttaggcttaaagtgaataaaggaaatatttgattgagagaggggattgtatttaatagttgcataaggaagttaacactaacttgctagttgtatatatatattatgataaagactgttactatgattactattcatattagacttggataattattatcatcattatagctattattaaaaagcagctagcatttttagagcacttatgtgcttatcattttgctaaatgctttacatggtttctttatctctcttctaatccttataataaccctgtgaggtaagtactaatttccccattttacagacgaagaaacataggttaggagatattttgtaatatattccaggtcccatggctagtaagtcatgaaaattgaaactcagccagttttattccagaatatttgtttttaacctttgagacatactgcctcccaattaagtatgttagataa

SEQ ID NO: 26691 - DNA, 1033 bp, Homo sapiens
cagtcagcagaagctggcggagaagctcaccatcctcaacgaccggggcgtcggcatgctcacccgcctctacaacatcaagaaggtgcgcacgggccggggaggccgcggcggaggcgggcgggcccgggagggatgaagggcaagggaggccgtggggtgggggcggcaggaggcgccgggtgtagaaatctcggcgtcgccgcccgaggcccggcccggggtcgcctggatgcgccgcggcctaatgcggagtcccgggcgcctctccctgtggttcgccggccggccgaaggcagagaagccatttcccggctcccggcggcgggatcgggcgctgggcctcgcacggggtgggggcgccgctgggagccgggagctgtcccctcctcggcgcccccgcccccatgatggggcccataggaaagggagggtggtgggtgggcgaaattctaggtgggtaggaaaacttgagtgttccatattcttacggagatggcagcagtgaacagggattacaccccacatccccattttttggtgtgggaatgtgggtagagaagggctgattggatgaatcccgtatcccctccactttgccactttattttagattgctaaataaaaagccattgagagtgtgttgacgatttgggattatttcattttgaaggtggagaggagggggaagtgagggtggaaccaattttctgaaatacttctaggctgtgagtcactagaactggaataacaaccttctactctttcccctgtactcctcctcatgttagattttccaataccatttcttaaagttcggtgtctgtacaaaataaaaaccgtaaaaatgttgcaattgctgctgatttatagcatagtctgataatttgagcaactatagctaataggcccatttaaaggcttttacatgtcctcagtacagtaaggagtggaagaccactggaagtttagaaaagtccatgtaaagatagaacaaataattacattcattatcgtaggacaaaacaacaaa

SEQ ID NO: 26692 - DNA, 1057 bp, Homo sapiens
gtgaaatcctccagcacctacttttgggtgagattggaaataaactaatggagataagactattccgccaattcagaagtagtgaatgtaaaacccactcctgttatatgaagataaacacacacacactcacacacacacacacacacacacaattttgattcacagaaaagaatcagatttgctatttttatttttataacatgcttattaattttacttgctgataaaatatccataatcaatgtttagacttaaaatgttttagtagatgccaaagtctttttgaaactaaattgccctgggattgacatatagtttcctaaatctttcagaatcacaaaacaaaataaaaaatgatcaaatgataagcaatgctttataaagtagtaaatatatttgtgagtgtgtttcgttttgttttgcttaatgctgacatataagtgataatattactctaaagcaaagctttttaatggacatttcaattatgacttatatcttaattttatggaccattgagaaaacatttgacaaaaagtaacatttttaataacatgtattataaatgacaatctgggggattcttacctttacttatatcaaagagcttagataaagcatcaaattcttttgttacaaattatttcagaattgattcttttaaaacacatactacaaaaataatcatatattttgggagaatctttgaatatagaactttaagacttttaagaggttctttgttctatatccctatgctacatcaaactactcctgccaggtgacaagttagtctactttagcaccagagaaatcaattcatagtcttcccacaccataatcaattgcacttattaattctccagaactatgtctttctgtgtaatctaaatatgtttcattgaacccaaattggccttaacataagagaagaaatatatatgttttttctgagtactaaaactaattacagacattaataatgctgtgaagtcgtcttttaagaatttgtgccactgtagaatgattttaattctcaaatgaaatgtgcact

SEQ ID NO: 26693 - DNA, 1089 bp, Homo sapiens
tttatgttattgaggttccaaaattatatctttttacattctgtatccattagcataaatttattatctgtttcatgcatttgtcttttaaatcctttagaaaataaaaagtggatatatgagctaaattatgataatactattttttatatttgttaatgtatttacatttgttaaaatttacataatttcatatggctctgagttactgtctagcatcatttcatttttctttttaacttgaagaactttctttagcatttcttgtcaggtagatctagtgttaatgaactccctcagcctttccttgtcttggaatgtcttaatttcgcctcatttttgaagaacattttttgctggatgtagaattcttgtttgacagtatttgtttttctttcagtcctttaaatatatcatctcactgcctcttggcttgtaaggttactaatgagaaaatcactaataatattatgagggttatttgtacatgatgaatcactttccttcttctactttaaagattatctttgtcttctgacagtttgattattatgtgtcttgatatgatatttttgtgttcattctgcttgaagtttgtcaagcttcttttatttgtgtatgtatttcttcaaatttaggaagtttcagcccttgtttcctcaaataatctatctgtttctttctcaatttcttcttctggaatttacataaggtgtatattgttctgcctgatggtgtttcaaaaatcccttaggcattgcttacttttttttcaatcttttttccttttggtctttagacttggcaacttcaaatgacttgcattcaagttcactgattgtttcttctgtctctccaagtttgctattgaacttctccaatgaatttttcaattcagttgttatatttttcagctccagaattaatttttaatttttatgagcacataatacttgcacatttgtatgggttacatgtgatgttttgatacaggcatgcaagtgtgattatcaagtcagggtaattggggtatccatcacctcaagcatttattactttttgtgttgtgtgttaaggatagtccaattc

SEQ ID NO: 26694 - DNA, 1098 bp, Homo sapiens
gacaaacccacagccaatctcaaggggattatatagagatattaatagaaaataatataaaatattagaaaacaatggatctagaaacccaagtgggaattataaataaatattttaagatattctggcagtattgagctatgtgagttaatgagttttacagaataacttaaaaatgatgaattaacctccaggctgatttaagctgatccattacacaaaggaaaatatgaggtaacctcaggtgcctgtttaccaaaggcttttagaaaacaatgtaataaagatcatcttagtcattctaaagtaagaataaatgtcataaaaaagagaaagtgagaaatgtgaattatgagaagaaattatacttttatttatgaaattctaatttagcttggaattaatacttcttttacttagataaagaacactacataatgcttatgatgtgtaagagaaaacaaggtaggaatgtatttaaaatttttattattttatccttatgctacaaaaaattagaaggctttaaataatacatcttgtctggaaaagcatttatattttggataaacttagtgttctggaaaccatgtaaaatgtctaggtacttaatgtttataaaatcttagagaagtcaaacttgtgtatataataataatatacaccaatatatttatacatctatatccgtctacttacctgtctctgtgcctctatatctgtatctatgccctcaaagagacaagataggatgtaaacattatttgaataaaatttataatgcacagaagcatttatttaaaattgtcatatttcaataataggcagaattattttcaaaatattaactggacaaaggatttcttaatattctcactgagtttgtcatggttctccagagaaaaagaaccaacaggatatctatctatctatcatctgtctatctattgagagataaaaatatatttattatgaagaattggctcacatgattatgcaggccaaaaagtcccttcatctgttgtctataacctggaagcccagagaaatcagtggtttaattccagttcatgctcaaaggcttgagaatcaaggaag

SEQ ID NO: 26695 - DNA, 1037 bp, Homo sapiens
tcctttttctctgggtttaaatttgagaaggctatagcttatctcttaacttttcacttgggtcttagtctactcaggtttccataacaaagtaacatcgactgagtggtctaaacaacagaaatattattttctcacaattctggaggctgaaagtccaacatcaaaccaatttggtttctggagaggggtcatttcttggcttgcagttggcttccttctcacttatctttcctcagttcttacctcagtgtgaaaccacctcacctcaggattttataaaatcaattaagaaaaaaaaatccagctaatcacagcagcaatcattatgccaacttgccttctggctcacttacttgtagagtcactactccagtataatgtggcccttgtcacaagactcttttcattttctattctataaagtctaagacattgtgagatgataagtcttctattggagcttctttcctaagttcttcatactaagaaaactacagatgccagctggtctggagggcctagtaagaacctgactcataaagaaatgcagttgctgtttcttgatgatttcatgtcccttatcctaagcaatcgatgacctcaaattttccagcccctcactctccacaaatccccatgaaaacccttgcccagagccccttgacagaacagatttgaggcttgagaattcctcccatttcctcattgggtgacttgtgattattaaaccctttctctactgcaaccctgctgtcagtgtattggtctgttgctgtgcagtgggcatagaaaactggcagtcctgtaacaagcagttgtgcagctgagggtggaagtaggggtggtaggagaagagaagaattttaaaaaaagaaaaagaatgctttctctggtgtctcctaatcctactggattaaggccacactcttgtgacttcatttaacaataattacttccttagaggccatatctccaaattcaaccacactgcggattagggcttcaacatatgaatttgtagagattctctgccc

SEQ ID NO: 26696 - DNA, 1050 bp, Homo sapiens
ttttctttgtattttcctacatacgtaatacaggtcagtggttttcaaccctggttaagcatctcagtgatctatgaagctttaaaacgtatggtgagagaggccagcatccttacccattcatactgagtttcaaactgagtctgaatctcctggggtggcctctcattttcattttgaaaaatcttcacagacgatagtgggactgaattaattaacactctttaggttataaataaaaaacttatcatgcactaccttgtaaaagatgaaattattttaagcataaaaaggtctcttatagaaacagagtagggatgtggccagagtccattgaaggtgctccatagagggcttctcttgcagtctcctttctggtcccctttctgtctttgcaagccagcttcagtcttctctacctttaaatgtaagcatcctatctttctcagcttccgggtttacgtggtctcatcacaataaagcagtcagacttactcttgaatcctttactgtctcccaggctagagtgtaatggcgcaatctcggctcactgcaacctctgcctcctgagttcaggcgattctcctgcctcagcttgctgagtacctgggattacaggtgcccacgaccacgcccagctaatttttgtatttttagtagacacagggtttcactttgttggccaggcttgtctcaaactcttgacctcaagtaatccacccacctcagcctcccagagtgctgggattacaccgtgcctggcctgaatcccttagttctgactgtaagttacttaggggaagagctcatttgctgagtttggatcaggtatcaaatcttagcatataaccatattttacaattattactgctcctaccatgggtggtatgagggcaaaggggctggattggtgtgaagaagctgggaagacaaatctacaatgtcctttataaaggcatggctatgattcagaatcactggataatttggttaaacaacaaacatttactgagctcatagcaggtgtcctactcggcagggaataaaaa

SEQ ID NO: 26697 - DNA, 1040 bp, Homo sapiens
attgtgagtgtgaggtatgggatacatttattgagttgctgtttaaaatagaatgatcagaatagacccaccttgaaggtgatattcagcttgtatcagatacttcaatattttagaacaagtcagtagtaaaaggttgactggttcatcttgcaggcaaatttaccatggaaaggtgagcattataataacttttaagtatatgagaacgtttacatttgtgcacacacactagtgtataattatctcatagatattatcttagaaggttgtcgttgttagctcatttacatgtgaaatatcagactcagagaggttaagtgacttgtctgaggtcaattgattagtgcttttggctctaagttctttctttaaattttgttaagttgtctatctctcgtattgaattttttactagccttttagatggctgttgtgagatatcacattttatcacttccagacttagtccgatttcatctaattactttgaacaatgaattattatttttaattggaaaagtctagttgtcattattattactctgaccatagagagttatttcatataatcattcatatttttaccatttaatgttatgataatattcataagctttagcataggcagcccatttaattggcactattgaatgtcagcacaggcataaaaatgcaggtgagtttcttttattaaaagtgccccaaacagagtcacatgtcaaatgtaataacaatctcatatttctgacttacttgcttatgattgtccataagccagtaataggttattcaaagtcattaaaataaattgatttgaaaaattacattcagtaaaaatgcatgtagaaagcaacatttaattcagagtaataagtatttttgttttgttacacataatgaatgcatctaagtaaattcctacagggtcttattaaatattttcagtgatgattgctagatgcttagcatgattttctgaagtatatgaaatagagttagaaactgtcttggagattataattatgtggcatcgcaca

SEQ ID NO: 26698 - DNA, 1044 bp, Homo sapiens
gacttcaagcctcttaggaacaagagaaaaagaaagatcaaatctattggaaccagtgttgatgaacttactatgatgcctatatttttaaaaagcagaaaacatctactgataattcgacttggaaaataatttttttaatcagcattttaaggtctcactttctgtatcaattttaaatgatgattttgacttatttacccaaagtattacatgatcggacttcctctttatgatttgaaattgtagttctctgtctgtagagtttatttttaaaatatctctgtgcaacttgctttttaaaacaacagtacattctttagggcagttttaggttcacagcaaaactgaacagaaagtacaaaagatcctgtatacccattaacctcagacatgcacagctcccctccctcactatcaatatcctgcgccagagtggtacatttgttgcaatcaatgaacctatattgacacattattattacccaaagaccatagtttaaggttcactccttggtgttgtccttcctgtggattttgatgaatgtgtaatgacatgtattatagtatcctacagagtagtttcactaccctaaaaatcctctaaactctgcctactcacttctccttcccttgacccctggcaaccattgatctttttaccttgtccctagcatctttatcagactgtcttgtgcagtatgtatgaaagaggcccttttcagataggcctctttcacttaataatacgtcattaagatttctccctgtattttttatggctaaattgttcttttcttggtagtgatgaataatgttcagttgtctggatgtacccccatttaactatacattcaactattgaaagacatagtatgaccccatacttaatgtaaatataacctgattccctttgccaagaattgtattttgaataggcatatgacacttctctgaacaagatatgaggtgatgtgcaatgactggtttccaagcattatttcctaactcttagtaagggacataaaggaatatatagaactg

SEQ ID NO: 26699 - DNA, 1029 bp, Homo sapiens
gtaaatgttattttctttttttttgaggtttatgattgatccttggcatgtgtccccttgtgtattgctctactaaaaatagcctaaaaaagaattttcccctcgatgtggagcttctctttagttacaattctactttctccttcacttgagtatcagtcttcagagaactaccataacaaaggagtggatacagatatacgcaaaaaagtctatgagaaaattagtacattaaatttgtgaaagctcatttaaagtaattttctactaacaattttaatcaaatgtattaatcatatttctatgcttagtgatgttaaataaaaatttaaaaggtggcaatcaataaacagagataaaagcttctcaagaataaatgaaaggaagtaataaaaagactcactaagctgaattgcctcctatcaacagcagctgataaaatattaaaagatttgccttgtgtaatgtctctggagagctgtcttactgatgtacgaggccatgattgacaactttgagactttgctggaagcgacaaaagtatatctataatattatgctgaattgcataggtctttcttcttaaatgaggctagaaataacataccaccaagtgtttggcttttaggaaattgagcattttctttagttctagctgcagtttaatttcctcagaattagacattatgcggtatctggaacgttaaaaaaaaaaaaaagcaaaaacagagtattgtacctaatgatatgtcaaataattttggaggaattaagaaatcactggaagaaattacatgggtgggtaatggtttttatgtcacaataaataattagtaatatttactgacacatttcatgtgcctggtactgagctaaatgatttatgtgcattgtttgtattaagcccccaaaattctgtggtatatgtaatgatatttccatttttcttgagataaggaactgaaactcagaaaagttaaggaacttgtccaagattatagtaagtggcttagttcaattttgaatcta

SEQ ID NO: 26700 - DNA, 1029 bp, Homo sapiens
tttatgtaggagaaaaagaagtgttctataagaagtttggacaagactctgcaagaagttaagaggtactcatatcatccttcattatgcttaaggggtatgccattcaaagaaaaattgtagaatatcagactttaagaaagtaaaatagaatttagaaccctgtaaaaagtaagcattctggtgctgtaaagataaatttataagcatacagatatatttgtgaagtttgtatataataatttaaaattcttttacaactttaatggtttgtatatagggattttgaaaaatatgtgtgtatatactttgaaaattgtgtaatttaaaagtgcaaagtaaaatatgactgttttatgagaccactattagtgccagtagtgtagtctttgatataatcaattgtagtagtaatttaaaaaataaagatgaattccctttaacatttgagctatgttaaggattcagaaatgcttttctttgcttttaatttaacagctttattgaaggaaaattgatatgcaaaacattgtgcatgtttaaagcatacaatttcataagcttggcttatgtacacagcagtaaaaccataacaataatcaaaataatgactattccaaaagttttgtagggtcaatctgttatccctgtctccattaaactacagatctgatttgtcgtaatagtcttgttagcatttttctgaaattttgtatcactaaaatcatacacaatgtgttcttttattttccggcatttttcactcagcaaagttattttgagattcatctatattatgtatattagtggttcattctttcttcaatggcttagaattccctttgatgaagaggaagtttacattttgaagttgaggctttccaagcattcatttctctatgggatatacacagaaattaaattataaaatgtaagttcttatgtgttgttatgtagggcatagaagttggtaataaatataaaattttacctttttaatactttacaagctgttatcactttatatat

SEQ ID NO: 26701 - DNA, 1023 bp, Homo sapiens
catgaggcagatctctcatgaatagattaatgcccttctatggtggtgagtgggttctcgctctgttagttcccggagagttggttgttaaaaagagcctggcacctctcccctctgctcgtgcttcttctctcaccatgtgatatctacacatgccctcttgatgagtggaagcagcctgaggcccttaccagaggcagatgcccaatcttgaactttccagacaccacattgtggaccaaataaatcttttttcctttataaattacccaccctcaggtatttctttataggatcacagaacagactaagacagtatccaatataagtctttgatagattgttctatgaagttaaatatcttctggactgcactcctattttgatgttaatgtttaattgctgcctttcttagcattgaatttttcgtattttctttttttgaattagtgagttttgtgggttttttcgctccaactctttagagccagatctcctagtctgggtcttgggagcaaggtgtgttcttagctgttctgatcatgcagtttagttttgtccttctgcctttttgcctatattgttataactgtcatagttacattcagcagattggaaacagtttggattcatcttccttaaatactatgctggttctgtcatgagtcttcccacctcttgacatcaggccatgtgcctgtttccagttaatgtttcttttggagcaatactgatgtccattacctcaccagagccaaacttgagatgttgcctgtctctggatccacagtgcagcacacgtgctgattcagtcccattaggcaggaaagttgtatttctggaccacagtaatttgtcttatatttgagtccaatcatagcactttagttttatatttttatattttacctattattactttgtttatatagtgtagaagtaggtgccttaaagcataaacataacactgttttgactggaatttgcctatttgacatggtttcttctcaaagtattacattt

SEQ ID NO: 26702 - DNA, 1027 bp, Homo sapiens
tcttattggaaggtcatgaaagacttcaaaataaaactaatagttattttatttcctcagaggtaactttttgtactgataaaaagcattggttaatattaagtttaatctaaatattaagctataatatctttattttaaattttactcattggacagagctcagcttctggagtaccataaaacataggtcattctcctccaaccccagaatgtccatccccacggcagacctagttaatatctgatcactccctttatatttcattttcccattgtttataaagctatatagctttcttagactttgttttcttcctttttcccacaagacttaaatctttgctcgcagtaaacatttattgctgcagtttgttttacttttatgtattttggatcagccatctaataaatactttcttatgtgtttctccccaagagctacagtttataaatacttcaaatactgcagtcaatgcttagtgctgtattttaaaacaaaataaaatggtcataaggtaacaactggtgtgtaaagtaattaagaattactccttctcttgagaaacgtatagagaaactatagataatagagcttgtgtagaaaaaacagaggcagaacttgaggtcaactgtcacgtaggaaaaaagaaccttacagatgtgttctttaaaacgctatcaacacctctatccctgtaccaaagaataaattagagtcaatgcaggagggaaatgaagacactgatttttaattttatatcaggaatctatttactcatttattgatctaacatatattttattgaaagctactaatgtgccaagcactgtggtaggagtagagatacaagggtacatgagacaaagagactctgctctcacatgtcttttgagttacacagatattgaacaaatacttaaaagtatgttaaatttgctctttcactcaattcataattaagtttaagcttttttgtcaggttaaattgttggtaaatatagcaaatccagatcattcacagtt

SEQ ID NO: 26703 - DNA, 1087 bp, Homo sapiens
aaattccttaatgtgaggtagacttaactgtggcaaaacagtaagaatttgtgtctgtggcaaaacagtaagaatttgtgtttggtttgtgtgtgtgtgtgttttttttttttttttttccagagaatcagtgtttggggctagcttttccaggcccaaatgagaaatcttggctgcattctttaagtgctctgcatcctaccgttttttttttttctaatgtgaggattataattcttcacagataattgtgagaaaacagttacagaaatccttcattgtataagtaattttaaaattggtcgttgtttcaacttctaacatagttcctggaaccaagtgcttaaaagctattgaattaaattgcatataagtgaaaatcattgttcccttcatgataaaaattctctcaccaaaatttatcatttttgaagagcaacttagtttttgttacgtgggttcctatattagcttgctagggctgccatagcaaaataccatacatgggtagcttaaacaacaaaattatatgttctcactattctggtggctggacctccaagatcaaggcattggcagatttggttcctcctaagacttctagagagaaggtaaccacctgcaagctaaggaaagaagtctgtgtcctcacatggccctttctctacacatgcacccctggtattccttccgcttcttataaggacgccagtcctattgaattaagttcctgttcttatgactttatttacctttaattacctttttaaagatcctagctccaaatatagccacattgggggttagggcttcaatatatgaattttagggggacagaattcagcccaccacagttactatagtataatgtatgtataaaatgtaataattaaaataaaattcctaaagtggaggagagacagttcagaatataaacattaaaatgtgctacgattttttccttttcaattttccagcagcattctgaggtaaaatcaatagttttcctcccaaataataatttttgagagatatataacttaattgatcatttgccaagtgagaaaggtgtgttgataatcaagct

SEQ ID NO: 26704 - DNA, 1026 bp, Homo sapiens
tcgtgaggaatgtgtgctttgccatgaaggaaaagaagggcttaaaaaagatgcaggtcaacaacaccaaggacatgaatggactagccaaggctgtcagggccctcatatagctcaaggaggtcaaggtcaagacccctgagggcatcagctacaagctcaatctatttgcctacattgctgacctaagctagggcaacatgtttatgtccacattgtgtagaatgatttctctatctttgggaacatacacaatattcgaattgctggattgaatggtaattctattttgagttctttgagaaatcaacaaactgctttccacaatggctgaactaatttacactcccaccaacagcgtataagcttcccttttctttgcaacctcagcatgatctgttatttttttactttttaatgatatgcattctggctggtgagagatggtttctcattgtggtcttgattggcatttctctaataattagtgacactgagaattgtttcatattcttgttggctgtgtgtatatcttctcttcgaaaagtgtctgttcacgttctttgcctactttttaatggggttgtttgttctttgttaatttgtttaatttccttatagatttcagatattagacttttgtcagatgcatagtttgcaaatgttttctctcattctgtacactctttaatctgttgatatgctgtccagaagctctttagtttaattaagtcccatttgtcaattattatttttgttgcaattgcttttgggatattcatcgtaaaatcttaccaagttcctatgtctagaatggtatttcctaagttatctgtcagggattttgcaagttttaggttttacatttaagtctttaatctatctcgagttgatttttgtgtatgatgtaaggaaggagttcaggttcaatcttctgcatatagccagttagccagttatccagcgccatttattgaatggtgattcctttccccgttgctggctgtattagttcatttttacact

SEQ ID NO: 26705 - DNA, 1062 bp, Homo sapiens
cctgggaggcagagcttgcagtgagccaagatctctcactgcattccagcctgggtgacaaagcgagactctgtctcaaaaaaaaaaaaaaagcctttggattacaggcatgagccattatgcttggcctgaatataacctttctgagagaactaaaaattgttgcaccatatttgctactaatggtttttttcccctctatattgtcagagacacaaacatttcaggacagactatagaaagtagagatatatgagaacagcaatgattcatagcctcctcaaggaattaatgtgtggcaagctgagatctagaattgcaccttttcatatactcattttattctaagtgttaaataatcattaggtagatataagaaaggatcccaaattgtagctgcatctccactcctggtgaatgcttcaagatatagtgagacttaggttgcaagctggatatatcaacctgctagggatattgtggagtatccttcaaccagtccttaaattgtcaatgatcaggaccaaagacaatgtgcccattctccattagcaacttctgtatatgaatagaaatctcttcattcaaaggcacataaggagaaaaacagacaaatcatggaaactatagaaaaatactgtcaactactttgctatgtaaaaacctacctaacctaaatggatttacactcttaatttaaaattattttgttatctctcctgagctattgctgactagacttagctccatgtatgctctctgggcctgacattatttaggggcttaactggggcggaacatccaagaaggctcattcacgtggctgataattgaaactaacttctttctcactcaggtgtagtaactctgttttgggggcttatttccttgcttgcttccatagatgggcctatctttcttgccagtgattggttcaggcctaagccaattagtgcatagttttcccattggtcatggtagattgagatatggtttaataaaagtgactttgaatacttcatttgatggttgcagcaaacaagcttctctgtctttactcgg

SEQ ID NO: 26706 - DNA, 1105 bp, Homo sapiens
taaaagatatattaatcatccaagaactatcaaaaactatttaatatgtattaagacctgcatgaaacatcagtaacataagcatatattcttatcaaaattgaaaaactgttatattatgaagcatgtacctaaagcagatctattttaaagcataatgaattaagcctatttgtagcagacatggtaagtgtcttgttcatatctcttcaactcacttgagaggtaacatgcaagcaaacatgctaagcactgatccctattgcattcctctgcttagcaggtagagagcaaatgtgacccataatcaatgaaaaatgaaagttggcaaataaatgcctcagaactgtaataggcaacttctgagatgctttgtatgttccctcagagagtttacttctggaactgaaggccaattgccatattagcaacaaacattctttattgactttctccttttgctttcttacttggccattcttataccttactaattgggatcacaacccaaataaaccatgtgcacttaaatcttgtctaaaggtctgctttgggaacccaaagtaagatagtatttaaagaagctatgaggcggaactcaggggctcatgcgtataattccagcactttgggaggctgaggtgggaggacggcttgagtctaggagttcaacaacagcctaggcaacatagtgagatcctgtctctacaaaaaataaaaaacaaaaaaaattagtcagatgtggtgatacacacctgtagtcccagctacttgtgaggctgaggtggggaggatcacttgagaaggagtttgaggatttggcaagctatgataacatccctgaactccagcctggatgacagagcaagaccctgtctcttaaaaaataaaaagctataaagtttaggattttatttatttttaagtatttcttattttgactatttttttttaccagaataatttagaaatgaaaaattttgtttgatatctttgaaaagtatttttaaaaattatctgactcaaggaatcttcccaccttgggcaagttgaaaaatataaaaatgactatacctagagggccaacagtcacctataataaagc

SEQ ID NO: 26707 - DNA, 1030 bp, Homo sapiens
atgaagacatcacttcagcatttttcattttcaaaattctgacaaaacttttgtcaaaattcatgaagaaataaaaagtaagttattaagctgtattagaaaatcatttaatagtagagtaaaataagcactaatgctcagcagttaactttatccaagttgtgcatatataactcaataaatctaagtctggaaatgaaatagtggagacacaaaaggacaagctatacatttttttaaagtcttgacccaaatatgaactcatttgattcaaatgtaaaatctcatgaaattcaagccaatagaaattccacttctttcctggccaacatagtagcaccatggaacagttgaaaaccacattttcatgtgtttgtaatttatttcttttctaccatctgcatgtggcaaacaattcatcacagttgcaagctgtcgttttgccatctgcatgacaaaatggagaataaacttaactctctaaaaacatttgtgttcattggttgtgctgacatatctggctgtcatctagaattttgtcactgtaaagtggaatggatgctgttggctcagacaattggcactgtattgagataatagccaatatttgtaactcacttaaagcaactaaaactaaagggaaaggatgagcaaacctattttaagttcctctgtgtaaatgagtagctgggacagttgtaagaagggagtggctcagttgaataagtgaacagattagagtactatatacttagattctaatccttgttcttcctctttttagcagtgtgacttagaagcaagttttgttatctctaagttccactttttatatctataatggaagaatgtttttaatcactcaaataaatatttattgagccttttttatataccagacactaggtgggttccaggagtacaatggtaaacaaagcaggtatgattgtttatctatggaagattatagcattgagatgaaaatgaatacgtagaatagcaataaataaatccattattttcaaatagg

SEQ ID NO: 26708 - DNA, 1047 bp, Homo sapiens
aaaaaagttggaggactgacagcataggacttttatgataaaggtacagtaatcaaggccgcgtgatattggtgaaagaatgcaaaaatagaacagtggaacagaacagagagcccagaaacaggcccagatcaatataaccaactgatctttgacaaaggagcaaaggccttacaagggagcaaagacagttttttcgataaattgtgttggaataatcggacattcactccctgcccaaaacgaatctagatagagactttacactcctgacaaaacttactcaaaaatggatcacagacctaaatgtaaaacaaaactaaaacaaaaaaaaacttagtatataatattggggaaatctagatgactttgggtttgactataccctcctagttacaatagcaaaagcataatcaatgaaagaaaaaataatttggatatcattaaaataaaaaaatctgtgctgggaaatacattgtcaagagaatgaaaagacaagcaacagactgggagaaaatatttgcaaaagatatatctggtaaaagacagttatttaaaatataaaaagaacttttaaaattcaacaataagaaaaatatgtgatttaaaaaattggtcaaagaccttaatgtacacctcatcaaagaagatataaagatgacaaatatgcatttgaaaattatatgtcatcagagaaaagcaaattacaacaagaaggagacaccattacatacttattataaggtccaagatccagacctctgataacatcaaatgctcatgaggatatggaacaatgggaactctcatttattgattgctggtgagtgcaaaatggcacagtcacttcagaggacagtttgtcagtttcttacaaaactacatattcttaccacatgatgtagccatcacaactctgtagtgtttacctaaaggagttgaaaacttatgtccacacaaatacctaaacaaggatgtttgtagcagctttattcataattgctaaaagttgaaagcaaccaagatgcccttcagtaggtcaatgta

SEQ ID NO: 26709 - DNA, 1050 bp, Homo sapiens
aaggtaatttcatctttacaatgtttaataccaaagaaaaagtgatgtctgtggtaatataaaagataattgcaacaaaataagaatagcctccaactaacccatgctgctcagtgacagctggaaagactttggcctattccttcattcatccttcattaattcttaattcctaccaccattgtatttgttaaggaatgaggctttacatctatcttaagggaagtagatgagaaaacttaggattaaatacttagctaatatactcaaaatcacatcttagaggtggtgaagagggcatttaatctgaatctgccaaaaacccaggctcttttttgcatgcagcacctaccttatagtttataccatactgtttaaaaatgctttcataggttcaattatccatcaagcaagcattaaacatttaaacatatcaggcctaggtcataaaaaaggctttgtttctatcattaaggaaatcatagtatatgggaatatggacaatatgtggaatacatgacaacttactgtagtagatagagttgtgtgtgtgtgcgcatgcgcacgtgtgtgtgtgtgtgtgtgtgtgtgtgtgtgtgtgtgtgtgtgtgtaggagggatcagttctgcctggagattcattctttacttcctggaagagaagaggttacaactgacactaaatgaaagagtgtttacaagttgaccaagggagtctaaggggaaaggcaaagtacttgcaaaaaaaaggtagcattatcttgcctagctctcttcttttttcgctcttcttttttttctcactttcctcctccccttcccccaggctcttgtatatgctttgctttttaattttccttctctagtctctctagtgcctttctctaaacttctgaaaattcataggtatctttgtacaaatttttaagatgtcaattccatgggcatgcaagatgcaggaaattagtgagcaaaccaaccaaaagcttatttccagtccctacttgccaggggccctgggcaggatacaccctgcatcacctgatgaga

SEQ ID NO: 26710 - DNA, 1031 bp, Homo sapiens
gtgctggaattacaggtgcaagccacccacctggctgaaaaatgagtgtcttaatcagttttgtgctgctgtaacaatacctgagtctgggttacttacaaagacagaaatgtcttggcttaccgttgtggttggaaagtccaagatcaaggagttggcgtcttacaagggccttcttgctgtgtcatcacatagtggagggtaagaggttgggtgagaggcagagaaaggagtgggggaagagagagaggactgaattcatccttttataatgaacctactctagtgataacaaacccactcctacaatagtggcattaatccatttataaagctcaagcccccactgtcttatcaccttcttatacgctccacctcccaacactgttgcactggggattaggtttccaatacatgctttttgggagacacattcaaatcatagtaatgagttatttactcatatgcaacatttaatttatctttgttttagtgagatttaaaaattcctgatatatgaaaggcttgaacagcatatgacttttttgagcagataataatttaatacagaagtcaaaagttgaggtcaagttaaatgctttctttgtcataataggacattaattttatagtcaactcaatagattatttattttataactattatgcctattaccatggtatatgtttatcccactatttttatctccctctttagagaaatagacattaacctactatttgattaatatataaatgtataatttttgaatgcttattattcatcatcacttataaaatttgtatgattttactttgcttataaatgtagatataactcattcagaaattggtttattttaactttatcttaactatataacctatgtgataagtgatgctcatctactttttaatcacagatgaggtctaattaaaaatatgacatacctctattttttcctatttctcacaaattaaatatttgtttgtgaaacatttcaaggtaagagatatttttgtatgaattc

SEQ ID NO: 26711 - DNA, 1061 bp, Homo sapiens
aatgcagacatagcgaaatattgtcaaagtttgatgtaatgttctcagaattatcattaacatagggaaactaaaagtattaatcattgaatcaaaatgaaagtactacatgtgaaattactttaaaatggggcctaacggtcaatttagagcctcaattacgtttatcaaaaagcaggaaaaagttatgtgtgaagttaaaaaactagcaaagaagaacagagtaaccaacaaaaaagtaggaataaagaaaaataaagatgagtagaaaataattaaatggaaacactaaaaacagtaagttcaaaaaaaccaaaagatggttattagaaaaaaattgtgtataaatccttagcaataataattaatgaagagaaaaagtacaaatattatataatatttacacaataaaggtaacatgaactgacatatattaaaattaaaaataacctaggagaagtctatgaacaattttatgccaatacattccagaacctagatgaaataaataatttgtagaaatgtaagtgaggaaatttgaagaaaaattaggaatccaagtaaattaataaaaattaaataaattgaatcaaaatcttgctcaacaaaagataccataccttggaagtcttagagataaattttaccaaacttcccagaagaaagatatttctaacatctttattataaatatgtgtatttttttcagagggcagaaaaagagcaaaagctagtcaggtcattttatgaaattactattattttgataaaaaactaaacagctatggtgcaagaaaagaaaattatagaccaatttgtttaagaaagaaaataatcaggtcctagtttacatactctcaaatcagtttcaccattgtgtaaaactcaataatacatctcaacccagtgatacataccagatatacaagaaattttcaacatcaatagattaaagagggtggagtcactttagcagatacagacaaagaaattggtaagttcaacactcaccagaagaacaccattaacaaattaggagtggaaagaaactttatgaacct

SEQ ID NO: 26712 - DNA, 1019 bp, Homo sapiens
cacatacaaattaagtgtccaggattttgtcttaaaataagagaatgacagttactctgattgaagctgtgttatcactgctgtggtttagtatttctctgttatcactgaaaagaagaggtagaaactgcaattgacaattgagttctgttaagctaatcggaagtgcaaagtgagcaaattaatgtcttttttaagataattttaattgacaattataataaaaaggaaattgaatgttttcagtataaactgagagagaagactgcccaagttctggcctatagacagaagacttctaacagtaagaaattgataaatttctatttctttttagtaactgggaaagttattatttttatttaccataaagtgccacagcatgttatttttttccttctctttgacctacacaattaaatctatgtttataatattttttatactaaaaatgaggaggtagggtagaggaagtaccttttccttaccgatcctaggttcatggctgaggccctgataacaaaagatttatgaacaagagtaaaacatacaagtttatttaatataagtttcatgtgatacaagagccttcataacgaaatgaagatgcaaagaaatgggtaaacctgtatatttgttatgccgggtttgatgaagtagatagagtcatggagatgtatgattggataaagaagtgtgatttaatagtactaaactggaggaaatatagcaaggcctatttgttcagattcttccctatctttggagataagcatgttcttttcatctggtatagaaagggcacttctcacttgaggaccccttcaggggaagttcggaaaattcttcctaggttttatgacctgtttcaggggagaagggcagatcaaagagtgaccttcaagcttctgtggttttataaaattcctttggcctaaaatattttgggggtattatgccctgaaccccatcagtgacatacctaaaatattattctgtacttatgagaacaatgaaat

SEQ ID NO: 26713 - DNA, 1030 bp, Homo sapiens
agaagcttttgcaaagctttacagctcaaaggggcagagaaagaatttacaattacaagttttctaaggaaactgctgtaagaaaagggaggtcagaagtctgtataaagtttaatcaagctgccgggcgcggtggctcatgcctgtaatcccagcacttttggaggctgaggctggcggatcacctgaggtcaggagttcgggaccagcctgaccaacatggagaaaccccgtctctactaaaaatacaaaattagccgggtatggtggcgcatgcctgtaatcccagctactcgggaggctgaggcaggagaatagcttgaacctggaaagctgaggttgcagtgagccaaggtcgtgccattgcattcaagcctgggcaacaagagagaaactccatctcaaaaaaaaaaaaaagtttaatcaagctgaaggggatgttaaggctgccttggtcattttttttttttttttaatcagaactctttacttataagcctgaagttcagataatattttgatattgaagaagtgtagaactggcattttgatcttcagtgccttttgttttcctgttaggctagatgacatagaatgtaatcaagtaataattagtgataataaagataatagttcactttctgtgagctttctttgtaatttattttttaagaccactcctacaatggggtttgatgtattaattgatgaaagtatttcattgcctttctttttttttcaactttcatcaattaaatatttttattagcatgtagttgaattattttataattgtctttgaaataaatgggttgttttgatgtgagaatgatttaatttatttttactaaccttacacagatggatttaactaaaaccaaatgctctgcattctgtgagcttgcaacctctacttcccaacatctggtttatagcacattagttctataatctttgttgttgccaggaaagtacatgggatctacttcatttgtaatagacaagaaacatttttaatgccttagttcca

SEQ ID NO: 26714 - DNA, 1059 bp, Homo sapiens
ggactctaagtatggtttctactaaatgtgtattgcttttgcaccattgtaaagacaaaaattataaatcatatcatcataggttgggaaccttctataattctaatttatttacactgactggcttctgggttagtggcagaatggacaggtctgcatccctgagatattcaaaataatcatagctggatttacatatttttacaaatacaaatcactctgtttttcttttgtcctgttttgacttaataagttcccccccgacccagtccccccaactcccccagttctagcctaggaacattatgtaccacttcttggatagtactcaaagtgctacttattttgtgccactattagacttagaatctacttttctgtactgttttgtcagtataatttgggaagaggtatggagtcctaagctatcttgtttgagaactgtgcagtcttttcccagtggtaattctaattctcctttgtttccttccaaatgtggaaatagtaatttgtttctgtagtcttaattgtgcaaaacaaataaacaaaaactccaagctatttaagattttttttacagacatcaattagcataaaattagtgtatctatttgccagtgtctttgttctttggttctatttttgatacaagattgttcttcctcagatgattaaatctacttatttctaagatattgtttgaatttgaaccgatctatatgctctatttacccctcatcatattacctcctaagttttctaaatagcctttgccttataatttatgtttctggacttttccagaattcaaggcaatttcagctatttattatgccttttgaaatgtaaggtattggtgaatcaaacccaaatattatactgagttggtctccaagtcacaggaaataatgagaaatgttagacttaactttcaaagcctttgttatctccagaaggctgggtttagggtagggcttttatataaaattgtaacttcctggagattatgatcaactcatctttagttatatatctggatgatcagagttgtgaacaggt

SEQ ID NO: 26715 - DNA, 1030 bp, Homo sapiens
aagaggcaaaacaaatatttaagagccacttgtgtttctttttctatgaacttgcaattcttatcctttggctgtttttgtattggttgatcttttaccaatcaattgagaggaaaattttagttactaggaaagagttttctgtctctggtagttgtaaatctttttccagattatcatttttcttttaactttgcttatgattgttttgatatttagggttgttttttgtagctaaatatactgatcatttcttttatggttttaaaattaaaatatagtttaacagtcttcaattccgacgttataagtaatttctcctaagctgtctagttttttttttttgtaaagattgatccatttggaatgtatactgatgaatgttatgaggtaagaatctaattttttttcaggtagctacacaattattcccaatttattgagtagttcttgtttttctcacagatctcagaatttataacagcaaacattatttttcttgctctcaagactgtcacttgcagttctctagtgctaagtgggaccagaagggcttcgttctaagttcacaacctagaacctgaattaggttcagatctgttccaattgttttctaattctccttttgtatcagccgatacctgggacattttcttctaataaatcacaagagcagatgaggacaagccgaactacacagcatgtttttaatgcctctgtttatttcatattcactaacattgtcttggccaaaacgagtaacatgacaaagccaacatcaacaagacgggaaaatatactcttttttgtgggagatgttacaaaaacacatgactgaaatacggatgtataatttaattcaggtaaggaggctagaattgatgacaaatattcaatgtgccatagttggttttgcttttatatccaatataaacatcttttttaatagatgtgtctaccattttatgtttattaatattactgatttatttggtcttagatttgtcacattactttattgtgtcttccc

SEQ ID NO: 26716 - DNA, 1099 bp, Homo sapiens
attgtgaaacaaagtgtgaatattaaaaagaattgggtagaaatcttggaaattaaaactatgcatagaatatgctatacagggaatgagatttagtgatttggaagtgtcgtagcaaagtgtgattctgcattcattttttaaattattttttaaaaatagataatacagtcataaagtctttttaaaagattgtggtaacatatgcataacataaattttaccatcatgactaaccatttttaagtgtgcacttatagtttttagttaacagtacacttaaaatgtaagtttttaagtgtactgttaaccttaatagtacttaacagtagtgttaactatatttacactgtgtgcaacagatatctagaactttttcatcttttgaaaatgaaactctgtaagccattaaacaacaccccatttgttgttcccccttaacccatggtggccatcattctactttcagtctcttatgaatttgactattctaggtgcctcatacaagtggaatcatgcagtgtttgtctttttgtgactggcttatttcacttagcataatgtcttcaaagataatccatgtcatagcatgcatctgaattgataacacagtgttttggttcaaacatcaaaaaatattaaaagatattgagtaagcatcttgatatggtttgcctctgcatccccatccaaatctcatctcaaattgtaatccccatgtgttgagggagggttctggtgggaggtgattagatcacgggagtggtttcccccatgctgttctcatgatagtgagggagttcacatgagatctgatggttttataagtggcagtttggccttcatgcccactctatcgcctgctgccatggaagatgtgtcttgattcccctttgccttcctccatgattgtaagtttcctgaggcctccctagtcatgggaaactgtgaatcaattaacctctttttttaataaattacccagtctcaggtatttctttatagcagtgtgaaaagagaattaatactgatgtagtgggacactgtaataaagataaactgaaaacgcagaggcaactttggtactgggtaacaggga

SEQ ID NO: 26717 - DNA, 1029 bp, Homo sapiens
ctgccattgtgaacttaacagcttctcaataattaaaggctttattgacgtgatgggtggtgacattgaaaaatgtgattttttgacattatatagtgaaatgtgtcagcttttggaacatctctataatacagttacttaactaatgtttttaagtgatgaatgtatatcaaatcatacatgggtaaaagattcattcaaaatataagatggatcattggattataataaaacagagtatgaaaggttattagagttgcagattcaacattgcaattaacctttaagatatacctacttgtcgagttttgatttagtatcaaaaaacaatttccccaatattcgaaaatattattaaattattcctctcatttccaattacatatttgtgtgaggctagacttttttcatgcttttttaattaaaataacattgcaaaagattgaatgtagaagcagatgtggggatacagttgttttgtactaaaccaaacattaaagaaagttggaaaaatagaaaacaaagccactcttcttactaaatttcttcattgttttgttttttcttttctgtttctttttttttaaaacatgtcattcatattaacatttaatgggtttattattgttgctttaaataagtacatgttttaaatatttcttagttttaatttctaatgtggcaaatactaaatgccataatctatataagtgaatgatctttggagttctccatttttaaagtcttcaagcatcttgagactaaaagtcagaagactgctgtctttactgtattgataatggcagacagtctttgttttaagttacctttcacaaaagaatgtcagccttattttgttctagtgtaaaatttttggcatatttatacacaagttatatgcatttcagatacagattgccatattaaacattttacctgtcagtttttttatgccaaaaggatggttgaaaaaaaagtgcaaaacataaagatggtcttaacatcctgaattcaataattttgccagat

SEQ ID NO: 26718 - DNA, 1054 bp, Homo sapiens
tcatttactcaactgatactcattgagctactgctatgtaccaggcattgtttaggtgtaagagatagagaattgaacgaacaaatattcttccaatcatggaacttacatttaaaagtgacaaatagaaaaataaataaatgtgtcatttacaaaagtgataataaaagtactacaaagatgataaaagtactacaaagaaaaataaataagtactacaaagaaataaataaataaaaaataaataagtactgcaaagaaaaatggttagggggatggggcttctggagaatatattgttattttatataaggtagctaggaaagtagtcatttaagaggaaacagggaatatagagaccctgtggtagaaacctgcttggtgtgtccataaccagcagagaagccgatgtaactcagatagactgggcaaagaggagtggtagcagaaaataccacagagatctccaacaatcagagaataaagagaggatacgactcatgcagaacttgtaggccattgtaaatgttttagattttactccaaatgaggtgggaaatcactgggggggggggggtttaatgtaatatattataaaatggattttcctgtctattgtgttgacgatagctttcaagaaggcaagtatgggaaaagggagatcaacttgaaggttaatgagacaacctgtgtaagatgtgtgatagcttgaactaaggtaatgataggtgtaatgttgacaagttgttagtttctggatttattttgaagacggagccaacaggatttattgatgaattagatatgtagtgtgtgagaaagagaggaatcaagaatgatttcaagtctttcagatgggcaattggaatgatggcgttgccatttggtgacttggaaaatactcccacaggagaaaaatttaaagttagataatccagagctatgctttgaacatatgcttattaaatatccaggtgaatattgagtaggtagttgaatatatgaatcttgagttcaggtgagaactctaggttgattattaatttggaatgaa

SEQ ID NO: 26719 - DNA, 1058 bp, Homo sapiens
ttaaaaaattgttttctgtatttagtgttgttttattccagccccttatttaaaaggcttttccctctgagctcatcattgatctggatgaggtgcatactcttttaacagtgtttattacatgtgtatgcgaaggtctgtagataatacgctccattaaactcttttgcatatgaaaatgtctttatttcgcctttacctttgaatgatgtgtatagcattcagttatttttctaaaatgttttgctgatattactttacaaacttctggtagctataattgctgtggataagtcagcttttagctgaactgtcattcctttgtagatagtctttaacttattctgaggtttttctttatcaggaagttctgaaatttcactataatacatctattttttaacatcatatttgaatttaatttttgatctgggagtttcagtttttaattcttgaatattcttaatcattgcctcttcaccattccttccgtttttttttttttttttctgaacctctcactaaacacacctgaggtcactctcaaatctgtttttcttgttccttgtttgctctttattttcattatctttccaagttctgggtgaattccccactactaattgtctctttgtctgagtttatttttaagtttgattgcattttttatttcaatgactatatttcaactttgaaagcatttaattaattctttttcatatctatttggttgtttcagctgtatcttattttgttttataatttgttatttttgtatgagattatttctgtgttaatctctgtgaatgcattgtttcacagataaaggttctaagaatttattttccttgcaataatttattttgcaattgtggattttgttttctattttccttaaatatttcttcatatgttttagaatattttgaggttttttttttgagatagaaagtatttgttcctctttctctttttaaaattcattgaagttcacctaacaaaatcaaccattttaacgtgagcaatccagtggtatttagtacattcaccatgtttta

SEQ ID NO: 26720 - DNA, 1003 bp, Homo sapiens
agaagaagtcgtctttaaaaaaataaaggtgacttacttctttcttttcttttttttttttttcctttttggcgatagatctttaaacaacgttgaaacaggaaaagtctcactctcctattgaaatctgattcctttagagtgtaagagtgatggcttatcacttagagtcacttttctgtgaaactttttgaatcagataactccctaaactgcggaataatgaactgggaaagaggactaactcgaatgtcagacacttcttttgtcctctgttttggctgtctgctatctcacagaaaacctggttaggaaattgatgtaaataatgtattttttaaaggaaacaaagatgaaaattctgaaaatgtgtttcctttttaaaagaagaactagagcagagggaaagataaatcaggaattaaaagttgcattaaagaaataatagaaaaatgcctaaataattattggttctgactgagaaagaatagctgtgcgaaagatgtggaaagtaaaattgcacatggaaatggactttaatacatacttcgccatattgatcagcgtttacccatgtctctcaattactgtcctttttatttatattttcaaagttgaaatatgacctgtttgcttgaatattaataaatatatgcactgaatgtgtttgcccataattctgaatactacatatacattttaagtatgactcattgagtatgcacagagaaatgtatgtgtatacacataaaatggcatagaaatttgcatatgaggtacacatatgatgtttactagtctgtaaatgagtgcatattaacactttatttattagatatgtatgggttctgtatttcagagatgatttacacaatgaagaaagtacatgcactttgggcttctgtatgcctgctgcttaatcttgcccctgcccctcttaatgctgattctgaggaagatgaagaacacacaattatcacaggtaaaatattagaagcaatta

SEQ ID NO: 26721 - DNA, 1050 bp, Homo sapiens
tttttttctaacagaatacccttatactttaagatttttaagttagtaagctacctttttgtcttttttttttttttttttaacttaggatacttctgaactggtaaggtgtgctcacaatgaggtttcccctaaaagttatttttctactttcttctgttagcaaagcagttgccgctacagagtgaatgcatttgggccatccgcaggttactgggtcaaggatttttgataggaagtctaggggttatcagcggcctcaatgcttttggggtattcccttgtttacactgacaacaagaaagtgttattggagtgttatagggttatggataatacctttaattatcaattataggttttaaatttaccttggcttttaaaggaatagggtacactgttttttttcttaactacttgtatatctctctctctctctctttccttgactccctctttgtctttctgtctcttcctgtcactttctctctctctttgcctctttccctctctgtctctttcctctatctctctctctctgctggtctttccttgcctctgtcagctgcttatgctgctgttctctcaaccactgtgaggcggatctaaaaccagctgtaaccaagtgtctatgtacaggaactggtttgcgtgccctggcttacaggttaccttgtgccatacctttgaaacaacggacccgtcaaggcttacttctgatgggaaatccacctctaatgctggccagtctatttcacataaagttctaacttttcctggtgtcagagtaacaccataatctcccttaaatcctttcttgaaatttttcaacatagttcctggtggggtgggcttactttgtgcctgacccatgcttcctcgagacaaaacaccacatgcacaccgcaaaacaaagaacaagtaaaaagggcacacagacactttcacagtttacaccaaaccagagtcaaaaccaaatcagagtatcaagaaatccaagccaggtcaaaaccaaaaccaaagtatcaagccatccaagtcaagtcaaaa

SEQ ID NO: 26722 - DNA, 1022 bp, Homo sapiens
tgtgctattaactacaatgcaattaacctttacttttcttaaaaagcaaagttgtgcaagtaatttgcctgctgtctctcagcaacgtgtcctccttttttgacactagtttgtaatgctagggctgtgactttgcagatttcatacctctgattcccttggcagctttttgaaagtattggagtgagacttgaagttattgaggaatggggattggaagaggagacaagacttccttcctgttttaaaatttgttttattcttgctggcttcaactctaaaatggcagttctcctaagcgttagttggtggcctccattgtggaagtggctccagcctccagttcctgttggcacttccagaaatgcctgaacatttccctcagagagccagcagcagccaacccaagcctcttccttagagcaccaggtctggtggctcctcctcctgttatccccatcttttcccatttatttccctaacctcaggcattgtagctacttcctgagttacctttatgtgactttacttattcaaccttctgacacctgtgaaaccagtttcttccattaaatcctctctgttggaaacaatttggtttctgttttctaaacttgtctaatatatctgtacatagtcatatatattttaaattatatgtaatgttaaaaatagtaaaagcaaataaattaattccattgtgtttctgatttatattttaaaaatgcttttttgatttgggcttttagcatgtcatatatatgtgacgattttgatggcttgatatggagtatatcttatgaaatgtatacatagctccaaatgtcaccaaagcaaaaattggtatgaacattgatagtaatttttccttgcaaaaggatcttatcctggagttccagttaggttttacaattactgaaatgacttgctgtctattttctatccttgtttagctcatactccattaaacagaaagcaaactaagagctggagagatgaagagacttggtcaacatcataca

SEQ ID NO: 26723 - DNA, 1051 bp, Homo sapiens
aagtgggcacgaacgcggtggacgctgtacagtcgccttcgtcggtagggaactgctggcggcctaggggtcgtcctgagagggaaaagcgggctccggctgcatctgcggcgccctgcgtggccgtaagagccaagtggcctcagaggctcgccccctacgcaaatcctcgttgtcttgccagggtcctgacgtgacgtgcggccgcgagaaggaaggggcgggttgggggaggcgctgaggtggtagcagcggcggcttttgctgagttttctctggcccagagcgctcgggctgtcggtctagcaggggggactcccctgaggggccgctgcgggtcgccgtcttcggaggcaccggcgagggcagagccaacagcctcttcacggtctgtaaggtcattgtttgccagtcgtgggcagcgcggcaaacctgctgggaaaaggttttctggttggaataggatgagtaccgcaccagctttgccttccagctgagatgtaaatttcaggcctccatcctgtggaacgtgggaaaactatcttgagtgttggcatgttctaagtatgacataatagtttaatgtatgataaatcatgggtgtttagacgaaagatttacacatataaattggaggctttagcggtcttagtgtaactaacttttcgtccccttaacccttgatgcctgttctatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcaga

SEQ ID NO: 26724 - DNA, 1070 bp, Homo sapiens
cagtatttaatatcgccactgatctgataccagaatctcatagtaggcagttaaatcttaaaaacaaacctcccgtatctgcatttaattgtatgtaaaagcttccctccacctaccaaggcagtcttcttccttggttcccatactgcttctttaactattttagcctttaaatgctaaattaggtttttctagttcactatagtttgcacatttaaatatttccattcttcacaagaattatgtgcattttaagcatggttgaaatttgctgccacaaccataacattaaaatttggagatcattgtagattcatgcggttgtaagaaataatatagagatcttgcataccttccacccagtctcccaaatgataacgtgtgtgtaactacagtatactggacattcctcccccttttttttcggagaagttacagattgcctcataatcctgtggggatactatgtggctatgatgagtgatgactacactgaaataggagaactagacggtttcatgataacctgatttttttaaatccagagctgtctgaactggaggattcagcagaacaacagtatccacatttaattatgcatgaagtccccttttctctaccttaagcaattaatttcctcccaaaattcaatgtggaggaggttagaaggcacatctggtccctctgccctcccctgcctttactttaaaccactggttttacctgttttgtaatgtggaggtttcactggcaattttatttcaagaagaaaaaaagaattctaatgtttaaaccactggattaattcagtaggctttattaaagctaagacatgaggcttaggaagttagaaaatatccaccccagtcatcaaaagtatattgctgtccatccctggagatttaatttaaaagaaaaatagaatacatataaaaattttgcaggaaaaaagtatgatagaaaaatgtgcctagtataagaatttctgtcaattcagtaagtaaaatctagcaatattagacaaaaataatggtattaacatttgtatcttctcttgacagttttaattg

SEQ ID NO: 26725 - DNA, 1029 bp, Homo sapiens
gactatgtgaaaagaccaaacctaggattgattggtgtatctgaaagtgacgggagaatggagtcaagttaaaacacacttcaggatattgtgcaggagaacttccccaacctagcaagactggccaacattcaaattcaggaaatacagagaacgccgcgaagatgctccttgagaagagcaaccccaagacacataatcttcagattctccaaagttgaaatgaaggaaaaaatgttaagggcagccagagagaaaggtcgggttacccacaaagggaagcccatcagactaacagcagatccctgtgtagaaaccatacaatccagaagagagtgggggccaatattcaacattcttgaagaaaagaattttcaacccagaatttcatatccagccaaactaagcttcataagtgaaggagaaaggaaatcctttccagatgagcaaatgctgagggattttgtcactaccaggcctgtattacaatagctcctgaaggaagcactaaatatggaaaggaaagactggtaccagccactgcaaaaacataccaaaatacaaagaccaacaacactatgaagaaactgcatctaatgggcaaaataaccagctagcatcatgatgacatgatcaaattcacatgtaaccatattaaccttaaatgtaaatgggctaaatgcaccaattaaaagacacagactagcaaattggataaagagtcaagacccattggtgtgctggattcaggagacccatctcacatgcaaagacacatataggttcaaaataaagggatggaggaatatttaccaagcaaatggaaagcaaaaaagcaggggttgcaatcctagtttctgataaaacagactttaaaccaaaagcaatcaaaaaagacaaaggcattacataatggtaaagggatcaatgcagcaagaaaagctaactatcctaaatatatattcaccaatacaggagcacccagattcataaagcaagtttttagagaccttcaaagaggcttagact

SEQ ID NO: 26726 - DNA, 1026 bp, Homo sapiens
tcaaggaagcacatggtcatcagatgaatagctgatcagatcttaagggaagggtgttttaggatacggcaaggaaagctataaaaattaaattagaaaatttatgttacatgcttagcccagtaactgacaaatagtaaacactcaaaatttaactattattaataattttaatgcagttttatatttttagaggttgccggatttttcattgagagtctcttgtatgttacaaaggatggccctttttatcctcatatctgtaacattcttctgttttgggtaaggatgccagagattatactgacagttagactatcatgtgagtcccccaaggactttttacaaatgatgatgatttattctcacacgtcctctttggccattgaagtaaaacagctggatagcataaaaatgtactgtttggtcactaatagaattctcttcataaactttataaattggctgtggaaatttttatgttgatgagctttggtcttgtttctcacactgttacagattctgtaaaatgtatgaagcatacaaaattgaagattgtctctgtaaactgttatgaaggcctttctatcatgtttggccaaagattcagatctttctctgtgttgtgggcatcctcagtcacattgagtagtctcatgcttcccttgagctataacaggaaggaaacatgggcatgtgattatcctgtctggaagggacacccttgattacagtggaatttaggatacgagagagctgatgcataacccctttctttgtcaatgtgttcaatgctagtatctgcaatgagtagacagacattctcagggctgtagaggatatgaaaaagaggaatatactttggggatgcgattagaagtgggtacaaaagataaataaccatctctctcatctggcagaggtaaagtatggtaagtgtaaaaacaatacaaagaaaatactcaaagaattgaaaggaggaagagcttacctgtaagaaaggactagaagcttttttatgaaggt

SEQ ID NO: 26727 - DNA, 1035 bp, Homo sapiens
agcttaattcacaaagacattttttaaatattaaaattcatgccctttgattgatcaaggaggaggcaggataatgtatttttttcccctcgtaccagagtttaatacaggctatatctcctttggcaaatcacctatcccgataaaaaacaaaactgtttttaaatctcagctctgtaatccttagagcttaaagataaaggaaaaaaaatgaccttctttttgtccattagtcaattacaggaagcattattctttccatattaccacgttatgaatctgatttcaaagtaagtattctaatgaaaagagaagcacttaactttttaaaaaaattccaactgactctgcaaatgaaatttttaaaccaaggtaccaggagaggaaaaagaccttatgttctaaagccaccatcatatgaaataaattattctgtcttttatgtatccgaatggtagtagttatatgccatccttgggagaactgaagaaatggtcactcaagtcattctgtatgttttgtgtttctgaggagccctcactgagaaaggctggcagagtcagaaaaaaaaaattcgtgttctttaaacagggtatagtcggggtttttttttttgtgattggggctttttaaaaagagaggtactctggaaaaggagacagaacatatttaagtcctacttttagcatgtgaaggagctagattctacattttcttaaatactctgatgagttaaatggaactaacactcaaatgccaccaaatccccccaccactgatagttaacaatgacagcatctccgactgcttcttgcatctttgctatctgcctgactccattctgagtgctttgcatcaattctcctgtaattctctttaatatgagataagtatccccagatttacagatgaataaaactgagactcagctcacacagcaggcccaagattgtccagttaaataaggagcacaagcaggatggaagccaggccagttcaactcaaagggcctcacttaacaccaaggcctactct

SEQ ID NO: 26728 - DNA, 1035 bp, Homo sapiens
gagtcagctcattctcatctacatattaatatttgatataacctccttttggtagaacaatcttaataaaggcatccctggttcagagaaaacttcagatttcaggtcttgacatttttgtctttgttttttgttttttttttgagagggagtcttgctcgttcccccaggctggactgcagtggtgctatctcggctcactgcaagctccacctcctgggttcacgccattctcctgcctcagcctcctgagtagctgggattacaggcgcccaccaccgtgcccggctaattttttatatttttagtagagatggggtttcaccgtgttagccaagatggtcttgatctcctaacctcgtgatccacccgcctcggcctcccaaagtgttgggattacaggcgtgagccactgcacccggccattgttttttttttttttaacaaatgaaggtaagtcatagagaagattaccactcactccctatccctagtagcaaaatgactgtatagccttatatgtatttgacttaaatttgaaaaacctttagaataccagagaaattgaaaactaatacttccctagtaccttgtattataaaagaaaacaaacaaacaaaaaacaagaaaaccccaagctacttaaaacaatattttttctgcatagtaggtggatctctttaacaatagtccacatgaattcatcgatacgccactcagaaaattgagccaaacagacctgttgtatactctgtaccacttctaggcttctcggggcatttgttgacttcccatggcctgaactgttaggaatattaagaaagaatggaaataattaccttcttcctcatctggcactgccagccactggatcagggcaaagagcagtaggatcaccaagcaggccatgccaattcctcggaaggttgcagcagcccctataaaaacaaacagcactctatagagtaattccaagaaatgcagatagcgctcatctaaaaccatcagttttctaaagatcaaagcaaaggaagc

SEQ ID NO: 26729 - DNA, 1027 bp, Homo sapiens
atgttatcaagtaagtattttcctcaaagtaaaagttttatagagtcacttaaatcagtgctactaaaagtgctgatccagagagacaaagagcttgcaccagaatgtcaatctgtacacttcttccctcatcaacaaagtcttgctgcaaaaatcgtgtcagctgaattaaatggtgtgcatagttgacatatttggtttatattcttgtgcaaactgaaaatactcagatagtaagaatttaggcttttcaggccatacagtagttgtcacaattttaggctttgtataccgtacagtccctgtcaactttgtcagtatagcacagaagcagccataggcaacaaataaatgaatgggcatggctatgcttcaatgaaactaagaagcagacagcagtctggttttggtttgtgggccatagcatgctgaatcctgaatcctaagccatttcagcagctcatcccgtcaaagctcattatcgtgtctgcttttataataatgtcaaaagaatgtaggcaagagcaaaaacagaattggagatatctttccttagagaccagaaaaccaaatgcctgaaatagttgtttcagatgccccaacatggagatagagggatagaatgaaatatggaaaattgtacataattatttaaaatgtatatgagtaataaagtgcacaagtactgccagtcaaggccctgggccaaatttggaaaaaataaatattctaagaaggtttcatttcaaaatgttgatatctcaacattactgcttagcagtaaggagttggaatattccttccctcattttttttcttcctccttttctgtcttcctcatcctttcctttttttcctttctcaacccagaggaaaaaatttccaggcaccattgaaaaccagtattacattcctgaagagtaggttcatagagcagcagttaaaacttgtggttttgccatttaattttctttcagtggttgccccatttgattttctttcagtgtagtttggagacaatacattt

SEQ ID NO: 26730 - DNA, 1130 bp, Homo sapiens
agtatcaatataaaagtcctcaataagatattagggatcagaattaaatactacattaagaaaggacatgaccaaatatgatttattataggttacaagggtagtccatgactgggcaacctattaatgcaattcactaaattaatagctacaaggagaaaaaagcatttacttccttccacagaagctgaaaagatctaacagaattcaatactcattcctcataaaaacattgaataagataggaattgatgggtacctctttaacacaaaaaaatatatatatctccattctagagacagtatcttacctaactgggaaaactccagtaagtcagaaacacagcaaggatgctgtgtttccactgctatttagcatcgtattggtggtattggccaatgcaattagacaagagaaaaccattagaagcataagaattaaaaacaacatcataaagatgttagctctccctgagttaacttgtaattttaatgttattccaataaaaataccaacaagttgttttctggagctacacaaatttgttctgaaatttatgaaaaataaacatgcaagagtagcgaggcaacttctgaacaagtagagcaatgaaatgggactggccctactagacagactataaatcctctatagtcaaacatccttcaagggttcaggcttatgaataaaaaggccaatgggaaagaagagaaaaatctagaaggaaacccgtgtgcatatggaaattcatgtgataaagttggcagctcagagcactggggaaaataatggacttttcagtaaatgctgttaagacaaatggaaagctaactggaaaaaaagtgaaagcaaaaagtggacccatacttcactctgatcatgagaataaacaaatatatcagcgatctaaaagttaaaaagaaaaaaaggaaaccttgcaagtgctagggaaatgagtgaatgatgtaatgtcaatagggaaaggctttctaatataaggaaaattccagacatgaagaaaagatgatacaattgcacatataaaaacacccccgtagaatctgtgctgtatagggcactgtgtaagaaaggttgacaagcacagtttttgctgtgtgggggatttaac

SEQ ID NO: 26731 - DNA, 1026 bp, Homo sapiens
tagcaaatattagatccatgaataatgagaactgacagtattttcatcacttttcatttaatagacaagaaaataagatggtatagaaattaaaacactttgtatagagatttcaaaaggagtgacaatgatttgtttttttccattggtatgtcataaagcgttattttgttattttgttattaattccctaggtttatagtagtttgaatcttgcatgtatatatatatatatatatacatgcaagattgcgtgtatatatatatatatacacacacatctatatatacatatatatatatcacacaatcaaatgttagaaggaaaaatatttctttttattttttaactttgaccatctaaaaatacaaaattttagctagagaggaggaataaattctagtgttctatgtcattgtaagacagctatagttaacaataatatgttatatagttccaaatagttcaaaggaggatattgaacagtcccaacgtgaagaaataataaatgtttgagattcggattaccctgatctgattgctatatacatcaaaacatcactatgcatcccataaatatgtacaactattatttgtcaattaaaaataaaatatgataaattatcaggtgtacaaatttttctatattgtcggatagagaaaataataaagcacaaacaaaactttttgtaaggatttatttttctaaaagtataaatgcttttatacaaaaagcggtattttttctttccagattattgttatttgccaaattttgggccaaatatgaaatttgattttcactcataatttccacactagtaaagaagaaaatgaaacatatttctgctttaatcgatgctcatatattcaaaaaataattgtggcgtgaatacaagttttctttcttttcattcctattttacaaggctatgagagatagaaaatgttaccaccaatcctgtctgcattaagcaataattaatacatatttacagtgtagttaattttaatttaaaataata

SEQ ID NO: 26732 - DNA, 1048 bp, Homo sapiens
atttgtagatgcagctctcctggagagtgcataagcgcactggggtgtgggaaagcaatctgcaaagacaccagaatttagctgccgtgagcacaggtcagtacattttaatgaagaacatctgctaatcttgcttgtctattaagagatagattgggtttatcacaattcagaggtaaagagaccagaactacagagcttggagagcaagttaatgatgacaagactttgtatttaactaatttatcttggaaaaaataaaagaggaagctatcttgtattgttattcctttagaagatatgctcagttgttaatttgatttgtttttgaaaggaaattagtccaaatggcaagagttcccataatgattcaataaaattttgatgaattaaggaagaataatcagtcaagcaaattatcctattaactgaattgtaactgatctttttgtggcatctcagagtaaaaatggcaacagttaatacttttgtatagtgcttactctgtactagtgctgttccaagtgctattatgtataacaatgcaatgctaatgacagtccctcgaagtagagtctaactattactattcccattttacagtgagaaaagtgaggcacagaaagattaagcagtttgcccaaagtcagctagtacgatttcaaatcaggactcaaaaccaagcggtctggctcctaccagtttggctccagaatcttgtgttctaaaccactgtgctatattctctttccagattctgaaaggcagatagccagagattcttaaaaagctaaaaattagaaggataatgtggactattcattagtaatagcataatggaataatggaagagtccatggaactcctatctctggtctactctactatgacattttctaataagggaaaaggaacaaagactatttttacatccattttagatattgatagcactaaaatcagttattgcctgggcataaaagtatatgtgcaaacatgaatgagtagctctttaggagcattagattgcatgtaatacacaacagtc

SEQ ID NO: 26733 - DNA, 1049 bp, Homo sapiens
tccaaatctctttgcattagatgagaagcaagagatatgtgataagatgcgtcagttagatcgccagcgggataaaaccaagcaaacagatggcagccccatagcccttttcaacatgtttattgatcattgccgcagccaactgcatgtggtccttgccatgagtcccattggagatgcatttcggaatcgtcttagaaagttccctgctcttgttaactgctgtaccattgactggtttcaggtattgtcatgtacattttagatagacttctagaaatgttgaatttccactatcatcatgacttattttatagattcccaacctgtagtttaccccaaaatattgtttagcagaatcttctgatcagttatatcttatgaaattataattcaagaaattataatagaaaagtatttattaagaatatatgtgatcactaacttcaatatattataggaagtgttatgataaaattgtgtatcagagtcctgacaggaagcacagagcaaccttgaacccttcaccgaagaaagcataatgaaggaactgttcacagaggggtaggcagggttaagggaaccaagaggggatgttggaacactcaggaagtggtaggtggagcaatagcaggaagtgttactataaccgtgtatgaaagtcagagcttagagctgtggatataagactgcccaacaggaataggaaccagaaacgtagaactcagctacggctggaaaggaagggaggatcaaaatacccctgtgtctcacttcttccaccctgcccccaatctcttcccattagctaaacccaaaggagttaagagcgagaaagccagagtgacctttttttctgtggacttcagtactgggaagtacagagcagagcagaaaaaggcagcgaatggatggggggtaggaacgaggggtggggaaggggagtagcaaaggaagagtaactagctagatgtgaatagtaatttaattctcccttctggctttaacagcatatcacaatgcattctctacctgtgtggtaaaaaatc

SEQ ID NO: 26734 - DNA, 1028 bp, Homo sapiens
ttctcaatttaacctttttctcttcttggcatgtgaatggaaaaaaaatcacattattctacaaagaatgtctatttcatatgtttcagaaccttatttggagcccttcatttgcaccttggaggagcacctgagggtccagctggcactgggaagactgaaactaccaaggatttggcaaaagctgtagccaaacaatgtgttgttttcaactgctctgatgggttggattatttggctttgggaaaattctttaaggtttgaattaactcctcatttctttacaacaggataactgatcagagatggttatttatgatgcaacataattgaatacaagtaaaagatttactgtagcttaagtaaaagtaaaaattgaagcactatctcaataattcttaaaggaaataaggttatagcaaaaccctatttgcagagaatctctactttcctctccagtccctactgtaacaagtcattattactggttggaataagtggtgtcccttaaatacattggagcagataagagtttgagaacgattgcatcgtgtaaaggtcgtgggattctaaagacatctttaacctacagatcttgttattgagaagttattttgagttagtaatttacttttatagacatattctaatcagtcatttcagtgaacttgaaatcttaagttttattatttgtttttatttttaaaaatttatttttatacattatagatgtacatattttcaggttacatgtgctaatttaataattcctaaagatcaaatcagtgtattactttttttaaattctaagttagattcttgtcagtccatgagcttcaaaaggtagaattagagataccaagtccctgcctataaacctataaacatctgattattttagcagcttgtgtctgtagcctgttattccttaaaatgttaggtgacacaactgaacacaaaatgatccacttgaaattatatatttatttatgtttttctgtaatttttcaaagcacattttattttat

SEQ ID NO: 26735 - DNA, 1059 bp, Homo sapiens
gaaagtgtaaagcaccatatgtttgcggcttctaactggcttactgtgtttagattgctcaattgcaaattatatctagagtgtgaagtgtcagtccttgtgactttcaacttgggactgaaatttgagcccaccattattttttcttcttatggctcctaacacttatgacatattttttcctcttggcagtcactgagacttctgaatccccagcttcaacccctctaaagaatcgctgcccattccatcattcattcattcaacaaacattactgaccacctactgcagtgcatgctagatactgttcttgatgtggttgtagcagtgagccaaagaagtaaaaatagagtaatagtattttccagagtgagttactattttatcaaatagaatatacttgtgtattcccaaatataccttacaaatttgatgaataactgtataaatgtttttgcatgatgttctaattttatcttatttagatttaatccctcctaaaaaaatctgtggattttattgatatttctgctttatggatgactataagtaactgaccctaagttatattgcaggtaaatagaagagttaggatttatgtttcgataattcattccaaacctaggaatttttcactgtgcctttttcagcattctttaaatttcagttctttagaatttatttatttatttatttgtgttctggccccaagtattctgcatgaagctacagtacaagatggtattggctaagaatgcagattcttactcatattcaagtttgttaacctaattgtacttgtttctactgtaaaatgggtgtagtaaccatgtacctcacatgtttgtcatgaggctcaaaatagatgatatatatataagaattcatatatatgaaaacatatgtatatatatgaatacatatagatgtacatatatgaggagagcacaaagagctactatttttattatctttattgcagtgaaggcaggctgcaacattattggatcataaagcaattcagttttatttattaatattcaagtattagtacccag

SEQ ID NO: 26736 - DNA, 1030 bp, Homo sapiens
gagccgagatcgcaccactgcgctccagcctgggcgacagagccagactccgtctcaaaaaaaaaaaaaaaagaaagaaagaaagaaaaaccatcagaacaagagatgagtactagaaggaccctttggggccatctcctttctatatttgccctgaggtgtccctcgttggtcttcctaattccctaccgcctgctgatgagctgatgtggcttttcgtgtgggagagaattgacaggagattctcatacagtggtctgctctgtagttgaacctcaggtccaagactctcttcaactcctttcccctctgccctctcactcagttctatataactgtattttaaattttcactttattctgccattgaatctgcatgtactaacaaaaacatgccagagttaacccatcacatcaccatattaaagattcttaaatgtcatataccttttggattggtctttactttgggaggtgggtaaatttatcataaaaacagattgtattaaaaaaagggactcttctgtaattaatgtaaaacgtcaagctattgaaagaatttgtgactttaatggaatgagataatcattccacttgcattccatcagcattgttgctgctgacaacagaggacaggatagtccaagtcaaatctactaaaggtccttgagagctatttcacaagtcagattttaaagtgtctatttgtgagtgacagacattgcaacagttaaagaatgcttacccacttttccttggcctcaagagcaaaaaccagtttgggctcatttctttccaccagcctagtccatgacaccatcccccctcacctggactactgcagtagactgctggctaaatcccctgcttctcctgcatcccaccattcattcattctgcactcaacaaccactgggatctgcaaacatctcaaggtcacctccctcccttgcctacaccctctggtggcttagaataaaatccagactccttcccaaggacttcctgtggggccctggtctgcctcctc

SEQ ID NO: 26737 - DNA, 1050 bp, Homo sapiens
gaatgtgcatagtgactttattccaaatagtatagtatggaaagagggggaacaaagtaacttcacagtagagaaacctgacaaacactatggcagtcaggtgatcaaggtcaacatcaatagccacaagtcatgttgataatatgtaccctcggtatgatgcgtgagggtggcactttacctctgtggtcttcctcccgaacacataatgctagtccaaccatgagaaaaatgttagacaaaatcccaactgagagacattgtacaagataccttaccagtactctttaatactcccaaggtcatcaaagaccagaggagcctgagaaactgtcatagccaagagggagacatgacaattaaatgtaatgtggtttcctgtatgggatcatggaacagataagggacattaggtagaaactagggaaatgtagataaagtatggattttagctaataatagtgtatcaatattggtttattaattataacaaatgtattatactaatgtaagatgttaatctgtgtgtgaggtgtacaagaactctctgttttatccttgcaatctttctgtaagttaaaacctattctaaaacaaaacatttattaaaagaaaatatgcagtcaggattcggggagatttaggaaatgtttccctggacaatttgtttccttgttatctgataaatgacagcccccagggtaaattttggtatgtatatgcctctgtctgcacttgaggtcattagagtaataagtgtatatatggggttaattctgtgggaagtccaaattagtagtggcattggtatatataaagtattattttgtgttgcttatgtcaactgtgttgtctatgagggactaatactttgcaattcatattgatatcatttcagtgattatattttacctgtcaccatcaaagtctttatttacagtagattagctaaagcataaagaaaagggagtttattttaaagaataacgcatcggccgggcacagtggctcatgcctgtaatgccagcaccttgggaggccaaggcgagc

SEQ ID NO: 26738 - DNA, 1040 bp, Homo sapiens
gtcaagtttattcacttgctttatgacataactcagctctttgcccagctatacaaacagatctccagacagattattggtcaatagccagttttgtacaaattcattagtaaaatctcaattcatttccctgtctttagtattcacctctatgcagataacaacagctaacacttacgtgggatctcttatgcaacagtcactgcataaagtgccataaacacactaactcagctcatccacacgtgtggccctgagctctcaccccaattccagccctgtatttttcagtctctagggcattttgttagctgtcatatccaagtcaatatgtataaagtttcacatgcccttgtccacctgcatcacttcccacactcttcatagcatcaggtagatagacttggctcaaatcccaaatctactgtcactggaatatgacttggacaggaaactgcaccttcattttctttagttgcaaagtggtgtgtgatggtcctagtaatacccgcttcgtagacttgtgaggatttctcaagatcccctgtgtaacgtgcatcatctgtaatgtacagcaggcgcttaacaagtaagacctgttgttattgtttaaatacactttatattatcatcatgcttcccattcttctttcttgcttatctattcttttcccagtgcatatttcacattgtagatgtttctctgagtcactcactccagtctagtccttatcccctcaggcttcaattactgcaacaactcctaactggggctctttcctcttgcccacccttaatttactcaacacactctgaaaataatttcttaaataaaacaccatttgtatgttattcttctgctcaagaacctataaaggcactgttcactgcatcatgcccaaactcctctgctaggttttaaaaattcttgtcataatttggctccaacccttctgatcaatttcatttcccatttactcccagcactcctcctccactctaggctagcttggttctcttggtgtcttctgaacacacat

SEQ ID NO: 26739 - DNA, 1027 bp, Homo sapiens
agaatgtaagctccatgagggcaggtggttttctttttgttgaattcactcatgtatcctaagatcctggcacaaagtaggcactcagtaaacagttattgagttaattagtctttctaccatctcgttagtccgattcttcatgaagttatagcctaagtttctcctttctaaacagtttcagggttgagggtagaggtggcacattggtgtatgttaataggaagaagttctagatacacagctctacactgttgtgacatttttcacattaaatgaggcattttacattcaatgaaacatacctaataggttttaataaataggcttccaaccaagttagtttcatttggaccaaattcctaagtaattaggaaaaaaaacaaaacccatgtactacagtagttattttaatctagacaagttatatttgcatttatattgcactttacagtttgaagagcagcttataccaaaatttccttggattttcaaccaccatgactggtctgaacaagtattttcagtccccatgtgctccagttccagagaagttaaaggactagcttcagatcacaaaagtgattctctaagacctgccacccaggtcttctagcgtcctaccttaggtgagtagagtgctctttttaataagaggcttttggtatcaggtttaataagaggctttggtatcagggcatagggcttaatggagagggatggccaatgatacatgattttaggaagaagttctgcatgatggaaaattaattaccttctagtgagatcatattttaaaaatttgctttaatatctccatgttcagtggtttgttgaatacttttcattaagtaactagagcttttatattctgattaaataaatgagccggggcttgtaagatggggaaggcttttactgtcttaattaaataagattatgatttattgcatatgagatacagaaaagaaaccatcagaccaggcacaatggctcatgcttgtaatcccagcactttgggaggcta

SEQ ID NO: 26740 - DNA, 1036 bp, Homo sapiens
ggaggtgtggtaggttgtccttgaaatccagtatagtctagataagttgttttcaaatgctgttctgaggcaatgtttttatgggcttagaaaaacatagacaatggactttttattaatgcataggttattcaacgtaaggaattaaatggtaaagtggtgttaattgagctagtttaaaaatgtcattgataaataaaagttagttactttatgtcagtctgcaaaatgtttttggaattttattgttctttgaaactcaaaagttttccattcatgcttttagtgacagcaacaattacttagcatttactcttttttttctagcagtgggaattgtttctatgcagattatttgaactgctcacatcctttgatggtgtaagattgcatgtatgtatgtatgtatgcatgtatgtatgtaagtatgatgaagtggtccaacatactgctaatgcttacagtgtctggatgtcatgggatggggaagtaaactttgaatttctttccctcccctcccataaaagcaaaacattgatattcacagagttgtatctactaaaaaaacttgaagttctagagttgtgtagagcattttcacatatatcatctcatttgattcttcttggggtcacagaggtagcaccaatcatttgagaattttaattattagcaaaaggtttatataatctttttttttcttgaggaggaacatttttggggatgcttgatattggaacaaaatatgtggtagaactttatgtaaaatagaatccaagactcattattccatctgctgtcatatgtgtatagaaaagagtataaatgtaatacacaagggtggtttgttgtaacaaagtcatgtctctttgaaaggtcatacagcataatcattaactcagaatgattcagaacagtgaggttaaaataaataaaacccttgaggaaaagaactttctggaagaacttgagttctttaaaggaggtgttgagggtttggtcaacatcaatgtttagtttatagtaagtactttct

SEQ ID NO: 26741 - DNA, 1026 bp, Homo sapiens
taatgccatgaattaagaggagagcaagatggaaggctggaaggtcagttaggctattgctgtaatccaggtgagaaaggatatggtggtggtctggattctgtagggatggttatctgttaggcataatataattagtaggcagaacttcatggagaggagtttggtagaaattattttaatctattactgtccaggcctgagcttcataacattgtatgcatccctagaattctaaatgtccatacatttatttaatgagggttgcaaagtcaaatatttaccaaggcttgcttagcacaggaaaactaaataaagcaggcttgctgtaagagtgggaggttttggggaactggacagcacatgcaccctttaaagaggacaagtctattcagttgcaggcaagtgttgccatttgtaaataagaattattgccagatcttctgatttttttctttttccaaagtatcttagattcttatatgaaatctaatttttacatgttgatgtctaagtaaaaattaaacaaacttgcaaacagaatactgagtaggccaacattgttagagccaaataaaacaagtaggagtgggattttgtttgcctgggttcatttgtgacctccagctaataactgtattagttagggcaggctgatatgacaaagaaatccaataagaaaatggccaaaagaacagagatgtttgtttcccatgtgacagttccagtgtgagtgggccaggtggccagacattgttgctcttcatggtcactcaggtgctttccaaattgttatctcctagtgtagacttgttcactggcatggttgtagctggccatcaccatgtctggattccagccatcaaaaagggaaggagagtatggatgaacatgagcacactccttgtcctaaggccctggccatctattcataacaatgtaatatttatgtatgtttgtgtagcattcttttctgttaattttttaaatccttatagccatttgagcctggcatgaggggtatta

SEQ ID NO: 26742 - DNA, 1029 bp, Homo sapiens
agaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaagtaaaaaactttttttttgtttgtttactcatctccactatttattatatgttcttgaatttaagttaacagtactttttagatgatatactgttagcttaataacaactttttagggaaaaataaatgctgtaattaatgtgcacatgggttagtaacacccagcccaattgtgggagggaaacaagtagaggcttaggatcaaagaaataaaattgggacttattagaaattcttaccactgtttctactgtacacaaaactttctagttgagcagaatttgtatgcaataagtaaatatattgtatactccatgtgtataatttaaatgcattttatttttataattgaggttaactgtttcacatgcttaattttt

SEQ ID NO: 26743 - DNA, 1022 bp, Homo sapiens
ctgccttgtacatctcaacattcttgaaccacttaatgtatgtaacaagatctgcacttgagatacttcagatcaaatgcaccatctcttttctttagatgtcaagaaattataacttgaccctagagtttcacatttcttaataaccaaggaggtaacaataagcatcaaataattttgtatgaatatcttataaaaactaaaattgttttgcaattgggcttacagtaatttatttttcttttaaaataacaatctaaagatcataatttgagattgtctttagaccatttgagattgtcattagataattggtaataattctgacagctattcttttttgcggactttggaccaagtatattattgaaaaaaaaaaagtacttagcatctactttgtaaaccttaggataagatattgagtaaaatatacaaatccataccctcatgggttgggatgcttttttgttttaatgggattagataataaaataaatacataacatatacgggacattggctggtgataagtgttctggaaaaaaaaggaggaaaataaggaatattgggggcaggggaaagttgcagttttcaataggggatcaggtgacatttggctgggcaccatggtgcacacttataatcccagcactttgggaggctgaggcgggcagatctcttgagctcaggagttcaagaccagcctgggcaacatggtgaaaccctacgcctacaaaaaatacaaaaaatttagctgggtgtggtggcgcacacctgtagtgccagctacttgggaggtaaggtgggaggattgcttgagcccaggaggtagagactgcagaccctgtctcaaaaacaaacaaacaaggtgacatttgaataatgacctgaaggaggtgaggaagtaaaccatggggatatctaaggaaacaactttccaaaaacattagcaaacacagaagccctgaggcacaagacgttgtgctggttagacgaagagcaaaacagatgagctgtgtctt

SEQ ID NO: 26744 - DNA, 1009 bp, Homo sapiens
ggttgcctgttcactgtgttgacagtttcttttgctgtgcagaagctctttagtgtaattagatcccatttgccaattttggcttttgttgccattgcttttggtgttttagtcctgaagtctttgcccatgcctatgtcctgaatggtattgcctaggttttcttctagggtttttatagttttaggtcttacgtttaagtcttttatccatcttgagttaatattcatataagctgtaaggaaaggatccagtttcagctttctacatatggctagccagttttcccagcaccgtttattaaataggggatcctttccccattgcttgtttttgctgagttggtcaaagatcagatggttgtagatgtgtggtgttatttctgagggctctgttctgttccattggtctatatatttgttttggtaccagtaccatgctgttttggttactgtagccttgtaggacagtttgaagttaggtagcatggtgccttcagctttgttcttttttttcttctttttggctatgtgggctcttttttggttccatatgaaatttacagtagttgtttccagttctgtgaagaaagtcaatggtagcttgatgggaatagcattgaatctataaattactttgggcagtatggccattttcactatattgattcttcctatccatgagcatggaatgtttttccatttgtttgtgtcctctcttatttccttgagcagtggttggtagttctccttgaagagatccttcatatcccttataagttgtattccaatatattttattctctttgtagcaattgtgaatgggagttcactcatgatttggctgtttgtctgttactggtgtataagaatgcttgtgatttttgcacattgatttttgtatcctgagactttgctgaagttgcttatcagcttaaggagattttgggctgagacaatggggttttctaaatatacaatcatgtcatctgcaaacatagacaatttga

SEQ ID NO: 26745 - DNA, 1105 bp, Homo sapiens
agccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttg

SEQ ID NO: 26746 - DNA, 1147 bp, Homo sapiens
gatttctgggttctctattatgttctattggcttatgtatctgttttatgccagtactaaactgttttggttgccatatctttgtagtgtattttgaagtcaggtaatgtgattgcctccagctttgttctttttgctcaggactttttttgctatttgcagtcatttgtggtaccatatgattttatgattgtttttcctataccagtgaagactctcattggtattttgatggggatttcattgaatctagacattgcttgaggtagtatagacagtttaacaatgctaaatcattcaatccatgaacatagatggaattgctttctattttttcgtgtgtctttttcagtttctctcattggtgttttataatttttcactgtggagatattttactttggttacatttattcctagatataatttaattgtaaatgggatcactctcttgatttattttttttgttttttgtttgtttatttgtttttttgagatggagtctcgttctgttgcccagacaggagtgcaatggcatgatctcggcccattgcgaactctgcctcccaggttgaagtgattcttctgtctcagcctcctgaatagctgggattacagccgtgtggcaccacgcccagctaatttttttgtatttctagtagagatggggtttcaccatgttggccaggctggtctcaaactcctgacctcaaatgatccacctgctgcagcctcccaaagtgctgggattacaggcatgagccactgcgcccagccctcttgatttctttttcagatttttcattattagtgtatagaaagttactgatttttatatgttgattttgtatcttgaaacttttactgagttcaaaaaaaaacaattctaacagttttttttggtggagttttcaggtattttttaaatctaggatcatgtcatctgtgaacaaggataacttgaccatttcttttccaatttggatgtactttttttctttctcttgcctagttgctctggctaggacttctagtactctattgaataagtagtgaaaacagacattctcgtcttatttagatcttggaggaaaagctttcaatttttttttcccattttgtataatgttagctgtgggtttgtca

SEQ ID NO: 26747 - DNA, 1161 bp, Homo sapiens
ctcctttctaatatcaaatagacttcctaattatcaaaaagttgtatttatggtagagataattaaggatgaatttctttttaaaatattattttggcttaaatttctttagctggcatgatatggtaataagatattctacttaattaaatattttaggtagtaaaggagcaaaatagcattcactcagctgtcaaataattagatatgtgggaaagtatactaaacagtaacactctactttaatgcaatttgcatggtggttcaaaagattctttaagatcttgagtgcctttaaggtttaccattatagaaaatcaattattatgcttagagatatgcataagtgctcaatttaataaaatgtaaaggagtttagaggaaaataaccttttttttcaataattgttttaaactaggtgacagttaagacttccttttcacaaatacttggacaggtaagagagattcctggctggttgattatttactgctttatgaatagataactctaaggaagggttgtagactttttccataaggggctggataatcaataattttttgcagaccacatacagtatcttttgctactgccactgctgtagttgcttctgtcttcttccttttttctttttcattcttcttacacttgaataaaatccaaaaattattcttggcccacagaccatatttgcccacccctgctttaaggtgattctttcatgtttgatacatccaaaaaatgagagctgatacctgattctcaaacaaattaatatttttgcctaaatgaatttcatggtttgccatggtggcccccatctgtaatcccagcactttgggaggccaaggcaggcagatcacttaaggtcaggagttcgagaccagcctggccaactggtgaaaccccacctctactgaaaatacaaaaattagccaggcgtgctggcatacacctgtagtcctggctactcaagaggctgaggcatgagaatcacttgaacctgggagacagaggttgcagtgagctgagattgtgccactgcactctaaccttggcaacaaagggagactccatctcaaaaaaaaaaaaaaagaaagaaagaaaaagaaaaaagatttcatgttgctcatactataaattcatagtacaataaa

SEQ ID NO: 26748 - DNA, 1028 bp, Homo sapiens
acgtgcccagcctaatactttcttatgattagattgaggttatgtatttttgccaaaataccacagaagcaatgaggatttcctactatatcatattgagtatacgtgatactgatatctctaattactagttatgttaattttcctttcttggttaaggtggtgcctgctagatttctctgctataatgttattgctttttccttttgtaattaataaatatctggggtgacatactttgagaatatataaatgtcctgtttttctttagaataacccactatttttagcatccattggttcatctagtacttagcaaatatcactctggtattctacatttagtggaattcttcctgagataaagtagacccttctcccccattatttatttattcaatttttatttatgtcactatggactcagaggtatctattttattcattgggctataatccaattctatcattatatatatttttgcttaagttattctagctttgaatattgggaacttttttatgttggctcctgtgccctttaaatattttttttacattttatttatgaaaagaatctgtgttacttggcaaaactttaggatttttatttttccccctaccctttgttttggtacaaaactacccagaacaatacagaaatgacaattctgaatcacccatatcattgaagataagaagcttgtaaaataaaagatctaccaagaaagtacacctttctgaaattggaattatatacctgacttttttaaaagcagatagatgtgattggaagtaataaaatttattttgtctagagtttattgctgggagattagatttttaggagttaactccatacagaagtgaaaacctgtaaataaatttttaattattggcattgtcttaatgctaattaaataatcagtatgtttttaaaaacttccttgatattctaagtaatacagtactttgaattcaacaggattgtcttcaaggaaagtggtgttaaatacaaatggcctata

SEQ ID NO: 26749 - DNA, 1046 bp, Homo sapiens
tatttctccagcaggcttttatagtctaattagactatctttaataaatacaggatttttcaaaaagatataaaacaaaatcacattttccttttgactatgaaagtattaagagacatagtatctaaatctttaactaatcttgaattagcctaggctgataatactttcatccatcctttactgtccttcttatgcaaacacctaaagctaactataaaaaaactgctatgaatctgttgttctagaaatggccctcgaataatttatctattaagttaggcttgtatatcaagttttctcagcatagtatctctccttgagaaattcttgccacttaagtataggcagaattatagtgtaatagatgatactttctccaaagctgaggtttatagacttttattttccactcaaacatcaagtaaagatactttactgtaaatttaacttactttttctaataaatcaatgttttatatttcagtttgttgtagattgtgaattctttaaaaaagagaaaagatacatacagcttcctgtaactcatcttttttcctttggtaagtactttgtttttggaaagcataagaattgcttttatttttaacagagttgcagtaaagcagagctttgtaatatcaaatgttgaatatttcaagtatagttcttagaataactatatgatgtggttcagtggttttattctcattgggctagcagtcatattctgagaagtgaacttccataatcacatacatttgcaggtaattgcgtgtgtgtatctatgtgtctgtgtgtctgttcttatgtgaaatttatcctattggcccttattaatacaattttaatatagagttataaattatttgtataagaaggtttcaagatttctctaaatattcttttaaactttattttgaaataattttagatttacagaaaagttacaaaagagttcctgtatatccttcacccacatttccctaaggttgaccttctacataaacacaatacaatttttttaaactaagaaattagcattg

SEQ ID NO: 26750 - DNA, 1035 bp, Homo sapiens
aattcaacccctgacctcatgtggtgagatgtagtcaaaacagtcaaaattttgtttcatgcacaaagttattaaaaatataaaaattaccttaagactaagtgtgtaagatatgtatgaaacataaatgagttttgtgtttagacttgggttccatccccaagatatgtgattatgtataggcaaatattccaaaatctgaaaaaaatcaaacacttctagttccatgcattttggatgagggatcctcagcttgtactagggaagtgggaatagaaagaaaagaatggtgattttgatagaattagtgggtaagaaagaaaatggaggtaaagggcccttcggactccccttttcctatttcacccagcaaacttactcttcaagatccaacccatgtccctttttcccttttccagagtcccccagtaatcttttacttattctcatgatactttataacttctttgaaaaatttattatattgaattataatttatttatgtctcagttgccatgaccacattgtgaactctttaagagtaatgaacagataggttttattctactttgcatcctcaaccttcagtgactactgcataaatgctcaagaaaatgtttattgactgagaaggttcataagatttgtagccaaaataatcagaaaaatgtaggagaaatagagaaaggaaaagggggatgtagttgggagtcatctcaatgactaaatctcacaagtaccttataatggattcattgttctgttttgcttagctcaagtaagaggtaattcagcatctgcaatactaaaacctctcttaaagggtttttctggcaggtaagctggttttgaatgaatctaacatttttctcaaacttgaaaaggccctctctggttattccaagaaattgatgagtctttctgcaaatagacagtcttagcagcctaataaatatgtaatgcatcttaatgctctttggaaagtaacactgctgactctactgttgtacaaccccatctcactagaattataa

SEQ ID NO: 26751 - DNA, 1032 bp, Homo sapiens
atctcagagttaaggcagaggactttaagtctctactgttagtggttggtcctgttaaaaataaaatgccttcagagcagttgagaccatggcaacctgacctcattattgtagggaagttgtaacaatacaacttccttattgcagttgaggaagggaagtaaaatggagacagaattatcagctcaggtagaaaggataaaaagaagagctcctgtctgttcagcaaagacaagacagccatgaaagtatcataggacaagcttgtatagcccaactgcttccctcttaccaaaatagaaaaggaaaaaaaaaaaagaagaaagaaatccagcttatggtttaaactgtgcaattatagaaaccaccagaacctttgataattctttggcattttaataaaatccaccgttaatatttaattttaataattctagttattctttccaaattcagcaccctctctgagcacaaacttggaaacttttttcaaagctgttacaatgaataaatgcggaaattaagctctactaatttttttttttgcttaggcataaaacttcctttttatagctcttttatggaattgctaggaatttgtgtgtataaactatttacaaatagagggcttgctttattattttaggaccaagtgagatctcagtttgtgcttggtgtgttgttagaattaaaagggcattcatcgagatcatgtcacttttcaggcatatacttaaaaactgaccatcatagtctgggtgcggtggctcacacctgtaatcccagcattttggaaggccgaggcgggcatcacctgaggtcaggagtttgagaccagcctggccaacatggtgaaaccctgtctctactaaagatacaaaaattagctgtatgtgtggtaggcacctgtaatcccagctcaggaggctgaggcaggaattgcttgaacccaggaagcagaggttgcagtgagccgagatcgcgccgctgtactccagcctgggcaacagaatgagactccatctcaacaac

SEQ ID NO: 26752 - DNA, 1015 bp, Homo sapiens
caccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacagcaagaagagtagcctcaggggatgttcccctcaaactagcacaaccattccatcatcgtagaaaagtagcacttttgctaaactgtcttgaatattttgtacttacatagcgcctttcatctcttgatttctcaaaatgctttatgaacacatttaaagaaagtggtttaagtcttgtccaacacttgacaggtctgctgtgtttagcaagtgaggaatttaactttacttcaaaactgctttctgcctattaggagtgaggatacctaagtaatgctgatagaacaggacaatgttgggcttttctccatgttataagccactactcagcaatgcatcagtaaatacctattcacccactgtatgccagccactgtgcttatatgcaggggatgcaaaggtgcatgagacctgccctctacctttaagaacagtataatggagaaggggagacaaaccttgtgacagattccttatgtactgtgataatacacagtggcagcagctaaaatgtctaggtttgcttagctttgtattcag

SEQ ID NO: 26753 - DNA, 1050 bp, Homo sapiens
tagttgtcaagcaaatttttctagaatgcaattgaatttgaagtaatttttaaaatgctcagggggttaccaaacgatattattctacctcaagttttaagatttgatgtaaaaaaacagcaacagatgtttgggtggttagaaaaggttgactcttagtgtatttcaactgtgcagtcataaaccaaatgaatatgtcttttttttaaatttattttttaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggtaaacttttgcatcaaattcttacttcttccccaaatagtttaatgtaaatagtaacattttaacattatttgttttattataggaaaaattgatgggacacttgggtgttgtattgtatgagtatttgggtgaagagtaccctgaagtattgggcagcattcttggagcactgaaggccattgtaaatgtcataggtatggaatttgctggttacataagactttttcttgttttaactttctttttcttttttttttcgtaagtaaaatcttatttaggagttgggaggtttttgttagctttttaaaagcacttcaagattgtagttaagtcgggggatgtcacaaaagtcttgtttcccaaaacccatttatattttactttaaagagaaaaaaagggtaagtttaggacctacatgagaggtgggagtagtcacagctcaaaaagctttgaagtcatggaatacaggaccctagtagaaatagtgtgtcaggtgaaatatattctgccatgttctgctgcggggtgaaaaggcaatcctaaagttttaatttagttttagaacaatatatatatatttaaaccttgaattagcgattatgacaggttttttgcttgtgatcagtttcaaggaatataat

SEQ ID NO: 26754 - DNA, 1866 bp, Homo sapiens
ctcctttttgttcttaaggcctttaaaatatgcttaaagcttgaagataattagtgaaattatgtgagggattatgttaacactatatgtgccttggaaatggaagatacttcagggaaatgaaggcatttagtacatacctctgtggttcgttctattaaattactcttttgagttaacataaaatttctatcacaggaattgaaattccagagtaatttggatggaaatgaactcatgctgtctatgtaaaatgtgtgtaaaagtaaacactaaaatattaaagtatggaaaatcttctttgagtaatttgctcattcaaaatgtttgattataaagaaaccacacctattactctgctctttttcccaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataaggtttgttctccttaatagtgtttctgatagtttaaagttttaactttttcagttaatcaatgttaaatttacatattctcctagaccttttcctttgcacaagtacacaccatacatgtacaaatacagttttatacagatgtacagatgttagtttttgtcatctttgccgtaagaggttcatattatttaattttttcatttgcttttattaaaattagattaggatgagaacatatgagaactaacgccagttagtattaagaaccagttttttcaccgatggtaattatggtgcagtatgttcatagggtgtataagttatttctttaaaaaatattgaatattagtgtgtcactaatagctctcttaaattttcatctctgtctggagtttgaacttgtataattaaaattcttaaacagttcgtcccttgattaacaaaagtcctgataattctaaatttcttatgtatgtttaattctgtacatgagcatttcatcagtaattgatgtgaaagtgtagcttcttctcttttctctttttcagatcctcgtggtcattgaaccgctattgattgatgaagattactatgctagagtggaaggccgagagatcatttctaatttggcaaaggtatttacatttaatttctagagaagaaaatttatatctgtttatggaattgattatggaaagaaatggttgaagattaatattaccaactcatgactgtcctttctttgtttacattttaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtaagttgtaatgtaactttgtctttttttttttttctttaggagacagggtcttactatgttgcccagactggactcaaacctttgggctcaagtgatcctcctgctcagcctccttagtagttgggactagaggtacacacacagcctgtccatgtttaataggacagctgtcctaaaatttgggctactgatttggggagataaatggaaaggcatagctctacaaactatagattttatgatgggtttgttatattatctgctgacaggctatggttcatg

SEQ ID NO: 26755 - DNA, 1045 bp, Homo sapiens
tgaactcctggtttcaagtgatctgccaaagtgttggaattacaggcatgaaccactgtgcctgacttaccctttgttttttattatggaaaaatgtacataacatcaaatttactttttttgttgttgttgttgagatggagtcttgctctgtcacccaagctagagtgcagtggtgcgctctcggctgactgcaacctctgcctccccagttcaagtgattcttttgcttcagcctcctgagtagctgggattacaagcgcccaccaccacacctggctactttttgtatttttagtagagacagagtttcatcatgttgatcaggctggtctcaaacaactttaaatgggtcaccattttaggaatattctattttagaacttgatagttttgagtataactgtttgagaataaagaatattattttaacagtgattaaaattgtggttttactcactctttctttttaaagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtagaactgtctcattggacataattgtttttttctccataaattatttaattttttcctttgtggtattctgtgtactattaatgtcaacttctagtaagaataaggagatatacaaatttaagtcttggtttgcgtttataatataaaagcaaataataggattgatcttaactgtcttttatctcaatgtatgtaataatacagtcttgtactatagattatataaaaatttgcttttcttggtaggtcacataatgagtatgactcctgaacagcttcaggcttggcggtgggaaagagaaattgatgagagaaatcgcccactttctgatgaggaattagatgctatgttcc

SEQ ID NO: 26756 - DNA, 1070 bp, Homo sapiens
gctttgtcttaataacagcaacaaaaaacctgcagaaaacatctcttaaccccattcacatccgcattcagctacaatcctgtttctatatctttttagaacaaagtgctttgttctttgtttttttcttgaggtagggtctcattctgttgccaaggttggagtgcaggggcgcaataatagctcactgcagcctccacctcctgggctcaaatgatcttcccacctcaaccccccaagtagatgggactatagacacgtaccaccatgcctggctagttttttatttttttgtagaaacgggtctcaccatgttgtccaggctgatctcaaactcctgggcttaagcagtccatctgcctcagccttgcaaagtgctgggattacaggcatgagccacagatgccttgaatgagttgtttgtacttgctttccctgcttacatagttctagtcttatgtaatttctagtctttttatgtagttctagtctattccacctaaaatctcttgtcaaggtcacttggcccctaattgataaatttaaaaagtgtattttcatttctcacatgatttagcataccaagaatatttgacatttcttcatacccttttctctctcagtctctgggttttagtctttcttgcttcccctcaaaatctcagtggctactactccttagtcttgtttgctggatcctcattcttcttacctctgaactttggggtgttatagtagtgctgagtcttttggattcttttccatctgtgctcaatccctaggatctcattcttgtctttatgtaccgtttgtataagatagctgccaaacttacaaatctgtcctctgcttctgttccgcagacttgcgtatttgttcagcttgacgtatttatttggctgttcaatgggcatttcaaaatcagtatttctaaaagaaaattattgattttcttcgcatacatgtcttctcagtcctgctcccctggtctttcctgtgtctgtttggctcaagcaaaacattaagggctgggcagagtggctcaggcctgtaatcccagcactttggga

SEQ ID NO: 26757 - DNA, 1052 bp, Homo sapiens
ttaaatgggatggtaaaaccccattttaacagtacagagtgaattaaatgtgcatccattatcactatgcatatttacataatttgtcagtataaataaaacaattttattatttttatcttttaccatttttctatcttgttccatagtcttaattgctatttatatgagttttgaagaaaaccctatttttcagtggaagcattatggttctccattgttgactgaagattttacttcacctccagtatataaactacagtgtgctatgttacgaattctgaacttgcttatcttttgtttagaaaggcattatgtaaaacgaaataaagacgcacagactatggaaccagcgagcgtagaaaggagatcaccagtacatagaaaagagaatgagcaaagtataaaataggatgttaagtggaagtgattgcgctaatggtagaaaaatacattgaaagcattttaaaggtaaatactcactgtttttttcagcgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagaggtaatttctttttgttttttgttattactgttaaaaaatttttttctgttatggactgtattagtctgcttgggttgccatagcaagataccacagactgggtgccttaaacaacagacattgatttttttcgcagttctggaggcttgaaatccaagatcagagtgccaacagggttggtgtttgttgagggctttcttgctgtgtcctcacatggcctttctctgtgccagcaagctctgttgtccatgctcttcctatgaggacatcagtcttactagattagggccccaccctcatgaccccatttgaccttaatttacctccctaaaggcccagtctccaaatacagtcacactgggggttaggacttcaacatacagatt

SEQ ID NO: 26758 - DNA, 1041 bp, Homo sapiens
tggcgtcctcctcttacacccccgacaggcgctttgttcagtgtttgggacctgctacttcagagtagcttctcttctctgaccagagggcctcgtttaagcggcttcctcagtaggattcgtgggcaagggatcggggaagcgggcgtggggagaaggtctcactcgcctctcgacactgtcgtccccatagtttgtgcagaagagggtcagaaaagcactgaaatacggcagccgcttttccggcagactgaatcgaatttggttaaaccgagattccgttactcctacccttgtgtgtcttcaagcgtcagttacttgtttatttttcttgcacgaaacgatttggggataaaatctggtagttgttttccctcccttagtcacttttagtataatattgatctttttctttggagactggttattggaggagcagatggaagaggaaaacataaattactttcattaatggccgaagctttcaagctagttgatcgttttatggaatacagagtgtgcaaattaggaaaacgttgggaatagactggagttcattaggaagtatccagagatgacagaaaatgggatcacttttcagaaaagacgaggcatgagaagttggaactgcattctttgatttctgacttggaatccgagattttcactgagaacgagacttctaagtcacttttgtttcatatgttctttctgggtatttggctcggtattagtctgtgagaggtaagagactgaggccatccaaaattttacagtctgataggagaaacagatgtgtatgttctcattctctcatgaggccagatgcatgcttaagtagaagaaaaagcagcatgttctgggaacctgggtaacggaatgattatgtttagggttgtttcactgaggaggttacatgaccgtgttttaaaaggatcagtcagttttaaatcgggaaggacatctgagcctgagaacatcttgtaacaaggtattgaatcgtgaaaggtgtgtttgagtagtagtccactgtagcaggaa

SEQ ID NO: 26759 - DNA, 1046 bp, Homo sapiens
aggataaacaggttttgggagtattcactgtaacatagcaccttcctctgactacttttttttttttttttttttgagacggagtctcactctgtcacccaggctggagtgcagtggcgcgatctcgactcactgcaagctccgcctcctggatccacaccattctcctgcctcagcctctcaaatagctgggactacagatgcccgccaccatgctcggctaattttttttcgtatttttactagatatggggtttcaccatgttagccaggatggtctcgatctcctgacctcctgatccccccgcctcggccttccaaagtgctgggattacaggtgtgagccaccacacccggcctcctctgactacttttatacaaaatctggcagtatttcactcactccaattatctagcccaaggacgcacggatttttactgttatgttttgacacgaagagtttgccaaagacctcatttctaagagcagagatactgaatagtagaagctgtcataatgatgacctactactgactgttctgagtgaactgatttagaccattatataaactaatccatacaaaatgtttctatcatgaagcaggcagtaaaagtcattgaactgttgcctctctgaaaatgttcaagggcttctggccattaaagattagtgtagactagaattactgacatattaagtgacaggcatgttttggtcagctaataattcacagaactgtcacatggcttctgttcttcccttataataatttttactgtattgggtaaaaaataataatttttactgtgttgtctattgggtattaaaatccagaacctggccgggcatggtggctcatgcctgtaatcccagcactttgggaggccaaggcgggcggatcacctgagttcgggagttcgagaccagcctgaccaacagggagaaaccccgtctctactaaaaatacaaaattagctgggcgtggtggcgcatgcctttaatcccagctacacaggaggctgaggcaggagaatcgcttgaacc

SEQ ID NO: 26760 - DNA, 1049 bp, Homo sapiens
agaaggcattgttttgggagggggttgtgccctccttcgatgcattccagccttggactcattgactccagctaatgaagatcaaaaaattggtaaaaagttaccttttaaatgagtttgtggcctgattttagtttttcttagaataataatgttgcagtcccctaaatggaatagcacattcatttcctgaataacagaagtagaatagtgctaatgtcagagctaaacatgcatcacatctttttcagaggaaatgatttgatctgtagtaggattgggatttccctacatcaatatcctcacaacttataaatgtgttacaatatttacaaatgaaagtattaaaattttgctgaaatttctctgtaggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggtaaatggttgaacactttctaaaaattcttttgttgttcattttgttaatgtatcctcacatcccaaatctttgattttgtcaccagaaaaatagtctaatagcagtagcaacagcaatagctcttgtgcccatcaacaattctcatgtacatttccagcacctagatatttaatactccactaaaaggaagcaggatcccttgagtagcagttgagtccatgcctggaggcaggaaaaaatcaggatggatctggaacaccctgttcctgcctggcagtaagaatactttccaagatacgcagaacagggttttgttttgttttgaagacagagtcgctgtgtcgcccaggctggagtgcaggcagtgacaacctccacctcctgggttcaagcgattctcctgcctcaggctcctgagtagctgggattacaggcatgcaccaccatgcctggctaatttttgtatttttagtagagacggggtctcatcatgtt

SEQ ID NO: 26761 - DNA, 1042 bp, Homo sapiens
tctacaaccatctgatctttaacaacctgacaaaaacaagcagtggggaaaggattccctatttaataaatggtgctgggaaaactggctagccatatgcagaaagctgaaactggatcccttccctacatcttatacaaaaattaactcaagatggattaaagacttacatgtaacacctaaaaccataaaaaccctagaagaaaacctgggcaataccactcaggacataggcatgggcaaagacttcatgactaaaacaccaaaagccaaaatagacaaacgggatctaattaaactaaagtgcttctgcacagcaaaagaaactatcagcagagtgaacaggcaacttacagattgggagaaaatttttgcaatctatccatctgacaaagggctaatatccagaatctgcaaagaacttaaacaaatttataagaaaaaacaaacaaccccatcaaaaaatgggtgaaggatatgaacagacacttctcaaaagaagacatttatgtagccaacaaacttatgaaaaaatgctcatcatcactggtcattatagaaatgcaaatcaaaagcataatgagataccatctcatgccagttagaatggtgatcattaaaaattcaagaaacaacagatgctggagaagatgtggagaaatagggacacttttacactgttggtgggagtgtaaattagttcaaccatgtggaagacagtgtggcgattcctcaaggatctagaattagaaataccatttgacgcagtgatcccattactggttatatgcccaaaggattctaaatcatactactataaagacacacgcacacatatgtttattgtggcactcttcacaatagcaaaatcttggtaccaacccaaatgcccattaatgataaactggataaagaagttgtgacacataaacaccatgcaatgctatgcagccataaaaaaaggatgagttcatgtcctttgcagggacacagatgaaactggaaaccatcattctcagtaaagtaacacaagaagagaaaa

SEQ ID NO: 26762 - DNA, 1105 bp, Homo sapiens
gaagaaaagatgacttgattctgtcctttagatgggaggattttagaagaggatttggattggttttcatgcctagagaagaccatcttataggcattaggtactgctctcctttcactcagagtacgtataccactagaataaagtactacatggtattaggaaggattcttagcaattggctagagagcaaattatgttgttcttttgctaggaattgtctagagacagtaactctctgcctggagtaattagaacattttaggggaatacagatagttaggacagataactttgggaatcttttaatctcagatattatgtatattgcggttgaaagggacttatagccaaagaaaagtgtcagtataatagaaaaagctcagctcctttgctaacttgtaagacagtttcactttagagatgcccatttggacattcactgttttgactgctctttccttacctgttagaagatgctagaagatataacttaaccatcttcatgtagatgtcatcatggtgcccaacccactatggtacattgtctgaccagaaactatatatttcactttgtagataatttctctgactattacttctcttgagaaacatcttcctagtctgtcatgggcagttgccttgtcattgtcccctggaaaccttctttatcagactgacaactccccatgtttgtaatttccaattcggaggagaatcctccgaattggaattaagaggagatgctacatgtttccagttcaatcttgaatccaaatagcacctttgtgaggaacttgtcaggattcagttaattaatccatgtgaagttcttagaactgcctggcacagaataaacattcagtgaggggtagctattcttactgttctttctctgtttcatgtttggcttctctgtacatatgtattactagtgctcagttctaggaaacaaaggggagtgaagcaggctagttggttggacctaaggagaagaacaaatgcaatcatgcagaaagattatagtaacttcaaagtatagttttggaaaatctctttaaatctaaccagtgcacagtggaaaatccctgaagaaccaatctaa

SEQ ID NO: 26763 - DNA, 1032 bp, Homo sapiens
ataatgacaaaaaatagttgatacatgttaggtacagatataaccattcttttttttttctaaatatttttgattgtggtttgttgaatccataggtatggaacccatggatatggtgggccaactataaatgcatatatgtaaatgatatatttatttcacaataaatatattttcaaaacagaaaaataatagaatgccaatgttttatatacttttgcaaatattttaaagtctgacttaatgaaagacaactggattttcataattgcttcagcatttaatctaatacaatatgtggttttggttgacgctggtgaggcaaatccagcctcaggtagatgtgtaattacaataggaaaaaatattttaatctgcatttcagataattgtgatattcttctttgatactagagcaacattctacaagtggtagtttcttaatggttagttgcaaagtggaattgaatctaaaactatattgatgaacttttcatactttttcttttacctattcataactttataacatcatgcatgcatttggaaaatactggtttactgtattttgtaaggttatgcagcccttacaaatgttggcacattttattatatgacatatttaaaagcaaaaccaaacatatttgttaaatcaccactgatatcaaaaaagttaagtattgggaaactattaagcatatggtggccactacaagtttttcaaaactctaatttttgcttgaaaggttaaaaggtataattggcaacaaatgctgtcagatatttttcctggagtgataggctcactttagttttaaaacaatgtcaaatatgcagatccgaataaccatagtttgtctttagttgttctttcaagtcaaattgatactccatgacaaagatgggtggctcagctttcaagtccaacaatgacacaagtgctgtttctcaagacaaccatcttccctcagtatgctacagaagtacttcatatgcgcttcccatttcttcacacagtacattaaaaagacg

SEQ ID NO: 26764 - DNA, 1052 bp, Homo sapiens
tgggtacaggaggatgacaacagggcagctcccagcctcctgtagtagcgacagctctgaagcataacttccactccagagcgctctgcaggaccaggctgaagctgggactttgcttgcatttcttctcttccctgtcctgcttctcacactccctcagcagtttcccttggaagtccatcttaataaatcactggtgtggtagtctctatctgaggatctgcgttttatcccagattataggtccacgccatttccagcctaattggtcatgccatagggtagtagtttgagtaaaacctatctatagttttatgtctactttctctgcaagtcaaaagccatatgttgttatggaactagtatagaattttttactcctttcttttgaaaatattatcagtattattgtttaaaacctatgccccctatagctctgcaattcaatgggtcagtattgatatagtccagactgacttatggatattgaatgtggaggaaagagagagaatgaataaaaatgagacagaaacagacgttggatgtaaggccttatgagatttaccaaacttgacttaaatgaaaactgtccttactgggtccaaatggtgaattatgtgattctgtggctttgagagtggctttgcctctcggccctactcctcctgtgctcctgcagtgatgcacatagtgtctgtgggaataagcagctgtatcaggtttccttttttttccatattcgttcttgcttatatcctgaatttattttagtgctgacatagtttgacttactaggcctatgtacatgaaatatgttgcttgactatttaatttgtttacatctttgccttttgacagtgtgattatgaattccaaccttaagcattcttttgccctttgttactttgtggactttaaaaaattaatcagggatttatgccagtatggaaaggtttatgacagtattttaagacttaatattactgagggatggttgtagaatgcccactgacctataataagcatgatttcataaaatatgtacagcgaat

SEQ ID NO: 26765 - DNA, 1028 bp, Homo sapiens
cccctagacaccatctgaagctgtatgagggtgtgagtgggtgtatggcaggaagggaggtgggtgggagggggaaggctggtgtgtacacctggtggaagtaggcaaagtcgaacctattgcagtaattgacggaaatggaatggtgagggaagtgaggccctggctttgagtggcacaagtgagaaagacaggaagccaccaatgcaagaggttcaagcagaggagagccatgagacttggtgagagtaagtaggggtatgagaatgagaaagagacatgcaagcagaatccaggttttgagcttaagtgactcttgatggttgtgacagaaataagacaataccaatggagacgaaattgctgatacctcagtgagaattttgacaactaggtagaaatgtccattaggctgtttgacatgtgaaaccagccgactaaaggacaggatggagaataaatttttgagcacttttttggatgacaattgaaatggtaccaaatgaacattccttaaagaggagagcaagagcgggagagggctggaagctttgagaggaaaagggccaggagttaagaagatgcagctagagagagtgaggtgtcactgaagccaagggaagatgagttaccagggggaagtgttatcaagggtgcagtggaggggcaggggagaggagagggaattggaggctcttggctttggcagaaaggataccataatgacattggagggagctgtctctctgaagtgtgagaacagggaagcctatgcatctactgagggaggggtggcaaggacatgagaggaaagagtctaaacgtggctaactgaagcatgagggctaagtgtaattatcagaaagaggatggagccagcagttttgaagaggaagaggagtgataagcaagagcccaccaactaggagggaatggatttgaggctcagataatgcagtgcctttgaaagaaagagtaatagtgatgttttcttcagaatctgggagaagggcaaggagatgtgtaag

SEQ ID NO: 26766 - DNA, 1050 bp, Homo sapiens
aggtgattcttcacttgagtttggcaattacaaagggaatgattcagtggatagttcatactttcttgaacaccccagtggtctgaagttcaaaagagcagttttgaaggtggaagaaaggtatggagaagtccataaaagtgccacaattgtagcctgaggcatatatatatttaaaacagggaagtaatgatttagccgttctctgtctggccagatgcttggaaagtacagattgtggttgtgtgtctgcgtatttatttttgatttcacctttcaaagtgtgtttaagtgctggcacctcttccttttcctctgatgtctctgtgagtaaccacttgcagcctctttcctctgccactggctgtcctgagcatcctaatttagcagaccttaggcatcgtcctcccttattaaatagtccttagctgttccaatttgaaaaccttatgattgcatctttctgtggcttacttattcttacttgaggaagagttgaaatacctaaggtcggcttttgattgcaaaaccccaggtgctcagggttttgacccatttaaataagtagaggtaccagtacctgccttgtgcatctcataggtgatcatgatgttcaaatgggatgactaaagagacagtcttgttaactgaaaactgtggggttttttttttttttctttttgcgacggagtctccctgggttgcccaggctggagtacagtggcatgatctcagctcactgcagcctctgcctcccgggcagaagcaattctccccgctcagcctcccaagtagctggcattacaggtgagcaccaccatgcccggctaatttttgtgtttttagtagagatgaggtttcaccatgttagccagactagtcttgaactcctgaccccaagtgaccctcctgcctcggcctcccaaaatgctgggattataggcataagccattgcacctagcctgaaaattgtaatgaaaagaacaatttgcaagtgcatgcaacttccaatgtgctccatctcctaaacatattctctgtgactctag

SEQ ID NO: 26767 - DNA, 1044 bp, Homo sapiens
gacaatgtctgttaagttgaagggaaaataatgagaaacctattacagaaatttgctgtgccatgagctttgttccagggtaagggagtctctggaagataggaaggctattgggtaagagcatgtatcctggaatcagggctggattcatgtcctggttgacaagcctctataaccttacctttatgagccccccttgtttggttagtaaaactgagtagtaatggttctgagttatataaagaggattaaatgattggaaattacataaaatgcttggcctaatgcctggcatgcaatgatgcaccataaacagtatcagctattattattgagatatgatgtgaactgaatgtgtgtgtgtgtgcctttgagggtgttttggaatttggatcctctgaagcaaagtatgctattaatatttttgcctcgaaaaaaatcaagaaggcatgcattcacgtataggcagctagatagaaaaggacattattctgaccttatgtttaggacttttcatggaggccattttaatacctacctgtaggtatgtatgtagatgttaaagccttgttacatacaaagttataaaatgcatattttgattatactggtgatacaaaggaactggacaaagaacaagttaggaaaagctgtcaataatttttcccaaatttcacaatcattcacaattaattttctcttgcattcacatggaagtcgaaatgggctttgtgtggaagtgtacaaacctctaacttgatattaccaattcagaaatttatccagggcttctgaggcatgtggaagtttggtccaaactgttgtatcatgaaaatcatgtttggttataattgtagatatgactagagaggcaacatgagtgaggagaatccagatcaggagccaagagccctgggttctaatctcagttcttttatgccagatatgtgatcctgggcaagtctgttcacttctcagggcctcgttaaactcttctataagctgggcatcattgtatttgcatgtttcacatagttcggaggg

SEQ ID NO: 26768 - DNA, 1022 bp, Homo sapiens
tgtggaacttacagtctagtgaagaataaaggtgccaaatatttttaagtgcagaggctctctgggatcatttgtagcagagggtgggtggtccctgatgccttctctgattgcggacactcctacagatggcaaaatggaggttcaaagagaataagtggccccagtcagtaagctaggacaaatttcctatcctagggtcttttggactatgtcagatgacttgccgtgttagcaggtgacattttagaagatccaagtttttgcttctttaagtaaaggcaactttcccttaaaaacatcctaaaaaatgtaatgcttacctcttttatgttgacttacaattcattaatgccaacatatgtttatacaggactttataattttcagtgcactttaactcatgttattttattgtaattaccatcttgtgagtcaggcaggggagtttgtttcttgttttagcttttaactccccattttatagaagagaaaataggggcccagagagggtaagcgagttatccacagatgcagagctgcatccaacagagggcagatccaagatctgggatctcttgattgccaggctgctgctcttcaaacaaaagtgggtatgtgacatacacacacccactgtattttaggcatcctcattttatggggctgtagccagagttgttagaacaagttaaattgacatgacctttgccttttggtggtttatagtctaaatatggtttaaaaaaaagcttcaggtttattaatacacaagaaactatttttttttttcctgggtattgtctattcagcctatgccaagtccttcacacttagaaggaaataaaacacagttacagtgcaccttagccctactttcctacttaaatgttacaatgttcctctttctctgcaacagtaatgagatttgccagtgaattgaagggaaaaaaaaaaggaatctgggaattttgatttttctgctcttttgaggagaattagtggattaatctagatgctcc

SEQ ID NO: 26769 - DNA, 1050 bp, Homo sapiens
cctcccaaagtactgggattacaggcgtgagccatcgcgcccagccatctttcatatatctttctaaagcaaaaaaagccaaattcttccatcatggtttcctttgggacttctagacctatagtaagtctattttaaaaaattatctgatacacttagctttgtgtgtttattcttttttcccaaattttgtgtggcttatattagttactattcattattgttgagttatttttcagattcactcatacttgaactgaatgactttgattataaattctttggatataaagagcactgtcactttaaattattctgtgaatagcagaagccagtgttgagatgataatggtgatatttaatatactatttttctctattaggcatatcatagatttaacaataattattagatttggagtctctgctagctgcagccttttccgaaattcaaggtatatttctgtgtagcgtatcttcacaaaacataaaaacactaaactgaaattaaaactgatttgaaagtatactagagaggattgtgaatatctatgaaagtacatgactttttttttttttaattaaacatttgtgatctctgcctactccatttcctagcaccttttattttgttattcttctttaggtaaacagccattcaggaagatggtttgtgcaaaaagaatgaaaataaaggcatgaaggaaaatgtatgcactagcatcttctgtctctccctctgagattttatgctctgcttcaaaaaccagtttaaaaataaaaaagatgagggcggttgcaatctgcttcattttatgcagattaggtatggccctcgggtacctgccaaattgctaatatggccttccgttgggcctgattagtgtgaacccggatcttttccattaaagcagaaatgaatttgttgggaataaggtaacaacaaaagtgatattttcactaataaccgtgggtcaggttacattaaagcagtttctcagtgtgtacctgaggcagactaccctcagcatttatgatttcctccatcct

SEQ ID NO: 26770 - DNA, 1049 bp, Homo sapiens
gttttacatgacatcatctcccacagcagttgtcctgtgtttttctagatcatcattgagttcctgacttcacttaataactttgtcaaagttagaggtttcacttatcttagatctcctgggctgtaacctctttgataagattcttagagattcctacttgtttctctgcttcattttcaacaatagttacctagtcttaattaagattatgagataactttcagatcctggcctcacctcttattagggcatctgacctcagggagttacttaacttttctatgtttctttcttttcttctctctcttttttttttttttttttttgggagacaagagtcttgctctgtcacccaggctggagcacagtggtgccatttcagttcactgcaacctctgcctcccgggttcaagtgattctcctacctcagcctcctgataatttttttgtatttttggtagagatgaggtttcaccatgttggccaggttggtcctgaactcctgacctcaagtgatctgcccacctcatcctcccaagatgctgggattacaggtgtgagccgccacacccagccaacttttctatacttcatgtgtaaaataagataagaaccctccttactttaaggcagttttaaggattaattgagatattattttaatgataagtgacattgtacacaatgaatgttactcttattactattatttctcatgatgatgcccacctatcttctttttcataattgtgatcatacgaatatttccacagcttcacaactcttttaaatcatctcccctaacatgatttcatccatggaattacacccatttttttttcagcttttcagtgtcatttcctaaactataaaatacatacgtcctctcagaatgcccttattgtacctttcagaagaagtggtctttggtacctcagagaaacctgtggcttcatgtctctcaaaagtctattcttctgatttaagcccagcatagttcaccttcataaatgtatttattatattatgccttccatgatgagtac

SEQ ID NO: 26771 - DNA, 1211 bp, Homo sapiens
tttgctctgcagtgatgggtttctcactgagctgcccagaatcactcactcgatgccttttgggatcgatgacatttgatttgtaatgagtgggcaggaatgggagtggagaccagatctttgggtcaaagagggaaaaaaggaactccgtacagcagatcatagtctcttttgcatctgattccagcctgatgaattctcacacacagggggcattattctatataactaagacttgtattagatgctttatgtaatgctttctttttgggtacattttctattacgtgtaacaaaacattgactgaaagtgtttatttaataagagttaaaatttactaaaccaaatcaaacaaatcgaattgttcaaaaatgtttggatgtagaagcaaaccacgttaagatttgaaaataaattcacattttacattagtttttaaaataaaactaataaactaataaaatgtgaaaaaatttcacattttatattagtttttaaaataatttccttttaattttgaatatagtgaaacgtagatggtgaagaacaaattgattgactagtttctttcccctaagaagtggataagcaattgatcacgatgacttcgctcacttaacagatcgttggccctctagttctgtgtcttttacaatctggttctgactgagggcattgtagtatagtgcagtggttaggcgttgtggactctgactgccgggcctttcatcttggtgctccccacttcccagctctgcgattctctgcctcagtttcctcttctatgaaatcagggtagtaattataattcccccttgtagggttgttaggaagattaaatgaaacaatccaaataaagtgctttacattgcccttgacacagggtaagggctgaatcatgttagttgctattatgattccagttgttgttattattactttacaatgcagaagccagatacagtgtgtcaatttcttttgttttctgtagcttcaattcatatgagcccttattctgagatactggatgtgaagtaccaatcttaaattttcttaaggtataggtagactaggtcttctggtattcatgtttttaaattgacaatatcctattccatgactgcatcaacttagaagaatgttattttcttttttgtggataagttgttctgcactacattgcttctttccccttttcttcagagtactt

SEQ ID NO: 26772 - DNA, 1400 bp, Homo sapiens
tagagggtgaagactctaacttgattttcgggatacctagcagttgactaggtagtgcttgggggtaaaagctgttgagggcaagaaatgaatgtgcgatctcactttacctctgaccttgaattttctacttgaatgcccactaaaaaaagtcctatcagtggaaataattcatttaaaaatgtagcttattatttcctccatgatgaggaaagtatttagcagtgttttcagttatctgttttgcttgggatgataggccatggtagcaattaactttgatatattttttaaactgcctaaagtccttcttctccagagcttaggcattaatgcccatgacctggaagggactggtcatctgagacattcacgtaaaatgatccaggttaaacagactgacctacagatatatacaacctttatttaataattaaggtatgtctcattaaaatatataacttctaggagtttcaagtgtgaaacctacaagcctaaaatttgtggtactctgatatgatatatatcatgtttaattttttgttctgctcccctttaaagcataactgtcttttactaacttatagattttaaatgtaaaatagagttgtttgctgaatagctaggtttgtttgtggtttaagaagatgtagtacagatttcattcaaggaactcatttggtaaaaaacacattcgttaaagcacttaaatttttcaatagtgctgttacttttttgatatattctttacatttaaacttgtccattgatataactcctagttttgatgctataccattattttccaactctaagtaaagtctattttggcattcataatggacagtaaaaaagtcttggccatagagcattttgtaatattaaaatgctttttaagaaattccctgcttcctattttgtctttttttcctttggaaaagatttctcatcatctgaatcttataatttcagttatttgcaaaattgtgaaatttcagaattgtaggtctttcacttcatatgttagtatatattttacattttaatactttgtccagattttctttgatacagtgttattatatttttacattcctatgggatcccagttccataactattcatttatttctgtagtattaagtgttcaatttatttattacttagttcaaatagcttagcatataagtgggacccagagctgtcggggacttcctttgtttacagtatgacagaagaagagctcggtggtggttttgagaggcaggagtgaaaagtgagcattctgctggctgtttggtcacagttgggcaccttaggttggtttcctaggtgccagatagattttgcgtgactgtgatgagcatttaaaacccagcactttgaaatgcaggtttctt

SEQ ID NO: 26773 - DNA, 1050 bp, Homo sapiens
tgcagtgagccaagattgtgatagtgccactgcactccatcctgggcgacagagaaagactctgtctctaaataaatagatagatgtctctaaataaatagatgtctctaaataaagactctgtctctaaataaataaatagatggacagtcagataattagtaagtgcagtcataattttggaaaggaattcagaaattcacctttttttctttttctttctttctttttcttttcttttctttttttttttttttttttgagagagaatggttaaaagatatatgttgtctggagtcaaaaggtttttcatgctctgaaagtttgacattttccctattgaaaatgtttaaaatggttcaggcgtggtggctgacacttgtaatcccagcactttgggaggccaaggcgggtggagcacctgagctcaggagtttgagaccagcctggccaacatgaccagatggccaaaccccgtctctactaaaaatacaaaaattagccaggcacagtggcgcacacctgtaatcccagctactgtggaggctgaggcaggagaatcacttgaacccgggaggaggaggttatagtgagctgagattgtgccactgcactgtagtctgggcaacagagcaagactgcatctcaaaaataaataaataaataaaaaagaagaaagcttttaaaatggtttaatcttgtcttgctttctctatttcttcctttcactctctctcttttctctactttttcttctttaaacactaaatgtttgggagactttcagcagttttttctttgtaagggcaatgttgaaaaaatatacgtatttagacattttaggccttagagctaacttttaacagacacgctgctttttaaaaaattctgtggctctctaaagagagctgaaaatgctaccccaaattgctgttaaccatgtctcagccctcattagagctggataggccgcaatgtaaaacactatttggagaacacaattcttcaacagaccccatgctttgtcctcctctgctatataaaattaaa

SEQ ID NO: 26774 - DNA, 1046 bp, Homo sapiens
gtgagaatgcataaggggaatttagattttgtgaacggaaaattagcagcccaaagtctcttttcagaagctttggcagcaagttccccgtctcccccactccccaagaataagaacagcagtgaaatgttggatctaacccatacattttaactcattattttttggaaaaaacagagaaataacctaaaatggtttcgagtaggagacctttatgcttaactcaaaaaaatgaagaaaagagtttgccttttagtttctattcttttctttgtagcaatttttaaatgaatgatttgcctctactgactttgattgtatggtcttttttcacttccaatcaacactgctctccagcattaatttagggtgccagtaaggagagctgtgaattcctgttattttaaaatgcaatagaggttttgaaaatgtctgtggtgaaaatggatttttatatacaaaagattcatcatcctactacttaaatgtaatgtgataaatatttcaaagtcaaagtagatgccctgagtggaactgaggtatgactaaaacaaaaaccagttgaggacttacagagtttgaaaaaagcacagttgtagtcattatagtatgctattttccgttgctctttattgttagcaattaaccaaacattatttttcttcttttatgtagaaacaagccctgtaagcataacatgctacagtgtttttgtaaaaatgttccatggtggagttttcaaaattatggaactctagctatatatatttgtttcaattaacagaattattttgctttttagtagcaagtgatttaagaattgtggtaaaatcagtataattaagtggcactgaaaggctacatcagaaattgcattctacaacttctgtatctttgctgctcaattaaaaagttttacttatttcagatttttaaaaaactagataaaaagacataatatggaacaagtgtgctttagatatataattatgacaatagagtttatggcatgcattttttttcccctttttaattgatgtccttta

SEQ ID NO: 26775 - DNA, 1031 bp, Homo sapiens
cttgaccttccaggctcaagtgatcctcccacctcacccttttcagtagctgggactacaggcatatgccaccacacccaagtaattttgtttattttttgtagagttggtgtctcactatgttgcccaggctggtctcaaactcctgatctcaagcaatcctccctcctcagcctccctaagtgttaggattacaggcgtgaggcactgcacctggccaataaagtatttttaaattaaggtatatatattggtttctgcagacataatactattaaacacttaagagattacagtataatataaacataacttttatatgcactgggaaaccaaaaaatttatgtgacttgctttattgtgatatttgccagcgatatttgctttattgctgtggtctggaatcaaatccacaatatctctgaggtatgcctgtaccttaaagcagtgttaatgaaacagaaatcacttagggctaaaataaacttaggagattttcttggctttatggtatctacaataccaggaacttctaatgctggagtccctacctgactcagagaaagaacatttcccaggctgggcgtggtggcttatgcctcaaatcccagcactttgggaggctgaggcaggcagatcacttgaggtgagaagtttgagaccagcctggccaacatggtgaaactccgtttactaaaaatacaaaaattaaccaggtgtggtagcgggttcctgtaatcccagctactctggaggctgaggcaggagaatcctttgaactcaggaggctgaggttgcactgagccaagatcatgccactgcactgcagcctgggcgacagcgtgaaactccatctcaaaaaacaaacaaacaaaaaaccaggctgggcacgtggcttatgcctgtaatcccagcactttgggaggctgaggagggcagatcacgaggtcaggagttcaagaccagcctggccagcatggtgaaaccctgtgtctactaaaaaaaaaaaaaaaaaaaaaaaaattagccag

SEQ ID NO: 26776 - DNA, 1021 bp, Homo sapiens
tatgttgaaaaactatataaaataggaagttgcatgatcttcttcttacttcatcttttgtagttttcaaaatgcaaggaaggtagcactagttaagaaaatgaaccttttttttttacaaatattttaaaggcatttatttttaagtgagtggaataaaaccatataaactgtattttttttttctaattaagcaatgtgagcacatttaaatggcctagaaaggtcttaggtaaaggaatctgagtaataaattttagacctacaccagggcaggactctacagatgctcgtttggccatgagtgagtgacatatgtttatcttctcacattattaaaattaatagtgtagggctgttctaagctctgtagttcctgggtgtaacttgtttttcctttcctctgaaaagattaattgttaagctgccaggggacaaggagacaaggtataatagcataaccaaaggtttaattaccgcctgaaaacttttgtccttcactttgaatttgcttttgtaggcttaagggggacttttaagaagcctggaccatgcttgtaaacttcaaaaataactctagggttatgtatggctgccacacaagggaatgtcagctttctcctccaggttacacatattcaagagagtcacaaaccaccaaaagctggaagttgttaacatctgaaggctgttggtggcctccgaaaaggagatggtggactcagaacagtttctaatggacaggtgcatgcgtctcaaaaacctctgctctgggcactaattggtctattctagttttaccagatgtcagatcttgacccaaacagtttagtttctggattttggaaggaaatattgacaaggcctaggtgatgagattgataaggaacaggatttagagccatatgatttggctattgaagaaaggagctaccatcttagactgagttaagggaattttggcaaattcagtagcaagtccaaaagagtgtctcttatagacatcaaaagcttgtgtctg

SEQ ID NO: 26777 - DNA, 1029 bp, Homo sapiens
ttgggagtagaggggaggtggtaatagacacacacaaaacttgttaattgctatacaagaagcatgtgctttaaaaatgacaataacaatcacaaaaccagtttatcattgttttacatatttatttagttcactactatgggctttttgttggggtttcccagagggaaactaaggtagaatcaggaacaacactgcccacatacaaagggggagtcttccaagtagtaagcccctgcctcttgatctcaactctagcacacacattggaaggcaggccctttgtctaatttgctcaacactgtacctctatcatctagagcaagaaatgaaggaatggatgaataataaagaataatgattcctttggataccttttaaatcatgttaccaagttaacattaatactcatagatagactgaaagtgttgtcacggatcagtgagtgacgtaggaagtctacacatggaaggtataatacttgagagaacaaagtcatggctggggaaatggctctctgacagtggccacttgggtaatctgaacttttccaaaatggacataagtcatggaaagaacagtgctctattcacttcagaaacctccccttgaatgtgcgtgaaatatgatagctgggcttcctttaaaattatactttgaagagcagggtagagaggacaggaaaattagatgaattagagatgcaataaaattggctttgtgttaataattgttaagattaggcatgtgggattcactttggtgtctgaaattttctataataaaaagtcaacaaacatacacatctccacttaagagcctgacataataaacatttacactgcttaatgtgtaaatatagtctaatcttagaaagcacttcttacatagattaagaaaatttaaaaaaagtttttcttcatgacaaaaaaaattgctttcagctctagatgcaacaaatcatgatagaaattggtactaggctgggtgccgtgcctcatgcctgaaatcctagcactttgggaggcc

SEQ ID NO: 26778 - DNA, 1034 bp, Homo sapiens
aaatatttttgctccacagaagtggaatcccaggctttactggcaatagtaaaaaaaaaatctatttagacttaatacttgaaatttcttgtggcttattctgagttcctttctgtttcctattgccacaaatagcacttttattaaatggtattttcctgtgttccatgaaattattagcattaaattcactccacagctgtgtctttcactgtgttttaaatacatttaaaatcacattttttttacagtgtctgggttttattcatggccttcagatgttctgatttcttgatcacatgttctacaatttaattgaatgcccgtatggaatttcagactactttcttacatttgccctctgggtctttcactgaaatgcggagatgcttattcagtttttagtagttaaccatcacttgtcaaaacagatcttatttcttaaaagccataattttattatcatttattttaccttttgagcctacagttagcaaatatatttgagtcaagagcagtggttctcaacgaggggtgattttgccttccaggggatatttgacaatgtttggcaacatttttagttgacacactgtggggtgagagttgctactggcatttagaaggtagaggccaagggtgctgctaaacatcctacagtgcacagggcagccccccagaacaaagaattatgtgaccaaaatggtaatagtgccgaggttgagaaacctcagtgtggagtctggtggaagatgtagatggaaaacatagcaggcaggcaggagtggtttacggagaccctcctctgtgttagttatctttcctctacaagtttacgaagcattatttttgatgcatcaacaggataacgatgatgatgactgagaagcacttgtaaggtcccaaggagccatctggtgaccagggaaaatgttcagtagggatttagggttgaatatattatatttgcactctttgctacagatggcaattttcaaataaccacgttattatgatcccatttccaagaatgg

SEQ ID NO: 26779 - DNA, 1659 bp, Homo sapiens
ctcctgggttcaagcaattctcctgcctcagcctcctgagtagctgggattataggcacccaccaccacacccggttaattttcttatttttggtagagatggggtttttaccatgttggcaggctggtctcaaactgctgacctggagcaatctgcctgccttggctttgcaaagtgctgggattacaggcataagccactgcgcccggccatatatattgtatttaaccttggattaagtgattgctttaggatcttccagctcaaacatcacattgcatatatatgtgtatatatataattttttggggggggggcggagtcttgctctgtcacccaggctagagtgcagtggcgcgatctcggctcaccgcaagctccgcctatggggttcactccattgtcccacctcagcctcctgagtagctgggactacaggtgcctgccaccatgcctggctaattttgtttttgtatttttagtagagacggagtttcaccgtgtagtcaggatggtcttgatctcctgccctcgtgttccacctgcctcagcctcccaaagggctgggattatgcctgtagcgtgagccactgtgcccggccaattcagatatatatatatcttaatagaggtgggatctcgctgtgttgcccaggctggtcttgaactcctgagctcaagcagttctcccatcttggcctcccaaagtgctgggattacaggtgtgagccactgtgcccagcctacattacatgtgtttttttttttaaagtattagtgttaactaactttttaatttctttaacaaacattgagtattttttttccttaaattttgctttgctttgcagccctagggtggtcccaaccatgtgatgtctggagcataggatgcattcttattgaatactatcttgggtttaccgtatttccagtaagtgacaatgatctatttcaaccttgctttgcacaagaaaggtgcctgtttatatgaataaatacttttgcttcccccattatagactattaattgtagataagcataaataaactaattcatatttctttcataattgttttatttaaaacatctttcagtatataagcaattatccgtgtccatgtagggaatcattggcgagtttgttctgcaagccttaatgttagtttttttgctgtcagctttaactgtgtctgttttggtggtcatcttccccaagtctgtttttattttatttctagacacacgatagtaaggagcatttagcaatgatggaaaggattcttggacctctaccaaaacatatgatacagaaaaccaggtacgttttaagagttagtgacatccttagtatcatttgatcacatctgctgattagaacttaattttttttttttttttgagatggagtcttgctctgttgcccaggctggagtgcagtggcgtgacctcggctcaatgcaagctctccctcctgggttcacgccattttcctgtctcagcctcccgagtagctgggactacaggcactcgccaccacgcccgcctaatttttttgtatttttagtagagacaaggtttcaccatgttagccaggatggtctcgatctcctgaccttgtgatccgcccacctcggcctcccaaagtgctgagatt

SEQ ID NO: 26780 - DNA, 1107 bp, Homo sapiens
ttaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctctttta

SEQ ID NO: 26781 - DNA, 1051 bp, Homo sapiens
gacatcaatagtgttagattctaaacagggcaggaaggtgaagaatgatctaaagcacaatgaaaaaaataaatacccacctacccaccctctagttagttgtcttttccactataaggatgtttaactataactccatatatttaagtatatatgactgtgtgcccttttgcctttttatacttatatatttaaaaattacatccaagaaataaattcattttttctttagcctctacaatagaagagttcatatacctcttatgaatgactaacgtacaggtattcttaaatctttcagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaa

SEQ ID NO: 26782 - DNA, 1032 bp, Homo sapiens
gtgctgacttatgttcatatccttttgaacttgccaggcctttcttttcaagatttttaccagcagtgtcgggaggcattcctcgtcaatagtgatctgacactccgggcccagttaactgaatttagggaccacaagcttataagaacaaagaaggtaagactccactattgtagcattgtatgccaggaatagtccgtatcatttacttaaggacacatatatgtttgacttagacctgattttgaaactgatgttccctgttgagtcacagagattcatttaggggatgtgccatttgagtttgtagaaagagccatggtagaagtaccctgcttcagagcagagcagaaaactcacatgttctagtccagagtaataggcaattagaaacatggtgagtcaaataattctgttcttttgttttttccctcttgctcattcattaatttggtctgtatttattgagtactaactacatagatattgcactaagtattaggatacagtagtaagcaaaaatctgattgcttttcttatggagcttaaagtctaatgggggagatggacattagtcaagtaatcgcacacataacattttaactgtaaggaagtcctatgattagaaggtacatagttctgaaagagtttatttaaataggtggatttgacctaattatggatagatatcagaagagaccactgagctgagatctaaaggaagactaggaggccaggcgtggtggctcacgcctgtgatcccagcactttgggaggccgaggtgggtagatcatttgagcccaggagttcgagaccagcctggcaacacaggagaccctgtctatgaaagaaaaaaaaaaaagagctggttgtggtggcacgcagctgtacctgtagtcccagctgcccaggaggctgaggtgggaggatcacttgagcctgggaggtgaaggctgcagtaagccatgatcgtgccaccacactccagcctgggcaacagagtgaaaccctatttcaaaaagaacaaaaca

SEQ ID NO: 26783 - DNA, 1004 bp, Homo sapiens
ctgagagcattatatataatgctttctgagaaatcctttggtttttttggtatccctccactcccacagtgtaataaaacatgcacagattcacctccaatctattgtatacatcttgcctatttcccatgccttattaaagctgctttctttaggctgagcacggcggctcacacatgtaatcccaccactttgggaggccgaggcgggcagatcacttgagctcacgagttctagaccagcctgggcaacatggtgaaaccccatctctacaaaaaatataaaaatcagctaggtgtggtggtacacgcctatagtcccagctactcgggaggctgaagtggaaggatggcttgagccctggatgtcagggttgcagtgagctgagatcaccccactgcactctagcctggacaacagagccagaacttgtcttaaaaaacaaaacaaaacaaaaagctgctttctgtagggcctgacttcagtgctaatcatgtctattttatgagtaaatgacatatcttctcaaataaattacatacccctaagcaatcattattttatcctatactactttattttttaatacctaggcattgtgtatggtagaggaaataatcactgaaatatcactaaaaataataattgcagctggacatggtggttcacgtctgtgatcctagcactttgggaggccaagttgagtccaggagttcaagaccaacctgggcaacttagtgagaccccgtctctaccaaaaaaacaattagccaggcatggtggtgtgcgcctagttccaggtaatcgagaggctgaggtgggaggattgcttgagtccaggagttggaggctgcagtgagctatgattgtaccactgcactctagcctaggcaacagagtgagaccctctaaaaataataataataataattggatttcttttctttttagattcttctttagaactcttccttctcatccacaatttggatagccagatgttg

SEQ ID NO: 26784 - DNA, 1023 bp, Homo sapiens
ccaaagtgaagacccatgtgtagctttttgctagagttttcatttcaaaaaatgatctctgattcatcagcatgaatttccaagtttggggtacagggcaatgcactttcctcagtttatttatattattgtttttaaaaatttgcaatacttaccaaagataaaggatttgttagaaacagcttttggaagaggagcagtgatataggtttattttactaatgataatagtaagtaaattataaagaacctttaatgttttctgagaaagtaaagcctattcttggagtttataatcatttaagtggttctggacaaaacttaccaaattctttactgttattactaaaaagaatgttaacaattttaagaaaacaaaaaaattattttttaagaattttgtttatcggttgatatactcattgccaaaccagattaaagtaatattccaattggattggcttcttctaagctctacttctaaggaaattgtttggattgatttgctgtctgtgctttgagaatgacttttttcccctcctccttttttttaaagcaaactttgcgtaacttattgagcaaggtttccccttccttttctgccgaacttaaacaactaaatcaacagtatgaaaaattatttcataaatggatgctgcaattacagtaagtattatcattacaaacccttgtaaaataaagaataatatttacatgaatctttatgttaaagtaagttaacatttttctttttacagtgagtttcagatatttagtcatatataaaaataaatgtaaaaatagacattatgactcagatatagaaatgtcactttattgtatgactcttcccagaaattctacagtttttaagaaatttgtgtttatcagacttgacagccattgataagataaatagcatttcttagaattatgttattggtttaaaaaacttgaatatttcctttgtcaagattaataaatataacaattagaaaaaaaaattataaagttttccacagc

SEQ ID NO: 26785 - DNA, 1049 bp, Homo sapiens
acttggaaaaggtaaatctgtttcttcatttgggttcattttccacatgcctctcatggtgtgagtgtgagagcatcattaaagataacacttatatttttttatttaaaatggcctctattataagtgatttggtctttggtctttagaaaaaaaaagcgagagaaagaaaattgttaaagtaaaaataaaatggcccctaaacaaaagaccactattccatttattctcggttgaagaaatggccatctgttcaacactctattttatgtattatttatatgtattatagactttttggcacaaaataaactgttcacactttatggaagatttaaaagattttaaagtataattttaactctgcacagttttcacttgattttagatctcactttctggcccttctttctcaccccccatcaaagatgtgcctcaactatatatggtaagaaatgaaaggaacataagtggttgatggagaggagagtatggtaattagagaaagcagcaaggtcaaagttagttatttgtattttcttttaaagaaatctgtgggtaatatgaaggaaaatttgaagattctgggaagacagctaataaaggtgaaagcagtattactcctaatatgggtaggattatttttctgataaaagtaacagaggtttttaaagaatttttgtaagcgtaataaggttatttccctctttatctactgttgtcctttaaaaggtttttatatatttctttgtttacagcttcagaactagcaaaaacaccacaaaaaagtgtttcattcagtttgaagaatgatcctgagattacgataaacgttcctcaaagtagcaagggtaagacattacattagttctttgaaaagaattttcatagttgcttcaagatagagcatgttacttttttccttgtttgtgaatttttatatatattttcttcttttctgaaaattcattcaacaaaatgcaattaatatttcaactcatgtaccttagtatacccgtgtttagcagtcagtaagagggaaaaatatc

SEQ ID NO: 26786 - DNA, 1006 bp, Homo sapiens
aaaaataaaatatgttaaatgttgacactgatgaggaatatatgagaagtaattataaaacctgtatttctgaatataagttaatcagttgccaaaatcagtttagtttttctaaaatgtgtaacattaaatacattactgattttgaacataacatggtacatacaataatttacattaattgatgtgtttcttagtatttattatctacatcaagaaattaagtttttttggttggtcgcggtggctcgctcctgtaatcccagcactttgggaggccgaggtaggtggatcacttgaggtcaggagttcaagaccagcctggccaacatggtgaaacccagctctactaaaaatacaaaaattagctgggtgtggtggcacacacctgtaattctggctacctgggaggctgaggcaggagaatcacttgaacccagaacgtggaggttgcagtgagccaagattgcaccactgcactccagcctgggtgacagaaagagactccatctgaaaaaacaagaaattaagtttttaaatctataaaaatgactgaatcctgtataggagcactgagaaaccagagaagaaatgctgatgtaataattagaaagataaagtagacagcaagaccaaaatgaaaccctaggacaatggtgcaggacaaagaaataccactggagaaagaggagaattattattgtaaagtgaaatagaactcacaggagtaatcaagtagtagttctccatttggagaattagcatgctcataacttaaagatgataatgtgttgtatttgtaagcactgcataaaactggaatattatcctcattctgcgcatttctgtcatcatatctgaaagaaatacacattttaaagtcatgagaagatagttttatagatatttcgtctttattattatgaccatgaaatttcaggaacgcagtttaacagactgatcagactttctataatctttgtttagttatgatgctctttaatga

SEQ ID NO: 26787 - DNA, 1022 bp, Homo sapiens
ttatgtgtacctaataggtatatcatactggtactgagcatatatagaaaatactattcatagaggagtcatcaccacccaacctccttgcctgtgtaggcatatttcttctgaacctgaccacacaagtacaacattttggtaacttcagtcttttcagtatttttgtaatcttagccatagtcctatgagaaatgtacataagagcaaacaattcaggatagaaattagcagaaagctgggaatgatgtgaaataactggcagcatagtacagaaatgtaaggtatatgttttgcttctggatttttagaaattgtgctaatcatgtttacaaattaaggcatattcagatgtctgctattatgtttaatattgatttgataaaaaaatggaattaggtgtagcttagagtataaatgagtctttttaaaaatgtgtatctggaagtagggctaataaagaaatccttttattttcaaagaaatgaacttaattggacaactcatccccaattacagaattgatatcaatatggtttgctgtatttgagtataaacagctcagtgttaattatatcaaaggaagttctttacatcttcattgattacaaaatttaccaaagaaaatgtatctaccaaatataatttttaaagtacttgttaaggaatgaggcctctttaacatataaagtatcttaaaaatattctctgacctggaaaataggtttacagtagctacaagattccattttaggttttcttatgtcaataaatgtcaatattttacacttccagcaaaagtacccgttaaagctaaatctaaatattattcctcatagcacagtttctggtctccttaaattaaggatcctactcatcaggattgaataaaaagggggaaattcctaaaattggtatattgtataatattgtgggttaagtaaaatttaggggggcattatggaaatgtacctattttaaagggcagtggcaattactataatattggttaaactggtaaa

SEQ ID NO: 26788 - DNA, 1033 bp, Homo sapiens
ggctcactgcaacctctgcctcctgggttcaagcgattctcctgcctcggcctcctgagtagctgggactatagacacgtgccaccatgcctggctaatttttttatttttagtagagatggggtttcaccatgttggccaggctgatcttgaacacctgaccttgtgatccgcccgcctaggcctcccaaagtgctgggattacaggtatgagccaccacgcctgactctaccatcattttttactctcattagtcttttatgaatttttaaaaaattctttaatttttaaaatatttttatttttaattttttaaataataagcttaaaaatattctttaatttttaaagtcttccatactacttagaaatcaccttagattgatttgtttttgttattctttattattctaggaaaataactacttaaaagaatgttgacactctaattgttgtatttcagtttaaaggaatctaattgctgtattctaggtgttcagtacattatacttttttgcttatatttatttggctgaagaatttgagaacactgataatcatgtaggtaaatgatacctgttgagctgaacttcttctactttctgtctttaagtaaaatccaataagaaacttatgaatcaaacttgtggtctgcagtggcctttgttgccactacactaagtcgtgaggataacatttaaagaaactttactagtagtctaaaaattgtattctattttcctgtcaacacacagtatcctgaccatctcatagctctttgcactattaatttgcttaattaattccgtgggactttgttttgtgtttaaaatagaatgtctcccatttagccaggaatcattttagcacagtatatttctgaataatagattttaattaagttgtgtgtatcatgaaataaaatggagagtagtaaagtattaaagaatggatggttcttcttcttcttttcttttttttttttttttgagacagagtctcgctctgtcacccaggatggagtgcagtggc

SEQ ID NO: 26789 - DNA, 1050 bp, Homo sapiens
attattattctatttttttctcatgatgtccagttaaggaccattggtattgaaatttcttcaccttgaagtcttatattttgtgtatttagtatacattataaacaaaattccacataataaagtttagttgtataactgaaaggtaataaggtacaagaaaattgaatctcatgataaatattcttctgtaccagtgctcactcctctcttagttactttaaaaaatcattagcaaacatttccatctctagaagtctgaaggaaggagcaagggctttagaatgacttgcattcagttcagaaccatgccctgccacttattaggtgttttaaatttgggcaagttacttaatatcttgacttcagttgcctcatccataaaaaagaaaacattgttagtaggactaaaaacaacttgaagaattcattatgttgcataaggtgtttataaatgtccattattattaccatcaaaattaaaagtgggtttaaaaaaatgaaaattgatctaggaataaaattctctactttcctaacttgcctgattgttttttcttttcaagtaggaaatttgttatatatcactgtgtttcctatagtgcttaccagcagatacttagtaaatgtttgttgatttaataatggaatttggtgttttagattatgcttagcattaagctatcatttttattaatgtgtttagtgtaataaaattcaataatgggacacatgaaacaaacattttgcaaagtgtcatgtttgacaagttgttgacataacttattggtgctgtggttcagttatcttttgacagtgcaaaattagtatactatagaaaaatgctcagttatatgtcagaaatgtaaccctaggctttggactccttttgattccctcgatgtctgtgttcttccttttctgtggttctcagtttttcttaatcacagtgggagtcatccatatattcttttctgtttttccttctttccctccccagcacttcgttgtttcaaatagccccagggggagttgtatatttctcttaaa

SEQ ID NO: 26790 - DNA, 1026 bp, Homo sapiens
acacggcgaaaccctgtctccaccaaaaaatacgaaaaccagtcaggtgtggcggcatgtgcctgcaatcccaggcacttggcagtctgaggcaggagaatcaggcagggaggctgcagtgagccgagatggcggcagtacagtccagcctcggctcggcatcagagggagactgtgcaaaggggagaggaggaccgtgcaaaggggagggggagggggagagagactattctatttttcaaatgaaggtactaaaatatatttttaggattttagagttggaaaataactaatcattgtaggaaactgaagcccaaagggtttaaatgagttgtctgaggacatataaacagtatggttcattgactatatatatgttttttaagtacccgtcttacatccagaaatcatagtatctttgttagctttgaatgcatagtagtgagcaatgcaaaaatgtaccctgttctcttggaatttacaatccagtggggagatggacaattagtaagtaatgaggtctgataaagaagttacaaaccccgaagttctaggcaggaaataaatcttgtgttggaatggaaaatactggggaatggaagaagagctgctatttacataaagtggttcagaaaggctgctgagacttacaagatcagaaggagccagccacttaagtagcaggagcaggacagcattctaggctggaacagcctgcacagatgtgctggagttaaggtgcacgtaaagctgtagagaaactcaaaggagagtatggccagaacatagaaagctgtggggagagtagtatgaaccataagacagggaccagattgcatagtgcctttttcaatcatagatttcaaaattatggcattagattcaaatctgagttctgccacttaaactgtgttaccttgtataggtcacacacccatttacactttaattttcttatctattagatgagaataacaagctacttcataggacatagtatcatggagattatataatgcttatagc

SEQ ID NO: 26791 - DNA, 1060 bp, Homo sapiens
ctctcttattggtttttgatacaggtttcacacaggcttcatttgccaattgtgttgtttagttgggaagtaaaaggttcttgagattggggtggagatggggagaggaacactgattgattcctggcttgggacaggcgattgttgctatattgctatactcttacaggagtattatctcctttgtcaaaatatagccaagatgtgaaattgaaatagtaattctccttacttaaaaattatttatttctttttttgagacagagttttcacttttcttgcccaggctggggtgcaatggcacaatctcagctcactgcaacctctgcctcccaggttcaattgattctcctgcctcagcctcccaagcagctgggattacaggcgtgtgccaccacgcctggctaactttttgtctttagagaccatgtttcaccatattggtcaggctggtctcgaactcctgaccccaggtaatcgtcccggctctgcctctcaaagtgctgggattacaggcatgagccaccgcacccggctcctccttgcttaaaaattctaataagtggctgggcacagtcgctcacgcctgtaatcccagcactttgggaggctgaggtgggcggatcacaaggtcaggagttcaagaccagcctggccaacatggtgaagccccgtctctcctaaaaaaaaaatacaaaaattagccaggcatggtggggcgcgcctgtagtcccagctactcgggaggctgaggcaggagaattgcttgaacctgggaggcagaggttgcagtgagccaagatcatgccactgcactccagcctgagcgacagagcaagactccgtctcaaaaaaaaagtgggggaggggctgggtgcaggggctcatgcctgtaatcccagcactttgggaggctgaggcgggcagatcacgaggtcaggagattgagactatcctggctaacaaggtgaaacctcgtacaaaaaattagctgggcgtggtggcgggtgcctgtagtcccagctactcgggaggctgaggcagtagaatggcatgaact

SEQ ID NO: 26792 - DNA, 1059 bp, Homo sapiens
attttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacct

SEQ ID NO: 26793 - DNA, 1818 bp, Homo sapiens
aacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccgtaagtagatgccttgttttagaatatgaactctttaaaaattgtccaaggatatcctttatacttctggaaatctgaattaaggaattaagcaaaactgtgtacaacaatttatacacaaaactggtcatcatgctatgattcatgagagtgaaaaactggaaacaacctaaatgtgaaataggagaggaataatgtcagtaagttgtggtgtatctatataataatgttcttcaccattaaacataatgtttagggagaatttttcattttatggaaagattctgataaaaaatgagcatatacacatgtgcacacacacacacacagtttgatctatgcataggacaaaagacttgaaggaaataggctcaaatattaatgctggttgtttctggatttatggggttatgggcaatgtaaagatcttccccacccctgcctgattctttattctttcttgtactttaccagtttgctgcaattggtagtagttgtggtgggacagataataatataaattctacaattgacaataagagaaaatacatgatgatactaccatattaaataagaaatacaacattatagctgtatattcttttgcaagatagttgtgacattgtataatgtatactaggtttgcagtgtattttagctcaggctgctataacaaaataccaccgactaagtggcttaaaccacggacatttatttctcatagttcctaaagctaggaagtgcaagacaaggttccagcagattaggttactggagaaggccccttcctggcttgccgacagctgccactgtgtcgtcatgtggcagagagagctctggtgtgtcttcttcttcttaaaaggattataatctcatcatgggagctttatcctcatgacttcatcgaaatctaattacctcccagtgacctcgcactcactggggggttagggcttcaacatatgaatttttgggggacgcattccgtctataacacagtgtttaagaaaaacctactcaaagcatgatcatgactatatactaccatggatatgttaagcatatgctgcctaaagaactcatctgaaacataaaggttagtccttaaaatttacaatttagattttgtgtaccttgttttagaaccctacttcagaagatcccatttaagggatcttgcagttcttggccaataagaaacctgtggtctagagaggctgacttacccagtgtctcacagtttggttagggtggaactgggacttgaactgtggttttatgacttctagtcacatggttttattcatctaccacgtggtcatttaaattaccgcagttctttttcaagcagtatcacttaatcctcatttttattcttgcttcacttagcatagaaatttccctgctagagtaactggccataaaaggtaccagtggttctattgtctgcccagaagttgtcttttcttagggaaaattgtcacacccctgtctttcatcctccaaaacacctgcgaactgggtttggtgaggataattgaaatggaacctttcctgtttcctgaggtctatttgtggattactagatatacaagaaggagcctctgaatcaacagtaaaaaggctaaagccctgctcatacaatattgcagtgctgactttt

SEQ ID NO: 26794 - DNA, 1028 bp, Homo sapiens
attctcagttgtatgttagaaagtttctgttctttggaacaattttgcacaaaagaaatgattaataaaaggttgatatgactttattagcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacaggtgagtgaacacctgctcaacatacagcagagcatgttaggaagatgaaacttaagaccagtaagtagtcaaggctcaccacatttaatttaaaagttaatgatttacttcgcttctgagtaagagagattaaaacacactttctttatcttctgttgaactcaactgttaaacctgaacagaatacatggacagttatttatgaactctgaaaagtaaatatcaacaagtagattgaggaagaaaacctgaattcaaagtaccacaaaaccagtggtgagtttacttagatgttttgctccaatatccctcagccagaactcagtgcagcctgaaacgtgaaagcaagtactgtggtgcagacagacagggatacagaaaaaatccctctggttctggctcaaggagtgacaaagggactcctaaaactcagagtggttgatatatactcagttttctttctgtcttttttctctattctctcatgcccaagcctccaggaccttctgtggcagtaatggtagcagctggagcaggcgtgaacaggaaacttgcaaaagtcaaaactcttgagagagtggaatcttcttccccctttggtggctccttagctcaagggaaggccaagccccaaccccattgcatttttggctttgttctctgttctcccaccatctgtccctagatgtggcacaatcacggaagtgggcagtttttggccagaggacctaaaaaggggtgcctgcgaaccagaaaatactggggatgtg

SEQ ID NO: 26795 - DNA, 1065 bp, Homo sapiens
aagctgtgttacctcattggtcagcatggagcctcattgagcagcttccttcatggggtaaaggaagccaggagtttggtcatcctgaagcattcaagtctcttcttggatagttatacagagcaagtatccagtcccgtgtcatgttcaatctctgcagggttattctgccaaggagaacagctccttaatcagaagagactagattagggagagtgatataaggtaatagaaattgcaaagcagtattttaatcttaagccaactatagttctggattgctaaaatttagtcttctctaaatgaaaaaaaatttaaaaataatgaattatcatgttttcttctatattctagcagagtgatagcataatttacattaaatgtactataataagtctggttctttagaaaacaattttgtttacttaactaaattgtactaaaacttggaagaaattagtaactaaacaaattatttcaagaccaactgctgattgtaaatatggagctgttctgatgtctgcttttgacttttatataaatggaagttttaaaagacccaactatttttaacatgaagatgtttttccttaataaaacctggaatagttattcaaggttctttgcatatttttcaagcaaaatatcccaagtgtacttgaaaatgtaacttaaaatgtttctcacgttttcttaacttgtattttgatatgatgatgtgaggcataatttaagtgttattttaatgtatgttaggttatgctttgatctgaagtatgtataggttttgttctctattcattcacacctcaaccatccagcaaacactgagtgcccactcagtgccaggcatttgcggggagctccaagcccacagcagcacagcatggggcctgcgaaaagcaccagccctcagggagttcgtgttttgttggtgttttgttttgattatttataacataataacatgtgtttattactgaaaactgcacaaataaagataatcaaaaatcacccataatcctaccaccagaactaaccactgtttatcatcttagtgtattt

SEQ ID NO: 26796 - DNA, 1022 bp, Homo sapiens
gatgtgatggtgctcaaaggaaatgctcattggaacattcagatttgggatgctcagtcagtaagcataaggcaaatattccaaaacctggacctgaaatccaaaacacctctggtcccaagcattttggataagtgatactcaacctgtatatttatgtaacatctcaaaactatatataatgtgacatacaaagtgaagacagccatgtcttgttaagaactggtgcttcctgtacagcctagaggcataaagttaatttcttagttttggccaaaatgaatcgctaatatttttaagccattgcataattttttgctgttccaacttgtttagtagtagtgaattgtagatattagtgaatgtgtctgttttgtcttattttttgcttattttatcttaacatggttatttattttgcctttgaacacttggaatctgtttctataatagcctggatgatggccgttaggagtggattgatgtgaggagtttgtaggatgaggctgaaggaaaggattagcctcctgcactttgtagaaattctcactatagtgcagaatattaaaaagagtcatttttaaaaagatgaattaatgtgaaatactgtgtgcttgaaccagatttctacaactgcttttgaaaatttaaaaagaaaatccaatttggttaaatctataggggactaaaagtttgctgttaaaatttttagttaattcactaacccttttttttttcttttttcttttttttaaccttcagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagc

SEQ ID NO: 26797 - DNA, 1028 bp, Homo sapiens
tagtggggaaatggataaactggtttattcatgcaattcaatactatcttctcataaaaatgaatgagctagatctatacttaccaacatatatacatctcaagtatgtaatactgggtgaaaaaagcaaaatgctaaaggatttatacagtaagatgcatttgtgtacactttgaaagcaacataatagcatgcattatttattgatatgtgtatatctaatgaaagtacataaaagtaaatatgaaaacgtgggaatgggatacattaactttagaaatagtaactaattctgagtggagtttcttcacctctgtaacttattttttcttgtgttttaaaaaagagctgaagccaatatgaaaatatgttaatatgtgttaaaactggatgatgagtacatagatttgttatttatttttacagttttatgtatagttaagatagtttgtgaaactagcactttaacatttttatttataatcaggactgtttcccaatatgtttgctttattttactttgtaccctcaaattaggagactgtggaaaaagaactcttctttccctgcaataagaaaggaatgtgccagtgcagctccactatgtaaagcttttctaaggagaggagacagaccaattatttggtcagttttgctttgctgtttgtgctcctgggaaaatgctttctttaggacatgaagcctgcaggggaattaacattctagagatgcttgggaaatgtaggcatataccaatcatgaactctggaagtataggggagcaagttgtataataaggccctcaaaggaatttggacatgttgtgactcagatacaaaattactacagatttgtgtagtattagcattaacactttgaaaagcttaacttggttacattttattacaacgtagttatcttgagtttataccttgaatgcaagtatcccagttgttgctcaaagaaaatagttgtctctatagatattagtaagtaacctgatgacaatgtgttaaatggttgactaa

SEQ ID NO: 26798 - DNA, 1143 bp, Homo sapiens
cagtagtttattattatttttttttaattttttgaggccgagtctcactctgtcgcccaggctggagtgcagtggcgcgatcttggcccactgcaacctgccttctgggttcaagtgattctcctgcctcagcctccccagtagctgggactacaggcgtgtgtcaccatgcccggctaatttgttctatatttttagtagagatggggtttcactgtgttagccaggatggtctcgatctcctgaccttgtgatctgcccgcctcagcctcacaaagtgctggaattacaggtgtgagccactgcacccggccagtttattactttttattaagcaatagtattccattgtatggatataccatcttatgtttacttatttaccagttgatggacatttgggttgtttataatttttggctattatactactactactactgaacattcatgtacttctctttgtgcaggcatacattgtcattttccttggttagattcccaggagtgaaattgctaggttgtatggtgaatttaacttcttaaggaactgccaaacttttttcaaaataattgcaccattttatttccaccagcaaagtgtgagggttctagtttctccacatctttgccaacatttggtattgtctatattttattttattttttgagatggagtctcgctctgtcacccaggctagagtgcagtggcaggatctcagctcactgccatctccacttcctgggttcaagtggttctcctgcctcagcctcctgagtagctgggattagaggcatgtgccactacacccagctaatttttgtatttttagtagagatggagtttcactatgttggccaggctggtctcaaactcctggcctcaagtgatccacctgcctcagccttccaaagtgctgggattacagacatgagccaccgtgcctggtatattttaagtaacagttattctagtgcttttgtttttttgagacaagagttttgctcttgttgcccaggcttgagtgcaatggcacaatctcagctcactgcaacctccacctcccaagttcaagtgattctccaaccttgcctcctgagtagctgggattacaggcatgcgccaccacgcctggctaattt

SEQ ID NO: 26799 - DNA, 1060 bp, Homo sapiens
tatatgtgggagctaaaaattttgatcacattcaggtagagagtagaaaaatagataaaagactggaaagggtgagtggtggcggcagtgaggaggattaagaggtaagttacaggatacaaacaaacagtgaaatagaaggaatgtatcaagtttgatagcagagtacggttattatacttaacaaaaatatattgtactcagatgacaaacacactaaataccctgacttgaccactactcattatatacacatagcgaaatttcacatgtgccccacaaatatgtacaaattattaacagtaaaccatatccttgtccaggtatggtggctcacacctgttatcctggcactttgggaggccaaggtgggaggattgcttgagcccagaagttcaaaacttgcctgggtaacatagtgagaccctgtttctacaaaaaatttaaaaaaattattcaggtatggtgacacacacctatagtcccagctacttgggatgagtcccagctactgaggtgggaagatctcttgagcctgggagttggaggctgtagtgagctctgatcacaccattgcactccatcctgggtaacagagcatgaccctttctcaaaaaaaaagtaaagcatatccttaatcacaatagccaagatatggaatcattgtaagtgttcatcaacagatgaacagataaataaaattatggtatgtgtacacaatggaatactattcagccttcaaaaagaaggaaatcctgtcatttgtgactaaatgaatgaacccagaggacattatgcaaagtgaaataagccacagaaagacaaataccacatgatctcacttacatgtggaatctaaaaagttgaactcatagaagtagagagtagagtggtaggtagttgtggggagggaactggggggatggccaaaggatacaaaatttcaactagaccgggaggagtaagttcaaaagatctattgtaaaacgtggtgactgtatttaataacaatatattcttgaaaattgttaagagaggctgggcatggtggatcatacct

SEQ ID NO: 26800 - DNA, 1047 bp, Homo sapiens
ataaaaataatttatatttgatgttataatacattatttaatttttatagtaaattcactaatctgttttgtttagaccagtatgagagaaaagccagacttcgagttaatactttgtaaggttatctgcactctcatctgtggttggcaatatttgatgcagtttatattagatttatgttgttgttatttagatagtttggagctgagatgaggacaggagctgagatgaggacaaactcttcagttttaattttttgtttgctcccatatatttatcatttttttccagctctcatgggggaatgtgctttctacatcggaagtaaaaccaaaactgaagcatgtcatagccaagaaaaatagacataatgtttttaaaacagacataatacttagaagaaaatgttatgcttttggggtgcttataacatatatttgtttatagttctttaaattgtcctaataaaatttatatctcaaggtttttcactctgttcaagagacatgcactgaacttctgaagataatcgagaaataccagctaagactcaatggtatgaaatcatagttatctatctgataatccccatttaaaataaatattagcattttttaaaatgaaagatttaatgtaaaaacaattttgtgaatagcttcttatggcaaaatatgaatatttacagttacctgttctcaaaggccccagtattctctcttctttcctcagttaatcaaatcctctgacccagatttattttttgctgatattttttttctttgagacagggtctttctctgtcactcaggttggagtgcagtggtgcaatcacagctcactacagtctccaccacctgggctcaagtgatcctcccacctcagcctaccaagtagctgggattacaggcgtgtgccaccatacctggataatttttgtatttttttgtagacacagggtctcactatgctgcccagactggtttcaaactcctggcctcaagtgatcctcctgcctcaacctcccaaagtactgggattacaggtgt

SEQ ID NO: 26801 - DNA, 1048 bp, Homo sapiens
agaaatgatggagataaaagctttctcaaacaaaaactgaggtagttcatcaccaccagatgtgtcttacaagaaatgataaagggagttcttcaagctgagaggaaaggatgctaatgagtaacacaaaaacatctaaaagtataaaactcattggtacaattacacaaatttagaataatagtataatggtgggtctttaatatgaatgttaaaaaacaaaactattaaaaataatggctgcaataggcctggtgcggtggcccatgcctgtaatcccagcactttgggaggctgaggcaggcagatcacctgaggtcaggagttcgagaccagcctggccaacatggtgaaacctcgtcttcactaaaaaaaaataccaaaattagctgggcctggtggtaggtgcctgtaatcccagctactcgggagactaaggcaggagaatcacttgaacctgggaggttaaggagccaagatcatgccactgcactccagtctgggcaacaagaacaaaactctatctaaaaaaaaaaaaaaaatagaccaagaagcagcttccctgctccttctgggatctccatctggttcagcccacctgcctccactcctgcatcaaccatgtccatcatggtgacccagaagtcctacaaggtgtccaccagaggtggtcctctggcccccaggccttcggcaactgctcctatgcgcgtgggcccggtgcctgcatcagctccttgagcttctcccgagtgggcagcagcatctttcggggtgtcctgggtggaagttatggtggggccagtggcatgggaagcatcactgctgtcacagtcaaccagagcctgctgagcccccttaacctggaggtggaacccaacatccaggccgtgtgcacccaggagaaggaccctcaacaacaaatttgcctcctccatagacaaggtacaattcctggagcagcagaacaagatgctggagaccaagtggagccctcctgcagcagcagaagatggcttagagcaacacggacaacatgttcgagagc

SEQ ID NO: 26802 - DNA, 1048 bp, Homo sapiens
cgggttcaagtgattcttctgcctcagcctcccaagtagctgggattacaggtgcctgccaccacgcccagcttatttgtatatttttagtagaaacagggtttcaccatgtttgccaggctggtcttgaactcctggcctcaagtaattcacccgccttggcctcccaaaatgctgggattacaggtatgagccaccatgccgggcctcaagtatcttttatgaagaaattacttgagcctatccttttgctaaataagagtgaaaactgatagaggctgtagtagaataatggccttccaaagatgtccatgtcctaattcctgaaacctatgaatatgttactttctgttgcaagagactgtgttcaaagagactttgaagatgtaattaagttaaggatattgagatggggatattatcctggattatttaggtgtgtccaatataatcacataggtcttcttaaggggaaggcagaaaggtcagaagaagataagacaatgtgatgacatatagaattagagaaagattagaagatgctatgctgctggccttaaagatggaggaagggggaccacatgccaggaaatgtaagtggcttctaaaagctataaaagacaatgaaatggattctcctttgtagcctccagaagaaatgcagccgtctgacaactttattttaggactctgacctccagaatgggaagacagtaaattaattttgttgtaagttactaagtttgtgatcattttttatagcagcagtaggaaattaatacacagggaatatatctttctcattcttgacgtttcctcctatgttaaaggagctcaattagtttaactcctagtctctctctaccctctcatttctttctagaggaggagtggcttgtctggtaaatttgggaagcaaaaattgggcaagtttatctcaattccttctttcttctctcatacagggaagcctctggtgattcagttacctctgactggcttgttgaatttaattttagtgctcggttatgaagattatttggctctc

SEQ ID NO: 26803 - DNA, 1244 bp, Homo sapiens
ccagagattctggtacgttgtgtctttgttctcattggtttcaaagaacttctttatttctgctctaatttcattatttgcccagtagtcgttcaggagcagattgtttagtttccatgtagctgtacggttttgagtgagtttctttttttgtttgtttgttttttgagacctctgcctcctgggttcagggaattctcctgccgcagcctcccaggtagctgggactacaggcgcccaccaccacgcccagctaatttttttatttttagtagagacggggtttcaccatattggccaggctggtctcaaactcctgaccttgtgatctgcccgccatggcctcccaaagtgctgggattacaggcctgagccactgcacccggcctcaggtgagtttcttaatcctgagttctaatttcattgcactatggtctgagagactgttttttatgatttctgttcttttgcatttgctgaggagtgttttacttccaattatgtggttgattttagaatatgtgctatgtggcactgagaagaatgtatattctgttgatttggggtggagagttctgtagatgtctattaggtccgcttggtccagagctgagttcaagtcctgaatatccttgttaattttctgtctcattgatctgtctcatattgacggtggggtgttaaagtctccccctattattgtgtgcgagtctaagtctttttgtaggtctctaagaacttgttttatgaatctgggtgctcctgtattgggtgcatatatatttaggatagttagctcttcttgttgcattgatccctttaccattacgtaatgcccttctttgtcttttttgatctttgttggtttaaagtctgttttatcagagagtaggattgaaacccctgcttttttttttttctttccatttgcttggtaaatattccttcatccttgtattttgagcctatgtgtgtctgcacatgagataggtctcctgaatacagcacactgatgggtcttgactctatccaatttgccagtctgtgtcttttaatcggggcattgaacctctttacatttaaggttaatattgttaagtgtaaatttgatcctgtcatcatgatgctagctgggtattttgcacattagttgatgcagtttcttcgtagtatcattggtctttatattttgatgtgtttctgcagtggctggtactggtttttcctttccatagttagtgctt

SEQ ID NO: 26804 - DNA, 1048 bp, Homo sapiens
cctcccaagtagctgggattacaggcacccgccaccacacccagttaatttttgtatttttagtagagacggagtttcaccacgttggtcaggctggtcttgaactccgtacctcaggtgatccacctacctcggcctcccaaagtgctgggattacaggcatgggccactgtttctggcctgctatgtcttcttgataaattgaccctcttattattaaatgtccatcttatccctggaaatattatttatcttgaaacctgttttttcagacattaatatatagttaatgtttatgcagtatatctttatgcttttccttttaacttctccgtgtatttgtgtttaaagtatgtttctttcttttctttttttttgagacacagtctttctcccttgcctaagctacagtgcaatggcgtgatcttggcacactgtaatctccgtgtcccgggttcaagcaattctcctgcctcagcctcccaagtagctggaattacaggcatgagtcaccacattggactaatttttgtatttttaggagagacggggtttcaccatgttggccaggctggtctcaaactcttgacctcatgatctgcctgcctcggcctcccaaagtgctgggattacaggcgtgagccactgcacccagcctaaagtatatttcttttaaattacatgcatttgggttgtacttgtctatcctgtattacaatctctgctttttaatggtgttacatagtccatttatatttaatgtcatttttaatgtgtttggatcaaccatattggtgttccttttctattttcccatttattattattatcattattattattattattattattttgagacagagtctcattctgttgcccaggctggagtgcagtggcatgatcgtagtttactgtaaccttgaactcctgggctcaagcaatcttcccccatcagcctcctgagtagctaggactacaggtatgtgccaccacacacagtaaatttaaaaaaaaattttttttagagacagggtctcactgtgtt

SEQ ID NO: 26805 - DNA, 1002 bp, Homo sapiens
atattgattcctgtttaaaactttttacttttttttatagagacagagtcttgctctgtcacccagcctggagcacggtggcatgatcattgctcactccctgcagcctcacacttcctgggctcaagtgatcctcccacctcagcctccaaagtcgcttacactacaggcgtgtgccagcacttctggcctttttttttttttttttttttttttttttttttgtagaaatgaggtcttactgtgttgctcagacaggtctcaaactcctggcctcaagcaatcctgcttcaccctcctgaatcactgggattacaaatgggagctacaacacctggtttctattgatttctaaagtagtaatattgtagcccaagaatgttatctgtgttatttcaatacttttatttttctgcctagcatatggtctgtttcggtgaatcttccagttactcttagggaaaaataatgtattctgctcttggtgggtggactggtgtataaatgtcaattaggtcaagttggttaaaagtgttgctcaaaaaaaaaaaaaaaaaggcggaggcttgcttaaaactttcatggtttcacttttttttttttttttttttttgagtctgaatctcactttgttgcccaggctggagtgcagtagcatgatctcggcttactcaccctctgtatcctgggttcaagtgattctcctgcctcagccttcccagtagctgggattataggcatgtgccaccacacccagctaatttttgtttttagtagagatggggtttcaccatgttggccaggctggtctcgaactcctaacctcaagtgatccgcccgcctcagcctcccaaagttctgggattacaggtgtgagccactgcacctggccttcactttttaaaaaaatgtctacttatgtcagttactattctgggggcagtgttaagtccctcattgtgattgtaaatttgacagtttctccttttagttctgtcaggt

SEQ ID NO: 26806 - DNA, 1031 bp, Homo sapiens
gtattggtatatcattgtgggttgagaattcattcctgctcttttatcaaaagtttttttttgtttttgaggggaaattcagataatatacaattagcctttttttttctttttttactttggctaaacaaacccaaacaaccgtttcgaagtgtacaattcagtgatatttattgttttcacaatgttgtgagatcaccagttctctctagtttgaaaactttttcatcaccccataaaaacaccccttactcattaattacttggtttgtagtttttctgttgctgagtggtattccattgcgcagtatactataatttgtttattcacctgttaatagatattctaatttttggccattttgaataaagctggcaagaacatttacaggtctttgggcatatttttcatttatcttaggtaaatacataagaatacaattgctggattgtgtgcgtttccaagaaactcaattttttctgaagtggttatacccattttatattcccacgaccaatgtatgaaggttccagttgttcctcattgttgccagcactttgaattgacagattggttgttagcaagatcaaatgggggtgtgctgatatctctttgtggttttaatttttgtttccctgatgaataatgttgaatatatttttatgtgcttaatggccattagtatacagtcatatactgcataaaggtgttttggtcaatgatggaccacagatataataatagtcacataagattgtaatagcatatttttattgtaccgtttcagtggttagacatgtttagatacacaaatacttaccatcattgtgttgcagttgcctacagtattcagtacagtaacatgctgtacaggtttgtagcctgggagcaatagctcctaggtatgtggtaggcttataacatctaggtttgtataagtacattctatgatgttctcacaatgataaaatcatctaatggcacatttctcagaacatatccccacagttaagcaatgcatgactgtata

SEQ ID NO: 26807 - DNA, 1648 bp, Homo sapiens
gcttccctgctgacctctttttaacgtggtgcttatttttatttcgctattattttgtaatgggaatgtcttccttagaaactaattggcaaccgatggataaaaacaaaacatagtaaatgtgcagtttgagctgaactgcagaatgcacgggcccgcgaggggctccgcgcacagatcctgctccttaggccggcaacccgaccccacggcacagatatggctcctggaaacgcgcgtcagctggtcaggtgcccaggtgatgtcagtggtcagatacctgatgctctaaggaagacggagaggggaaagcggggagtccatcctggcagctcacccgcgatgctggggcgttgccagtagagggggtggaatcatttttcgtgtaatagatgatcttgatgcacacagcataaaagctgttataaactatgggtctctgtaaaatagattgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatggtatgtatgtatttttatgtgaccaaaattttaaatcgtttagtatttgttatctgtgcctatcatacccagtattctttgaaatctctttatttaatagttcaaaatgattgtttatctagtcgttgaaacagctatgtggaaggcagtgttctaattaccagtttaattttagagttagaagggtgctcagagatcagccagtccaaagaggaaaaattgcaaatatgagaactggtggaaaaagtaggatgccatatttttattataaatatcataaaaatataaaacaaagtttataccagttatggaactaggaccagatatcaaaatattagatacaaaatagataatatactgtcttgttctactatactgccaaacttggtgatttcattgtgtgattctatatttacattttttctgtacttttatactttagctttttcagtactcactgcgcttcctttaaaattttattctttttatattctttaacaacaacagatgggatatgtgagttttaaatatatctgtaactggaaagatttcctcgttcgaagtagattttgttatttaataatattcttattaccctcttccattttgtctatttttcattcatcacttaagttttgtgtttttttcggaaatcaaaattttcaaacttgtacttggatccagtattcaccattaaaatttagtcaccttctatgtatctcattattattttgccattattgactcacttgcatgtaacactagggttttaaaattccttttttaatttagttgagataaaaaaagactaaaattccttttttaatttagttgagattaaaaaaaagactaaagtaacacaatatctatatttacagaggccgacattaacaactgttaacattttgttgtatttctttctagtatttttttagataaggaaataaaacatttccaataaagctgaagtctcatcccacccatccgtt

SEQ ID NO: 26808 - DNA, 1048 bp, Homo sapiens
gatcacctgaggtcaggagtttgagaccaccctggccaacatgtcaaaaccctgtctctgctaaaactacaaaaattagctgggcatggtggcgaccgcctgtaatcccaactacttgggaggctaaggcaggagaattgcttgaacccgggaggcaggggttgtagtgagctgagattgtgccactgcactccagcctgggtgacagtgcaagactctgtctcaacaacaacgataacaaaatattgattcggcagggcacggtggctcatgcttgtaatcccagcattttgggtggccaaggcaggcggctcacctgaggtcaggggttcgagaccagcctgaccaacatggtgaaactttgtctctactaaaaaaaaaaaaatccaaaacaaattagccgggtgtggtggcacactcctgtggtcccaagtacttgggaggctgaggcaggagaattggttgaacccaggaggtggaggttgcagtgagctgagatcataccactgtgctccagcctgggcagcagagccagactctatctcaaaataaagacaagtagattgccaatttttgaagaattcatcaagatattttaaggaaggcactttatattaaatatatgtcagatcctttagaaattgcatacagttggttgggcacggtggctcacgcctgtaatcccagcactttgggaggctgaggcgggcggattgcctgagctcaggagttcgaaaccagcctgggcaacacagtgaaacctcgtctctaataaaatacaaaaaattagctgggcgtggcagcatgtgcctgtagtcccagctactccggaggctgaggcaggcaaattgcttgaacccgagaggcagaggttgcagtgagctgagattgtgccactgcatttcagcctgggcaacagagcaagactctgtctcaaaaaaaaataaaaaattgcattgcatacagttttcactgtaaccctaatctttcctcatgtgtagattagaataaattttttagacaaaacctttcatcagtattaaacatt

SEQ ID NO: 26809 - DNA, 1102 bp, Homo sapiens
ctcagcctcttgagtagctggaactacaggtgcatgccaccatgccctggctaattttttttttttttaaagagatggggtcttgttatattgcccaggctggtcttgaactcctgacctcaagcagtcctcccacctcggccttccaaagtgctgggattacgggcgtgagctaccatgcctggctgttactccacatctttaccagcacttgatatggttacttattaaagtcatgattaacttttaataagccctggatctttgataattatgaaatgttcatatttttagctaatttttaagttgttgttattcatttttttatagagatggtgtcttgctttgttgcccgagctgtctcaaactcctgggctgaagcagtcctcccacctcatagcccattttttaaaagtgttggctctattttacttattgatttttttgttgttgttgttttgctttgtttttacttactgatttgtaagagttatttatgtattctggattcaagttctttgctgaatatatgtatttaagtattttctcccactctactttgctgataccatttatttctaggtgcatactttcgtaagcttgctcccatagttcatttcgtttgagagaaataatagtatattgagtttctcatttagcttttttcctcctttcactgatttttcctgagaaatcatttagctttttatagggtttaaatttatacatgcataaattattagtttaagtcatgccagaaacctttgaagtgccaattacaatgaaaatgttgctgcgttagaaataatagaaaaatttggggcccgagaaggtggctaacacctgtactttgaagccaacactggaggatcacttgagcctaggagtttgagaccagcctgggcaacatagcaagaccccatctctaaaaatttaaaaattagccaggcatggtagtgtgcatctgtattcccagctacttgagaggttgaagtgggaggatcacttgagcccaggaagtcaaggctgctgtgagttacgattgcaccactgcactccagtttgggcgacagagtgaggccttgtctcaaaaaaagcaaag

SEQ ID NO: 26810 - DNA, 1024 bp, Homo sapiens
agaaatgaagtaaacaagccattcatttatataaccttcttacctcatagtaattgacatatttccagtctatatcagctactcttaagtgctgtcatcaactgaaaacgcctagttgatagtctgagcattagcatacactaaagttagtgctaatagagttttactatagtatcaatctactctttatcatgacaaaatggtaaaagttagttaaaaggtaacaaacctgagggcaataccatattgatttattaatatgaagggttataaatccacttagaatttgaaagtttcctaagccacattgaagtattctggacttaagagtgtttctttgacagttagggtaacaggatgcttgtattcaaaggtgaagatttatgatttttcatattgagccgaaaagttttatatgttgtttagtccaaactttagtggattaactgtacctcttctttttggttaaggagagatagaaactcaacttgaacttatttaaccttaaaagtaaatggattgtgagatccaaggaaagattgaacaaccacatcacaagaagggtaatggtgcatttgggcctcaggaaccagtggaatagaggcttgaatgtggtccgcacaccctctcgctgtcttgtccctcaagttgactttattctctctcacttcagattggctttcttcaaaagacatggcaataagcttggccttcaagatttcccagattttatgttctgtcctatctgcccctggaaaaaggctaatttcagttctgtggaacacaagttctttgaaaaggtcctgaatgaggaagagacctactgttgtaggcaaataatatgaatcatattacatatgtcttttcccttcatatacatctgtttagttttgcagtggctcctgggataagatgctaaagatctggtctacaggtaaattaaatatttattttaccttgacttaataatgttgtttcaaaaatttaaattcggaggctatatggtggcttacgcctataatct

SEQ ID NO: 26811 - DNA, 1020 bp, Homo sapiens
ttgccaggcatggtggtgcccacctgtggtcccagctacttgggaggctgaggtgggaggatctcttgagcctgagaggcagaggttgcagtgagccaggatcaatgcaactgcactccagcctggggaacatagtgagactctatctcaaataaataaataaataaataaataaataataaaattcttgctttttctttttgcttaatattatggtcagtaaaatggaggcggggggctaatataattgtcacacacacacacaagaatatacatatatgtgaattatatacataaatatatagctatagccttattgctcaaagtgtggtttgaggatcatcagcatcatatttgcaaagttgtgcaaccatcaccacagtcaattttagaacatttttcatcatccttgagctgtttgttaaataatacccccagccctaggcaaccactgatctactttctagctctgtaactttctctcttctggacgttttgaataaatggaattatataatgtgatcttttgtgactggcttctttcacttactatgatttttaaaaaatggtttcattatatcatagtatatattagcacttcattcctttttgtggccaaataataggccattgaatggaggtaccatatttttccattcatcagctggtgggcatttaggttgtttataccttttagctattatgaatagttgttatgtgaacactcgtacaagttttcgtgtggatgtatgttttcgtttctcttgcatatatgcttaggagtggagtttttgggtcagatgtaattccatgtttgagtttttgaggaactgccagactgttttccaaagcaactgcaccattttacgttactgccagcaataatcagggttccaattgctccatattttcactgacacttgttattagctgtctttttacttatagcaccctagtggatgtgaaattatatttcattgtgtttgattaacattacctggatgactaatgatgagcatt

SEQ ID NO: 26812 - DNA, 1107 bp, Homo sapiens
tccacttgcctcggcctcccaaagtgctgggattacaggcatgagccacctgcacctggtcagaaaatactttagaagatccttgctaggaagagatcagtgtgcatttctcaatatataaccaaatgcctgaacacaatcaaatgtagttaaatggcatacaagtttaaatataagaaaatacaaaaaaacccagaaaatacaatttagaatatttagcatttctagtcaacctaatattttctagtgtttttttaaggaaagacaacattcctgatgcttaaagaaatgcaaatccagccaggtgcggtagcttacgcctgtaatcccaacactttgggaggccaaggcaggcagactgctgacatcagaagttctagaccagcctggccaacatggtgaaaccccgtctctactaaaaatacaaaaattagccaagcgtggtggtgggcgcctgtaatcccagctacttgggaggctgaggcaagagaatcacttgagtgagctgagatcgcaacacttccctccagccttggtgacagagtgagactcttgtctcaaaaaagaaaaataaaagaaaaagaaatgcaaacccatgaaaagtaattcagaagagaatatgaagcctgttgtaacagagatgcttagaagtggaaagttagtaagctctatctacattcattttcttctttaaaatgtagaaattgccagcctaagcaacatggcaaaaccccatctctaccaaaaaaaaaatacaaaaaaaaaaaaaaaaattagcctggcatggtagcgcgtgcctgtggtcccagctacttgggagaatcacctgagctcagcaaagttgaggctgaaataagccgtgattttcccactgcactctagcctgggtaacagagtgagactgtctcaaaacaaatcaaaagtagaaactagattagatagaatttacacttaacatgattccagagactgtttataatggtagagagctgagagttttaacaactgttcagctttttcttttgccaaaattagtattcactattttaaaattaactttttcaaaaatcagaaatatgctgtatagaatattcactttctggctga

SEQ ID NO: 26813 - DNA, 1084 bp, Homo sapiens
tgccttggccgtaagttcaaaggcaacaataaagtgtactttcattaataccaccatggactttcgagtattaatatgacaagaaaagacaactattcattttttttaaggggactggacacacaaacttcaggagggaagaatcccctctcccattagaatccctctatcttgataaaatggttgctttattggtcagattttggacttggatcgtctgttataatattaatagtacacagcatgtaagattttctgcattcatttgaaattcctaataccaaccatcttttaatttataaaaaaagagggaaacttacaataaaacaaaaaatactaccctcacagatgattaatagcatgcaatctatgaaatattacatacattaaaagtctccaattactgtgtgcctgacccatcacacagtatccttccaagacaatctatagaattcaaaactgtacaaaaattataaaatatgcagaaaacccaaaaggtactgtttgtaaaacaaagatcacacacacattagtactaaatagggaaaaaaaatcagcagacccatggactacccctgctcccaaccacaggtcttcagtataaaggacttcaccagtgtcttctgcactgcccccatcccgtaggggtccaaaagaccagctgcattcctgctgaccgccactaactctgttttctgcatagttgtcttccctgcttctgtagtggtgagctgtgggaactttttttttttttttttgatggagtctcgctctgtcaccaggctggagtgcagtggcacaatctcggctcactgcaacctctgcctcccaggttccagtgattctcctgcctcagcctcccaagtagctgggactacaggtgtgcgccaccacgcccagctaatttttgtgtttttagtagagatggggtttcaccatgttggccaggatggtctcaatttattgacctcatgatccacccacctcggcctccgaaagtgctgggattacaggcataagccaccacacccagcctgtgggaactatttattggatttcaaaacaccctctgcctcattaatcc

SEQ ID NO: 26814 - DNA, 1032 bp, Homo sapiens
acgcctgtaatgccaatgctttgggaggcctaggttaagggatcacgtgagcccagtagttcaaaaccagcctgggcagcacagcaagaccccatctccacaacttttttttttttttttttttaaattagccagacttagtagtacacatagtcctagcaactcaggaggctgaggcaggaggattgcttgagcccaaaagttcaaggctgcagtgagctataatcacaccactgtgctccagcttgtgcaacagaacgagaccctgtctcacaaaacacaagatgagaatatgtcaaagggatacacagaggagccagtctgaaagagctccaaaggtcaaagctggaacaatttgagcaatacaataagtaatatagtataggattgtaacccatggacataaatatccatgagtttatactgatgtaaataaatcattgaataaataaatggggaagaggagagaactgtcctgtgtagatttctaaatgatttatgaagacactttgtcctgaaggaagtagagcttacctaagtcctcaagtgtggactgtgcttagtgacttgcttccagtgattatggaacggggattaggggtaacttcacagtggagaaacctgacaaacactgccacaaccatgtggtcaaggtcagtatctaagtcacattggttatagggacctttgacatagtgtgtgagaatggcttttttcctctatgatcttcctccccaagttccataaacagactaatcaagagaaaaagcatcagacaaaccaaaactgagagacagtctacaagatacctgaccactattcctcaaaactgtctaagtcatcaaaaacaggaaattctgagaagccgttataggagacatgatgactaactgtgacgtggtgtcctggatcagaaaaggcacatgagggaaaaactagtgaaatccaaataaagtgtggagcgtagttaatagtagcaggacatttccttagttgtgacaaatgtagtatagtaatgtaacatgttaataa

SEQ ID NO: 26815 - DNA, 1046 bp, Homo sapiens
gtggtgcatgcctgtagtcccagctactcaggaggctgaggtgggagaatcacctgagcctgggaggtcgaggctgcagtgagccatgatcacaccactgcactctagcctgggtgacagagtgagaccctatccccctgccaaaaaacaaaaagtttaaaaataaaccacagtcattccttggtatacatagggaattgcttccaggacccaaatcaataccaaaacctgcacgtacacaagtcctgaagttggtcctgagaccttggacatgaaaagtcctcctgtatatagcgaatttttaaaatttttattattattttgagacagagtcttgctgtgtcacccaggctggagtgcagtggtgccatcttggctcactgcaacctccacctcccaggttcaaggaattctcctgcctcagcctcctgagtagctgggattacaggcatgtgccaccacgcccagctaatttttgtatttttttttttttagtagagacggggtttcgctatcatggctaggctggtcctgaactcctgacctcaggtgatctgcccgcctcagcctcccaaagtgctgggattataggcgtgagccaccatgcccagcctgtatagggaattttgcatcctgagaatactatattttttatctgagtttggttgggaatgcagagccctccagtatggagggtcaaatgtatttatagaaaaacatttacacataaggacactagtagctcagactcaggttcaaggatcagctatagttgttaattattttgattctaagcagtgctatttaatgacccttaagctgtttatatctttccaagttctatttaaatcattttaatttacattgtattgcaatatatgaattaaactagatcctgaaggaattcttaaccactgtttagccccttaatttcaactgggtttgttctgaacccacaaagcttaagcttcccagttgaaggaacaacttagcaacagtagcactttctgtaagtattctaatttttacaccatagagaaagttct

SEQ ID NO: 26816 - DNA, 1048 bp, Homo sapiens
acattgctttaattgtaacttttactgctaatggttgtccatactctgggtttctttagcaaactttgcttcctagttcttgtttatattatcacctcctcatttaattaaaacatttactcatataaacagaatcttagttaatattaacttagtcaaattgaaagaggaagctgcaattttaattgcccggttctctgcccttggaatgttttgaatcagtccagccagattttcactgggctggtattttatatccatttgaaatattttagccattgtcatcattaactagggaataatacagtagggaagctgagttgctttctacctctttttaagtcatgtttttatttcattagcttatttaaataatgttaaattcaagaatatcagacatatttctgaaaaatatacagttatgggtaatgtccctaagttgttgttattgtatctgaggtttgtttgctttaatttctttctaaccttgtacatttatgaaagaagatggtagaccaaaatgaaaatctgcccaagaagcagctcaaagaaaagaccctttaacaaagtcagcagtgggaccctttctctaccctgagtttctctttttaaagcagatctatgactggtggtagaaatttaaagatcagggaagtgtagaagtctaagctggtcagtgtagaagtctaagtctagctctttttcctttttcctcagctcttccctcttcgttctctatttactctttccctagagtccacacttgtatcttcagctaggatctctattctagatggatctgtctcccaagagcacatttccaaacagctgttaggcatttcctagaagatcaccaacatcttacaagcaccttaaatcccacaggtgtttagcctacttacctacattatccctgggctccataatttatatctgttgtcatcttttctgtttctgtttaggatgctgacattcttctaattaccaggtttaagccctctgatcatctttgctacctttcttctcatttaatgtctccaatttctaa

SEQ ID NO: 26817 - DNA, 1056 bp, Homo sapiens
aaagaatgcccctggcctactcttccagcccatgtaggcatttcatcttgcacccctgtaaagtaagattaaacgaaccttggagtatattggcatggaagcaagggggtcaagagaaaagaactcactgactggtcagaaaggagagattttcaagaaagagaaagtggtcagcagtgtcagatgctgcagagaggtccagttagctgaaggcggaaaagtgtatgtggaattcagtaacaaagaggccattagtttcagatttttagcacaaaagaactttgaggagtagagctacaacttagtttttcttctttcctcttgtcctgtaatgcagggtttctgtaacaacagagaatgactgtgacatggatcggaacttagaaagcatttgttgtgaaggattattaactggaactaataaatactgtacccagatcagtcaaacagtgctcattctgctagtgttttccatcacaagaacattagtatttaagtgctctatagaatgtaggaaatattttggatattagatttttaatgattataggaaactattcagaaaaccactaacagctggagaatgtattttagtcctacagattctagatcaaaatgataatacaaataaaccactacttactgcttctaatggtagtttgtttttttttttttgagacagagtctcgctgtgtcgcccaggctggagtgcagtggcgcgatcttggctcactgcaagctccgcctttcgggttcacaccattttcctgcctcagcctcccgagtagctgggactgcaggcgcccgactcccgggttcacaccattctcctccctcagcctcctgagtagctgggactacaggcgcccaccaccatgcccagctaattttttttttgtatttttagtagagatggggtttcaccatgttagccaggatggtctcgatctcctgacctcgtgatccacccgccttggcctcccaaagtgctgggattacaggcgtgagccaccgcgcccggcttctaatggtagttaatattaagtgattactata

SEQ ID NO: 26818 - DNA, 1030 bp, Homo sapiens
ctcccacctcaggtgtgcctgtagtcagccaggactacaggtgcttgccaccatgcctggctaatttttgtattttttgtagagacagggtttccccatgttgcccaggctggtctcaaactcctggatgcaagggatccgcctgcctcagtctttccaagtgctgggattataggtgtgagccaccaggcctggcctccaccttacttttctagtagtaacatctaaatactatttctcttgtttccttttttaaataactgaaagtaatactgtactatacatactatagtaggcttatgctatatttggagagtagacctgtttttcccactcaaaggataaccactgtttaacactttcgtgtgctttttctctttatgtgtatgcatacagcagaaacaaagaggaaaaacgtaagggtaggattgtccatgtaatggtagttgtgtcgttttgtattggttaaaagcttgggctctggagcaaataggccttgcatcctgactgtgtgaccttggataatgacaattacttaatctgattaagtctcagttttcttcgtctgtaaaagggggtaataatagtacctacttcatagggttgctgtgaagactaaatgaggaattgaacataaagcctttagaatggttcctgaagcataacctttatattttcttggtgcataactttttctggtgcataacttttctatttttttctaaagatttttaatattctttttttttttttttttttttttttgagactgagtctcactctgtcgcccaggctggagtgcagtggcacgatctcagctcactgcaagcttcacctcccgggttcacgccattctcctgcctcagcctcccaagtagctgggactacaggcgcccgcacacccggctaattttttctatttttagtagagacggggtttcaccgtgttagccaggatggtctcggtctcctgacctcgtgatccgcccgccttggcctcccaaagtgctgggataacaggcgtgagcca

SEQ ID NO: 26819 - DNA, 1050 bp, Homo sapiens
gatcaggtcataaaagctctgccctactgaatggattcatgctgttatcacagaagtaggttagttattgtgggagtgggttcctgataaaaggataagttctgccaccttcctttccttcctccccgctttccccactcatacatgtactctcttgaccttctgccttctgccatgcgataacacaacaaaaagaccctcttcagatgtcagcgccatgctcttggacttcctgtctccagaagtgtaagaaataaatttctcttctttataaatttctcagtctatggcatactgttatagcagcataaaacagactagactaggagcttgcccagggttacacagtaggaaaatggtagagccaagtttccaaatcagatggccttgactccagagatgaagctattaatcactacagctcctgttgcacatgtagaaaaaaacccaaaaaactaagaaaagctagaaaacaactcaaggtattaaattaacaataaggtcagtatagactcaacttggcctcagaaggcttcagggacaagactgtgagcaagtcatcaagcagagtgggatttaattggcagagctgaaaacagagagcatcagaacaagaatagaggcatgagaacaagaatggccatgacttgctgtgtggtgccaaaagagcattaacttagtagaacgatgagatctagtaatttttagtagaatcttacctgttttttctttaagaatagaagaaaatgcaaatacctataatactatcatatggcacccaggtatgcataaacaaacttcaaattagctgcgcgtggtggcaggcgcctgtaatctcagcaactcaagaggctgaggcaggagaatcacttgaaccctggaggcggaggttgcagtgagctgagattgtgccattgcactccagcctgggtgacaagagcaagactttgtctcaaaacaacaacaacaaacttcaatgtatatggagtaaatagtacaattttcagttattgaggtctttttttccttcctggtgtactagaactggct

SEQ ID NO: 26820 - DNA, 1033 bp, Homo sapiens
ggcgcgatctcgatctcgggtcactgcagcctctgcctccttggttcaagcagttctcctgcctcatcctcccgagcagctggggatacaggcgtatgccaccatgcccagctgatttttgtattattagtagagatgggatttcaccatgttggctaggctggtcttaaagtcctgactgcaggtgatccgcccacttctgcctcccaaagtactgggattacaggcatgagccagtgtgcctgggcatgttgtaaaacttttaatcagaagtctgttaactttttttgtacttgaaaacaagtactgttttattttctgaacatttcattgtggtctttgctgcgtgtaggtttcttggtgatgcccttttcatctgtttctagttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctgggtgagaaatatgaagctaggatctaggctttcctttctttttttagttacaagttatgtataaaatgtgacaacctggattctccaacatatcccccagtttattttcatatatagaccaagatcaaaccagaagttgtaggaaatagaggaatccacttatcactaagtatctcaggcacagtggctcacgcctgtaatcccagcactctgggaggccaaggcaggcagatcgcctaagtgcaggagtttgagaccagcctggccaacatggcgaaaccccgtctctactaaaaatacaaaaaaattagccagacgtggtggtgtgcgcctgtaattccagctacttgggaggctgaggcaggagaattgcttgaacctgggaggtggaggttgcagtgagccaggatcacgccactgcattccagcgtgggagacagagtgagactctatctgagaaaaaaaataagtatctgaaatgttcatttaatttagaaatact

SEQ ID NO: 26821 - DNA, 1047 bp, Homo sapiens
ggtaaaatcttggctatcctcagctacgatgacctccaaagtatcacctccacaaacaagtttgcctcgtgctccaagttaagtgagttgtctccatctgtaccaaagaagttctcatcttcacagcctgccccggcctcgaagaaattccattttgagggggtggagaggagcataggaggagcactgagcccagccaccagtttttcagtgcataaaagcttcccacattgtatgtgtttagatttctaaactgctgaaatggtgggttttgtcatttttggccagctttacttttgcttttcagtgggaaggttttttgagctccttaatctcccatagacagaaatcctgcccctcttgttgaatcgtcccagatttggctagttggagccccttcaaactagcttctgtgtcagataatagttttaaagccttccttactgtgccaggaatttatgtgttcaaatgtgggtgtgccgggagcagtggctcacacctataatcccagcttttaggaggccaaggtgggaggattgcttgagaccagtagttcaagaccagcctggtcagcataatgagacaccggctctacaaaaaatttttaaaatgtggtgagaggatagtttgagcccaggagttctaggctgcagtgaattatgatcatgccactgtagcctgggcaacagagtgagaccccagggcaaaaaaaaaggtggggggttcttttatttaattgcagttcctctaagcttcattttttaaagtaattcagaaagggaattaattgtaaaaaaaattttttggtaaaccaggtaacagaaactttctttattcccaaaagcaccatagtaaacaccgtatgtgtttctcagaaagacagaatccattgatgtaatggatgcggttggaagtaatattgtggttagcacaagaactggagaagtgatgaggattttgccacgtatgcatgaggacatcaatgaagagtggatctctgataaaaccaggtatatgctatattgttttccttaacttttacagttt

SEQ ID NO: 26822 - DNA, 1387 bp, Homo sapiens
ccacgtacgaattgggggccctgaattaaatggcccacaaattgtccatggacctttcgttgcgtttggaagtaaattaataaaataggcatgtcttaagttcgtacctccacggctcccgaagatgacgggaaccagccctagaagcgccggagatgaccgaagacgcccggcctcgaggctggggccacttccggcggaactgcgggtccaagttgtccttcccgcctccgggctgggccgacctcagctccgccctctggtcggctgacggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaaggtgaggtcttgtatggatgggaagggtgaggtgcgtcggccagaggcttatttattgacgggactgtttcctttggcccacgcgacgtagtcttctgttgtccttgactgggcgccgcctcccgccccgccgcctcggaagcccctgagagccggcagatggggggcttttagccacggtctctggtctgatgaagcagaaaagaagatgaggatcagggggtcctcgggaacgctgtcacgaatgtaggcttgcaggtgaccttccctctgcagggaaaattcaggacatttccctctcagaggaggaggccgttttattccccgggagaggaccagtgtccgatgacttaggccttaagactaagcctttccccccagatttttacacgcctgatacagtgcatgattgtttggtcgctgttgtgttagcaatggctcacgcttctgtttgttgtccttgtttgtttggtccattgaccacgttggacagcatttttttattcctttaactaacgggaaattgagaaaaacgacttttgaaaagttagcccaggattgcattgcaaataacaaaacgttgtttacaggttattgggatccagtgcttgaactgtaaggtcttggatcagacacaactctgttcacacacgaattgacggtatagaagtgtaacgttaactgtttttgatgaataaacaagttatttttgttttgcggaatattcttgttttcaccgacttaaggctgccagagcacctgcactttttaaatccgggaaagtggtctctacaaattaacgaccagaaattagagattcagttcacttaaccgttattgaacatttactacgagccagaaatgagtccgtaaagaagaataaaatggatgatatgctgggggaatcgtaaatgttagatagcctggtcaatgaaac

SEQ ID NO: 26823 - DNA, 1047 bp, Homo sapiens
tctaatgtttttgaagcctccccttcctttccacaagcccccacccgcccccgcgtcaagctccttctcccacttcctactcccacacaacttcccagccactgaaacttttctttcaaatctctattatcctcttaacagttgcttgaataaatttatttttgcactatacattttctttttgccagatgtgtctaacaagtgtgtttggagagacctactcccagccccgtctccttccccgcctccccccgtcacattctctcaggccttctctggtatttataatatatcacagaagtacccagtcttatagccctcggttatgcctttttttgacattttattttttttaagctttttatatatatatatatataaatatattactttgtcaagtttttttgctgtacaaaagtcttaagatttaaaactattatttgtattatatgatggtggtatgttaatgttacaaaattattaatgaagaaaaaatttatttttgttactggtctgtttcataattcttttttaaattggtatattgtaagatatctatgcaaaaaatgttatgtgacgcatttttatttaagaatgtaatatgtgtaataaacagtagaatgtgtttggccttggaatactttactgtatttctccttagcttgtttcactggggaaaaaaatcttcgaaagacgcaagtgggtacttacatacttcgtgaaagttttctttcttggagaaagggaaagcaaaaggttgtattaggttatcttcgtttgggaagttgtgtgtgtgtgtgcgtatgtgtgtattttatagtttcattgaggcagctcaatgcccaaataagggtcactgagtttatttcttcaaggggaaaaagggagccaattgttggagattatgaaaagcaatattttagaatgatagagattacaagatgttatttgtttagggggttgggagaggcttattgaaagcggtttatttggcgagagaaggaggcagtttgttctgggatggtgtttaataggaacctattggga

SEQ ID NO: 26824 - DNA, 1033 bp, Homo sapiens
agggtatttgtcaaagtcttttctatgaatcttttcgaagaaaagcagttttggactatcgctgattgccaatacttttagacaaaaatcaaaacagtaatggcctgtagatgacaaagacttaatatggccatggttaaaaatctgatgagagttcattatagtcagcagttgacaaggaaatttagttatttctgtggatacaacattttaacataattgccagaattgttactgataacattagacttttaaaaatctcacattttcatatcaataatacgctcctaagtataactctaggtttagcattactcattatttgaccacacttactatataatttaatgcatcaaatatatgtaagcccaattattttaatatctttcttttacaaggtgagaaaaacacatattttgtagctttcaagaggcctaactggtaaatctcaaagtaagttcaaggtcaaaaagacttaatttagaatttgattttgggaagtatgtcaaaatgtcaaaaggtttaaaaaaattaaatatgatattggctatctaattaaagtgacagttttaaatagaaaaacaattttctattttttttaacatttttttagagacagggtctcactctgtcacccaggctggagtgtagtggcacaagcatagctcactgcagcctcaaactcctggcttaaagcaatcctctcaccttggccttctgagtagctgggactgcaggcatgcgccactgcacctggctcatttatttttatttttatttttgtagagatggagttttgcagtatttcccaggctggtcttgaactcctgggctaaagcagtcctcctgccttgtcctcccaaagcactgggattacaggtgagccactgcacctggccgacaacaaaagattttaaaggcaaatacaaaaggttgcatagttgtgaataaaatgtaatcaaagacctaataaaatacagcatgaagcccaaaaatgatcttgataaaacacaaaatctttgttttctaggtc

SEQ ID NO: 26825 - DNA, 1360 bp, Homo sapiens
ttgtttctctccatctgtatttttaatcatagttgtaattatgattatatatatgtaaatatatatgtctgcgtatgtgtgttttgtgtatccgtatacacacacctatacaaatgatgttttcacattatgtcataagcatttctctgctactgtatgattttcatactcactatttgtagtcactacaaagtgttaggttggagaagttttgctgttggagcctgagggtaagaaaatgttagtctcttcaaaatagaatcagtgagtactagaataggtagtgattttgaaatgtcaggaagagattaattattattctttttaaagtatattctctttttgtaaccttagtcatttattcctgaatttggggagaacccaccagaagcctggcggtccactgtggatggggcaataaacaggctggcaggtgtctccggaagcttacgttctgagtttagtgggtagaggtaaagaaagaagattaaaaaaaaaaaaaaaaagcggtgctatgtagatattaatatagggtgatgagactttcctgttaaaaaccagctgctaattcctgagtagttcctgtgttctgaggactgtgcattacaccctttcattctcacagtcaccctgcatggtaagtaggccttacctacttatagcgcccttccagtggtgaaagggaggcttcttggagggtaagtaacttgcctgaggtcacaaagctaatggattgtgcttagaatttgaatccaatctgactctcaaatcctcgttcttagtttgaaaatctccctggtcttatggtacttggaactgtagcagtcccccctcacctgtgatcactttccctggcttcagttacccactgtcagccttggtctgaaaacaggtgactagagtatgataagatattttttagagagagagagagaccacattcacataccttttgttgttgttgttgtttttgagatggagtctcactctgtcacccaggctggagtgcagtggtgcgatctcggctcacttcaatctctgcccccgcctccgggttctagcgattctcctgcctcagcccattgagtagctgggattacaggcacctgcctctgcaccaggctaatttttttttgtatttttaatagagatggggtttcaccattttggccaggctggtcttgaactcctgaccttgtgatccacccataacttttattatggtatattgttataattatcttgttttattatttattgtttatctcttactgtgtataatgtagaaattaaactttaccataggtatatacatattggaaaaagcatcttatatacagggtttgttactatctgtggt

SEQ ID NO: 26826 - DNA, 1049 bp, Homo sapiens
tttaatgaactgctaccccagccaaagaagcttctttcacttttgtgctctacagaaagcccaaggggggtaggagggacagagctttgaataactgctttctaacactaaatgtggccaacaggacagagcacatcacacgtataggcaggtgtgagggacagtggctaagaattgcctgctccctctgcatgctctttcttgtttccaaagtccaatcaagtgatcctgggaaacaaatctgtctggattgcggagggtggttctgaaagaactgccaagacgttaaagaagggtgaagagtaggcagaatataagtagctaacctgagtcaagactctcaaaagctagcagcctgatgacaataggatttatttcagccaggatagtgtctgtctgtgagtgcatcattttaagacagtatgacttcatgttgttacaaactatgtatagtatgtatgttttgtgggttgtatatatacataatatatattatatatatatatgagagatttggtgacttttgatacgggtttggtgcaggtgaatttattactgagccaaatgaggcacataccgagtcagtagttgaagtccagggcattcgatactgtttatgatttccatatatgtatagtgcctatcccatgctgtagtcactgttatgttaaatccagaagttacactagagccagcgatactttatttgtagacaatcaatttgaatccatatgttattactggcagatgatacatgattacagttctgaatctgtaacacttacaaaaggaaacccagagcagcttgatgagtttttgtttctgcttcgttcctgggagtcagtagaaacagcagttgtatgtggttatgttagtctcaagatacttaatttgttgaccttacttcagaaaaattttgtatgtattatatttgtgggaaggtaaaataatcatttgagatttttatcaaatatgaagattagttatttatgaaaaacaaagaaatgtctatttttctttgttcccaattaatgtagataaattttaaa

SEQ ID NO: 26827 - DNA, 1065 bp, Homo sapiens
cgctcacaggcaggaccgggccgccgggccccgccgccacctaccacaagcaggtgtccctgtcgcacgtgtaggaggctgccgccgagggactcggccggagagctgaggggaggggggcgttttgtttggtagttttgccaaggtcacttccgtttaccttcatggtgctgttgccccctcccgcggcgacttggagagagggaagaggggcgttttcgaggaagaacctgtcccaggtcttctccaaggggcccagctcacgtgtattctattttgcgtttcttactgccttctttatgggaaccctctttttaatttatatgtatttttcttaatttgtaactttgttgcattttggcaacaatttacctttgctttgggggctttacaatcctaaggttggcgttgtaatgaagttccacttggttcaggtttctttgaactgtgtggtctcaattgggaaaatatatttcctatacgtgtgtctttaaaaaaaaatgtgaacagtgaacgtttcggttgctgtgactgggaagttgttgggtgtgctttttcagccagcttctccttccactgcttaaagtgtccatgattctttaaggtgagctgcagtttatagccccaggtcatacctaggaggggagcataatgagctcagggcctccccaaagtgacaaggttagggagtgcttagcggttttgtgttcagccttagctttgtttatagagggaggttcagtttcttttctgtagtgcttgtaataattctcactcctaacagcaccatcgttgtgtcttgaataagttagaggtagcattatagaggatctggcataaatatttgcagtagtgagagcctaagcgatggtgattggtggagcttgaattttaggctggtgagatggcagctttgtgcctgagaggtagtgggtggttcttaagcttcagtgatcccctttttttttttttttttttttttttaaggaacttgtgttataattttggtaaaagtataaacccactccctctggacaatacttagcgacagttgctaaagggggc

SEQ ID NO: 26828 - DNA, 1050 bp, Homo sapiens
gggcggagccggggcggggcttcccggcgggcattagaagcaggtgacccgggcggggcgggagagggcagccagcctgcggccgtgagtccgctgtggtcgccgccgcgcgcggttccgtgctcgccagaggtgggcgaaagggtgcgagagcgcgggggaggagccgagcagggcacgtcccgagagcgtcgccaccgcccccaggagtccactggagcgcggagccccctgcaggggaggaggcgagcggcgggcgggacgcggcggccggcgctcaccatgcagtcccggcctggccagcgccggctgctcgcggtgctgtgaggcggcggggtcccacggcccccgcctcccgccttcctcccgcccaggtgctgccaggcgcgctcgccctccgtccggctcccggccccggggagaacgcacggcctgcccctgcccggctccgtctggatcatgcggggggctcccgaggaggagagggcgagtgaccggcctgcgccgcccctgttctgggggcgccccccactctgagtcgcccccacctgctgccatgtgccgctgccacgggtacccagcctgtcgctaaactttccgggcgccagcccggctctgagtcgcgcttctcagcggagtgacccagggacggaggacccaggctggctggggactgtctgctcttctcggcgggatccgtggaggtgagaaccttccctttctccctgttcttctcccgtttcctgtgcccttttccgggaagctgagggttctggtctccgggcactgcctgaagggcccagcttggaaagagagggtgggggagtcggtagtttggttacaggaggcggagcggggaggaaaggaaaggggttaacttaagagatttggagacagctcgcggggaccgaactgttgacgcctctccaacagggagtggttgcaatctttcttctcccccttcttttttaaagagtcctttccctggaatccgagccctaaccgtctctccccagccctatccggcgaggagcggagcgctgccagcgg

SEQ ID NO: 26829 - DNA, 1043 bp, Homo sapiens
ttatagaaaatttgaaaagtacagaaaattaaagaaaatattctccattatttctccatttttctacacatatgtatttttaaatagttagaatcatattgaatatataattttatatccagcattttttatcacattgtatcagaaccagaaaaatagtcacatttaatctataaacttatattaatgggtacttttaaagaaaaaaaaaatttttttttttttgagacaggatctggctctgtcatccaggctggagtgcagtggcaccatcttggctttctgcaacctctgcctcccaggctcaaacgatcctctcacctcagcctgccgagtagctgggactacaggtgctctccaccacgcccagataatttttgtatttttttttgtagagatggggtttcaccatgttgcccaggctggaggaaaaaaattttaattggctctaaaatcattaagatccatcgaataaacacaggcaggccagtccataaaaagatcactgggccaggcgcagtggttcacgcctgtaatcccagcactttgggaggccaagcctggtggatcatgaggtcaggagttcaagaccagcctggccaatatggtgaaaccccatctctactaaaaatacaaaaattagccgggtgtggtggcgggcgcctgtaatcccagctacttgagaggctgaggcagagaactgcttaaacccaggaggcggaagttgcagtgagctgagattgcaccactgcactccagcctgggcgacagagcaagaccccatctcaaaaacaaaaaacaaaaagatcactggactaggaacaaagaagtctcgatgtcgttcctagctactaatttgtgtgacctttgacaagccaccactctgctggaccttcataccaggcatatggcactgttttaagcttttattgacaaaaggagtaagatctttgcttctgctccattgctcagcattttgtatttgtgtttgatagtttgtcatgatgttttccgtaaagttggctgatttttattctgtttac

SEQ ID NO: 26830 - DNA, 1035 bp, Homo sapiens
ttagtggtgaggataactaattaggagcattcggatttaacaagcagaaaaacaaagcgtgacagctcgcctgtgttgttccatggcaagtgcctgtgtccgctgcagccggcactgccttcagaaaccactgaacataatctggggcgagacaggaacgaggcctccattaaaacatcactaaatctctgttaactattttagccacggctcttccaaccaattaatgagctaggaaagaggactataagttatttggggaacaaattatgccttttaagcaagtgggttttcaaaaaatgaatgcacaggctaagatcttgctggggaggaggaagggattgagtgttatcctttgaagttttgatagacaggcagcagagcaaatggaaaagtgctgtttctcaagagagcaggtgtatcttgagtgggtgccgaacagttcatgcctcatgctcggtctcccagtgtgtttcacatcgtacagggaggggaacgggaagagtgacaactgctgctaggtgccaggactggagctgggtcttctgacttctcactttcagtcttgatgtccttactacctgctgagcataactactagttttctggtgttttggtgatggggccagttagctgagtgggttaaagcaggtgattagcaaggtgctggtgcagattgttctttatgcaagctgacttttctgttctgcagacccaggcactacagccaaatctaacctgatccacagatgattgaaggatcgggggagctcggcacgggatgtggcagcaaatgtgcggcactaaggacaaagtcactgccttttgtggaagccagatcagaaagatgactgtgtgttgtgagtggtggatagagagccctgttgcccaggtgagaaggagctcagttgagataaggattccaggagccaactcgagcccctcaggtagagacaacaataccggttgaggctgcagctgtggagttggatggtgtttagtcagtgctgaaatcactttcctgggagtcccttg

SEQ ID NO: 26831 - DNA, 1034 bp, Homo sapiens
ctccaacactgggaatcacatttcaacatgagatttggaagggacaaatatccaaaccatatcagtatgtaaaagaagtttcaaaattatttgccttttcttaaatgtatttctggttcatatcagtttttggcatttctgcatcttcaggattttaaagactgtatgttttttcatttctgctgtccttccaaaacaagttagaatgtccttatctagaactggcttttctctcattatgtgcctcagaaatttgttggaaacctgtctgggacttctgaaatctagtctcagatgtgagagctgagaagtaggtcatttggttgtggtgggtgattttagccttattacaactacattacatttattcttctcccttttttcctctcactggcttctcctctacagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagtaactatagttcttttttaactttttctttattctcaagtaagctgacatttgcatatagagtatgtatctccctatccctatgattctgggtaaattgagtgaaaatcatcactgtctcttaaagataagggcaaaactgaggtttagcaggagtgaaacaaaaccactctgacttgcttttataagataaacatgttcttaaataaggtccccacatgaattgttttcagagccaggttctttaatgtttaaataaacgtacgctgttagtgataagttctaatttttcatgtgtgagtttctaagtcagacccatttccattctttctgaagcccattgttagaatttaaaattctgttggccaggcacggtggctcatgcctgtaatcccagcactttgggaggccgaggcgggcggatcacgaggtcaggagatcgagacca

SEQ ID NO: 26832 - DNA, 1049 bp, Homo sapiens
tcggcctttggatttttagccttgaagttaccccttttcaccttgccactagtgtcagccttcttgccttcaggcttcttctccttagtatccggcttctcaactttttcacctgccatcttgtaagatgggaaagagctgaacttaatttttttgataactcaggttcaccaccatgataacattctcaggggttactgagataaatagctgtatatctataaaacaattcactgaataattaactagtacctactgagtgacttctgtgtgccaggcatttggattggataccaggtatatgataatgaacaaaaccagatggaatttctatctttgtgatataaagtctagttgtgaaaaaaaaatgacaccacctaaatgatcacacaaatgtataattttaaaccttgatcaagtgctatgaagaaaatttttattgttaagaatattactttggaattagatcacggttcaatcccaaattgaccaattggtagtattgatcctgcacggcaatctgaattagatagaatgagaacagcctgttttctgggttgtgttgtgaagatcaaatgaggtaacaaatgtgatgttattttgttaattttttacgtgcttattatctgtcttcctggacttgaacataagcttcaggagagtaagaattttttggtctatcttactgaactgttgttttccttagtacttggatcagagagtcacatcatgggcatgaattaatatttgttgaatgaatgaaatgttgttcatgatttcttgcccatactcagcattcataaggaatattttgtacttaacgtattttttcttccctatagtcagattgatattctatttgttgctttcgtggctgtctcctgcagttctgcttctcttcctaatttgactctggactagaaaatcagataaccaatgtgatagatgacatagatgtctctgtaataagagatatttaaaaaaatctgtaagagagaaggcctctcttaaaagcaacaagaggatggccaggcatgatggctcatgcc

SEQ ID NO: 26833 - DNA, 1107 bp, Homo sapiens
agaagtagagagagggggtcaagattacccttcaaggccactgattttaaaggctataataaaagggacatacaaagtcacagaaaatattttgtttttaagatggaggaaatttaagcatctttattaaaataaagggaaaggaaggagctacaggtgagaaatgtagaaaacaccttatcacaaagttatggagggatcttattacaggaaaaaatatgcctgttccttaagagtagcatgaaatagattaagatatgtgtggatgcacttgtttctgaggtgattatagactggttaagattatagactagttaatctgaggtgattatagactagttaagactagttaaaggagcctgaggagctttgacaagtaaaacatttttccttttcccttattccttctcattttccctcccctcctctcctctcccctttgtttttggagcctgagtaatctacccctaggaaagggtgttagtggtttctaagaattttttttttttaatcccttaactataaatatgtttataatgaaaagtacttaattaatgcttataaaactagttaagaattgaacttttaaaatattctctaattgaactttctataaaataagtacatagtagtgaaattctacaaattttagttttttaatgttactcatgtttgagaatattactatagatttttaaaattaatcggagatacaattttatattatagcattatatgaaacagctttgattcaaagatatctggattgaagtaatgtgaaatggatctctatgagccttttgacactgggagtagaatatcaaatgaggcctaattttatttcttatatcttgctattttccaatacctttgttatttttccttcacatagttgtatatgaagaaaacatctttcagattcaaaggtttttaggagtaagggcttagtctatttaatggtatttcagacttgacacttaaaccacaaagcactttctgaagatgtccttgttaagcatataaatacttctcggaagcatataaatactatttatgtatttataataaatgggcaggtaagaaaactcataagtatttttcaaaatt

SEQ ID NO: 26834 - DNA, 1049 bp, Homo sapiens
aagcacaggtaacaaaagcaaaaatagacaaatgaaattgcatcaaactaaaaaggtttgacacagcaaaagaaacagcagagtgaagagacaacctatgaaatgggagaaaatatttgcaaactatacgtctgaaaagggaggatttccaaagtacatatggaagttaaattactcaatagtaagaaaacaaataacctgattaaaaaatgggcaaagtggccaaggaggtgtagcccggtggatcgcttgagctcaggaatttgagaccagcttgggtaacatgtcaaaaccttgtctttacaaaaaaatacaaaagttagccaggcatggtggtgtgcacctgcagttccagccactcaggagactgagatgggaagatcactcgagcccaggaggttgaggttgcagtgagccaagattgcgcctctgcactccagccttggtgacagaaagagaccctgtctcaaaaaaaaaaaaaaaaaggaaatgggcaaaggacctgaatagacaatttctttttccaaagaagatatacaaatggccaacacatagatgagaaagtgctcaacatcactaatcatcagggaaataccaattaaaactataatgagataccgtctcacacctgttaaaatggctattacaagaaaaagaataacaaatgttggagaggatacagataaaaggaaactcttgtacactgtgggaatgtaaacaagcacagatattacagaaaatagtaaggaggtttctctggaaatttaaaatagaattaccatatgacccaataatcctacttctgggtatatgtcaaaaggaaattaaatcagtatgttgagttgatacctgcactctcatgttgatactcatttacagtggccaaagtatgcaatcaaactgaccattgacagatgaatggataaggaaaatgtagtgtgtgtaggtatggatgtcagttaggaggaataagttctggagatggtcagcatagtgactgtagttaataataacataccgtgttgagtccctgacttatgatggctcaa

SEQ ID NO: 26835 - DNA, 1039 bp, Homo sapiens
gtgagccgagatcacgccattgcactccagcctgggcgacagagtgaaactccgtctcaaaaaaaaaaaaaaaaaaaaattggccgtatgtgcgtgggtctgttcctgagctctgtttttttccatatatgtgttcatccttttgctaatgccacactgtcttgtctactagaaattggtaagttgtgtgaatccttcaactttgttcttttccaaattgttttggctattctggttcctttaactttcatataaatctttgaattagcttgtagatatcagcaaaatgtcctgccaagattttgtatctaaacttataaatcagtttgaggagaattagcatcataacaatattgaatagttttatctgtgaacatagtgtaatgcactatttaggtcttgatatttttatgggtgttttgtatttttcagtataaagaccatgtgcatcatcttgtgtttagatttataccaaagcatttttgcaggtgttggaattattactgtttaaaaatttctatttctagttttttatttctagcatatagaaatataaatgagttttgtaggttgaccttgtgtttgctgccttattaaattcattagtcgaggagttcaatcccttgggattttctatgtagaaaatcacgtcatctgtgaatagagacagttttacttactttctaatctgtgctttttatttcttttttttttcttgctctacagcactaactaggtcctccagtacaacattgagtatgagtggtgagaaatgtctaccttgcctcattcccagtcttagggcagaaacattcagtctttcaccattaattatgatgtgagctataggcatttgtgtacatgctttttatcagattaaagacattccctctccttcctaatttgctgagtttttctcatgaatggatattgaattttgtcaaatgctttttctccatttattgacatcatatggtttctctttagtctattgatatggtgaattttagttattgttttcttttttttgagacggagt

SEQ ID NO: 26836 - DNA, 1803 bp, Homo sapiens
ttttgttttgccatccataacatttctgggctgctgatgtgctaaggaattttttttgttttttgttttttggttttttttttagtaaaattggaatgtaagttgaaaattctgttgtaaaaacgtaaaagtatgccagtgctttggtgggcagatcacgaggtcaggagttcgagaccagcctggccaacatggtgaaaccccatctctactaaagatacaaaaaattagctgggcatggtggcatgcatctgtaatcccagctacttgggaggctggggcaggagaatcgcttgaacccaggaagcggaagttgcagtgagctgagattgtgccattgcactccagcctaggtggcggggcgagactccatctcaaaacaaaaaaaaacaaaaaaaaaaaaacagaaaaaataaaagtaaaatttatacccaagaaacatagttggtttttggattatctagaactgttacctattgacagaatcaagattatgtatctagttgctttctttgaaagaggactgatatattttcataacttagttttgcttcttaaattctgtaagtttgatattttcatttctgtgtgttgtgacaaaaagtttaattcttttttccagttttcttccttctaggttcttcgaagttctgcatcattagactaaattcttttagaaaagggacctcttgttcctaagtatcttgggtgtatatgaaagaaataatcatcaaagatgatggtggtgcctagagtaatataataaagtattttagtagttgtaaagacatttcttagatttagcaaggatccaaatactcctgcccaattatgtgtataattggaaacctaaataattagaaactgagtatttataggaagatccaggtgctttttagaaagctatttgaggatttattttccataaactttccataaagcctagaatactataggtgcctaaaaatattaaacaatagatttggccaaaaaattgggggactgaaatatagtagtcgatagttgatccctggttacaagacttggcacacatacagaggaatagaaaatagcttatcaagatgtttatgtattgattacatgttgatatatgatactttatatatatgatgacattaaatttaatttttcatgtttcttttaaaaatatgtctagtagtagcaagtttaaaattacatatgtagccacttcatatttctattggacagttacattctatactaatgtttcctaatttttttgccttgagactccttcacaataaaatatatctcatgaaccttcttccttgaaattttaaaataattttaccattttggatagtatttgttcaagaaatatttattatgagcctgctatgtgccataaaatattctagaatacgatgatgagtgaacacataacacctgccttcatgtagcttttgatctatttggggaaaatatgtgatgaagtaatttctagtaaaaatttttaaatggatcatttgttataagtatactattgtatataaaatttcatgtaatataattttatatatttcttcatttattaagtgatagtttggtgttctctgagcttcctggatatgtggtttggtgtctgacattaatttggagaaattcttagtcattattgtttcaattttcttttctttttctcttctccttctggtattcccattatgcatatgttacaccatttgtaattgtcccacagttcttggttggatagtctcttcttcctcaaaccccctgccatctttgttctctttccttttt

SEQ ID NO: 26837 - DNA, 1014 bp, Homo sapiens
ttatttcacactttctttcaggaaaacgtagatttgggctttagagttagatgggatagagcagaatctaggggatttttgagggacggtgcttccaagtttgtgtcaccggtgtgctgaggaagggaccggtcttgctggaaaaagtcagattgcgtggtgtttggtagcaagaaataccaggcggtatcctggccgtttcagaaaccacaggaaaggaaagaggctggctttgcagtcgggagggcaggcactggatggacgttcttgtaatgttttcttactctgggagagtccgtttttgtttgtttttttgtttgaactgtggtaagcacattccgtttttgattccccaaacttcaggacattcatgttctggcgaggtttaggagacaaacttccttcgtctttagccagtttgcttaacttcatctgagtttgggtcagtaataattttaaatattgctggatggggcaggtttgttagccacaaaacctaagtgaagtgagcactgcagacaaaactggcaatttctgactaggaaaaaatgactctaaaaataattcagtattgagaaagaggcttaacagtgagtggtctctgcctttcccgttcttaataactagccatttctttgggttagtcacctctctgatgtcaaacttgtttcgtttttgtaaagtttcataatatggtctctgtcttaagagattgtaagaaagaagaaatgccttgtattaggaaaagtgattcctaatctctaccaattgccaagtagtgttatttttataacaaaagtgaattttttaaaagcccacatgttggggaaatataaacaatgaattaatcatgaaatagaatatatttgagtatctttaaaatctgttgtaaccattatctttggttctccctcagtttccacctacttagatcagtgtcagcgtctgcaaccatttcctcatggttttaatctacatagattattctctcccgcaaactgtctggagtaattt

SEQ ID NO: 26838 - DNA, 1057 bp, Homo sapiens
ggattatttcttaaaattatggtaaatccatgatgatgctctattcagctaataagaagtcattagatattgttaacagatcaaaatcatattatatggttccagttttataaaaatgcatatatatgtatagttatgtccatagaaaaatattggaaagatatacctttaaaatgttcattccaggagataaaattatttttaaaattatttttctcctttggactgctgtgttcttaatattttatttactaatatttgtttctcttatatttagaaaaataatctattctacacttagagcaggtttgttagaaaaaaatggcatttgagacatactcttttttttttagacaaattctcactgtgttacccagactagagtgcagtggcctgatcatgcctcactgcagcttcaacctctcaggcccaagtgatcctctcacttctgcctcccaagtagctgagaccacaggcgtgtgccaccacacccaactaattttttaactttttgtagagatagagtctagctttgttgcccaggctggtctcaaactcccgggctcaagcagtcctccagcctcagtatcccaaggtgctgggattataggcatgagccaccatgccctgcctaatagctaaatttttgatcaatagagacaggggaaggaaccaaggtgtttaaaggcagcaaagtacatggtgacacgtaatctcagggatacagtgaggtttgaaatgttatgtgagtcccactggggtctcgaatgttagttgggctttgttatactactgtataaaacctggctaatttatataataaatcttaatcatatatttatttgtataagtgctttagaatataatagatcagcatggtttttcagtgcaattgtgtgaacattcttaatactcagcaattttataatggtgtagccagtttgaataatctaatttacatacatacttatatcatttgtataatttaatttttatcatttgatgaattttttatcttttctttcaattacagtgacttacagggaataaaaacaaa

SEQ ID NO: 26839 - DNA, 1034 bp, Homo sapiens
ttaagtctactttgattaattacatgaaatagatcttttctggataaggactagaaaagaaaaggcagagtccaactaaggaagaaatacactaaattagaatttaatgcaaaatagaaaaagcatcctttggcaagatttgaatatatgataagttttttagatgtgaacttgaaaatgtacaaaatgatgcatagattttcaaaatttctttcaggggtacttcaagggtaaaaaaggctgaagaccactgaactaaaggagctacaaaactgtctcatttgaagcttggtgtgggagggatgggagtaggtcttaaataattccattttacagaatctttatcagagattgatgggtatttttatctccacccagattggctttgtaatgtggcgattacatcaacatggtttgcatcttatacacctgcaatttgaaattgtgtgattctggttaaaatactaattttggaggctttgcattattttaaacattgtatatgatatgaaaatttatcagtattactctaccgtactatttgaattttacataatgtgatccatatgtcacctgacaatactacatttcacctcaagtcagacctgtggttagttctaggcatcatcttctttaaggatttggagatggagaccgagttgaataatgataaggtacttcttaattccagctacatgaggtagatcccatcaaaagtggtggcgcccaaatttgaacccagctttgtcataattcaaactctttctacttgcctctcaagtttctctgtgaaagaaatccatgttgttcagtggcactaatttggatatgaagagtaacaattcacttacttttcctattgcatatatatatttttaagatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactca

SEQ ID NO: 26840 - DNA, 1043 bp, Homo sapiens
tcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaaggtaggagtcagaaccaccaaatagaaagcagctcggtggctcacacctgtaaatctcagcactttgggaggctgaggcaggcggatcacctgaggtcaggagttcgagaccagcctggctaacatggtctactaaaatgacaaaaaattagccaggtgtggtggcaggcgcctataatcccagctactttggaggctgaggcacaagaatcacttgaacccgggaggcagaggttgcagtgagccaagatcacaccattgtactccagcctgggtgacaagagtgaaactccatctcaaaaaaaaaaaaaaaaaaaaaaaaagcaggtctcccaggaggttgtagaaagagttctagttcatctgatttaattcatttatccctaaaaccataggtcttggataacaaatacagttatttaaggaaaaccttgaaaagcctttcaattaaattagcattcctttaaagggacataattctactcaacagcattaatgggagaaaaaaataaagatgtagggtgattttgtgcctttcttcttgaataaccttgtagatacgtgactcagacagctcattaaattcctcccatgctgtgtactctttcaaaccatccttttctctgcattaatctcctttctctgatgtgaaggtagtgtttgatttttcagagtaatttgtatagacaacctcttaacttttggggttgtctctggaagaaatcactatactaatttaacttggtctcattttcagtttgctgaatggtgcttagagtatggagaacatggatgcagaacaccagacacccctttctctctctttgaaggtattttgtacactttatttatttgccctataatatcagca

SEQ ID NO: 26841 - DNA, 1029 bp, Homo sapiens
gtatgtaggtgccacttttgcgagttttacatgcgttgggcagatatttgcatagtggggccaagcccattgctgtccaaatgagacaaggcagaactgaattgaatgacacacttttcaaccccttatgtggatactcaagttgcataagagcctttagtgctctaggagtttcacatttttaatgcaaagacacttacataaaagtattcagcagttataaataaactcaaccacctggacatatagataagtaaaccacacttaagaaaatagttattgaaattatttaggtctatatgatggcagaagttttgctttgtaataaggatacctcataaaatttgatataatcagcttaagaaggaaaattgtatatacatatccctatccctaagctgtatggttttccaccagtagcatgcaattctgtgaaaccacaaaatattaggaatgatctgtttctgctcaattattactaaggtgtcagacattcaaccacctctctgtagtctctgaatgcatttgcacaatatgtatgctcagagaaaggctcagcttctattaatctagaggttgctgtattaataggttgcacacttcattgatttttaattaatttctaaagagacacagaggataactgctacagcccacagacatctccattctcattggaaagcacatctttattgattggctgcctaaggagtagaagtaatgcactttaagtacacctccctgtgagagttcggacactacatgattcgcttctcctattgtaaccatattggcaagagatcaatgggagaaaaactgtagcatgcttgatattctcttgatgcaggcagatgagctttttactcacaatgtagtgagaaagcagaggtttttcgcacatgctgtttaatttgcttttttgtttttgatttcatttatttattttttggttttcttaagaaggctttcaagccccaaggaggctgttcttcaaatggatgttttaaaagcttgccatgagtggtaaat

SEQ ID NO: 26842 - DNA, 1030 bp, Homo sapiens
cgattaacgctcattctgctttagagtatttttagttttcccagaattgttggcacttgctctggaaaaggtacgttactatcaatgaaacctacaaactcctattcaacccactgcataacacaaagtaaaatttctggggttctgtcactctaaagaaaagatttttagaataattactaacatggacattggaggtcagtctgtggcatatccgaagatctcagtaatatatataatataatgcattacacctttaaaatctatatttttaattcagcaaaaatttgctttacaatattgccacttaccacgtatttcataaaggaaagcatgtaatcaaatactggagagagaaaagagagagagagaggaaaactgatatattaccatttataaggtgggaattttttctctgcagcataatacttatattggagcattaccatttggaagcccacatagatttcagataataagaatatcctcatttgatggctttgtgtgggatgaatttctttttaaaaaaggtctgtaaaccatagcacttttctgacacttttttcttctactcactgaattcattgcagttactgagaaattaataataactagtcagtcacaggtgtgtggtgtttatttctgccacccacagagtgtttcaggcatactgaactcagttgttgataaatttgcaatgttgttggagatcagttctgacacatgtaagtcagtaccaaagaatctagcttggcatcctgtcctggattcaacaaaaatttactctttggagtcttgaattctttgacaataacaaggatgttaactacaaatttggaaaagataactcattcatatttcatggcatcattgaatgtgttcctttttttttttttaaaaaaaaaaaaaaaaactacacaaaaagatgaaagcatgttacttactggtagtaggaagacaccttttaccttacattgaaaagcttcccaaccattttgcttagaaagtgaaggctattacgctaaacaac

SEQ ID NO: 26843 - DNA, 1037 bp, Homo sapiens
cttataataaatttggatgattcttcacctgggtttggatagtttcttcacatccatgtactgatcggtattctagtgaatcctcaaagagggacactctgcagttctctggattatccttatacagttccctattctatgtctctgttgccctgtgaactccacttgctttgccttctctgggattccagttttttctgctcaagataggagactgcctgtctctacttggattccctctccttgcactgtgacctggaaatttacttaaacagtaagctggagcaatcttgtggcttatttctcaggggtcacattcttcattgcctgatattcaatgtcttgagtactactgtttgatatattctttccagttttttaagttgttttttagatgttagttgggagagtaaatcaacatgttgctccatcttaaccagaagcctaaaactatggtggattttattcactgatcatatctagtttcaattttccaggacaaatgaaattctgatgtgtttatccaacaaagtatcctagatatatcgtcctattgtgctataggcactatgttgaatattaagagagacacaaagtcacttaagaagcagctcctcacatactcacggagtatgtaaccatgatcatatattcatatattacctttgttcataagcacagcagtacttccagagagtagatattggtttgtaaggaaaaaaaaaaaaaaagatttccagccctggtgtgttaccttatgagtggcaaattcttcagctccctgaacttcagtttctttagttacaaatatttgaaatactagtgctgtgttaactttaccctgcctttagaatgctgtaaaaaattcagaaacgaatgcagaatagcataagaatatatgaaagtctctattagaagttaaaattaatagggatagtatcaatctcttagaattcaaacatgtgtgttcacaatgtggctttttctattttgtttagttttttttcatctcttcatatcaattatctctttcttat

SEQ ID NO: 26844 - DNA, 1023 bp, Homo sapiens
caagtagggaactgtatataggggtctatttatgggagtggttcaacaggaactacacatttaggactcatgggcatttaggtggtacttaaaacctagaaacagtatatagtgacatagggagggactacataaaaaagagaaaaagttcaaatactcaaaattaggaagtccaaattaggatgatagagagataaggaagaaccagcaaaagacactgagaaggagctgtctgaaaggtaggaggaaaactggactgaatcaaatgtaaatcaaatgtttcaagaaggagagaatgatcaactatgtcagtgctgttgatgggtcaaatagatgagaacttaaaagggatcaacatatttatcagtatggagattatttttgatcatagaaatagaagaggacaaccctacgtttttagcatgttatataggtttctctttaagatataaatgatattatgtttgtgaatataaatttgtaattgtatacatttataataataattattaatactgtatattaattaaaatctgttctggctaagattatttacaagttagttcattttctctgattatttttagaactgcttaatccattttaatgaaaatgattttaaatgttaatgtccatctgtgggtggtactttatttgcgttgtcttctggcatggactgatgtgtgcctagtagagaggaaaatatattttgttcctagcttatattagagagattcaaatatcagacaaggcgtaacagtgatattatgaggttacaagaaggttaatgctatttagacagatggtgaattgccaattcaacctgttgtcacaataatgagtatgtgaaaaagcatcagtgttgcagataggagaaaaatgaaatagttgtttttacatatccttatacaaatttattaacagctctctcataagagaagagttattctacacaaaaggcgaattattatgttctcatttattagtcattataagaaataatatttttattatattcagtct

SEQ ID NO: 26845 - DNA, 1047 bp, Homo sapiens
taggtggcagttgcaggtgagaggcaattgcagtgatgacagtgggatttttactttgtctttgttgatcagggcaagctccaggatgttccaggttatgggcagagcatgggactctcaggaaagggtgggatcaatctagcaatcctgcaaccaggctctctaaggcatgtgcaagcactggccttcacaggggtctgagggttcctcccagtccactgagacaaccctccaggcagaggaggaagcacctctcctaagccacagagccttctcagggaaagagtggtgacctgatgttttcagcccagcagtcggccactggactcacccagcttccatacctgccagcaagtggatctccttccagcatccagcccaagaagcaggcctgacccgttaggctaattctgagccacctgtgcccaaggcgctatgcgggtccagatgttttgaactgtgagtccctgaagcagaaattgcaactatcttgtcacaccattcctgatctggactaggaggaactgctccaagactgccaacaaaccactcaggcagatcaatgtggggtatgctgtgggtctcccattgcggtaacaaccaggctggcagtcttgggagaaactggcgggcctggggacatgtggttcagatgctcctcagttcccaaacagtgctggtgggacccatcttgggcatgtgaatgtggccagctcagttctatcctggctcggcagacagcaggagctgcagccgcttagggcatgatgcagaattttgcagggtgggtgcccagagtcatgttttgctgcagctgcccagctcactgaagccttttggggtccactttggtttaaacggtctctctgtattctctaggcccaaaggtctgcgagggtggtgggaacttctgtaactagggtctcagaggattgcagtgggaatgtggtgtcccagagtttcttcattcatccattcctcaggtctagtctggctccaggggctgatcttggcaactagtgaggccaagcaagtagccatgcttcc

SEQ ID NO: 26846 - DNA, 1047 bp, Homo sapiens
atagcccatattttaattaaaacattgtttcagtttttataaatgaacaatacttaaccaaaaagatttcttaagtagagatcaaagtttctgtttttatgcctgccatatatttagaaaagagttgaatttatttcaccatgtaatttaggcatatattgtattagatcctaagtaagtaccttttttcatattttctatctaactaggggaatataattaactgagacccccttctgtgatgtggttacataaaatgatgtgtagatattaattcaaattgctctcttcatgcctttttcttattacctcagcacattccctaattaatcattttttcataaacatacaattattcttctgtactatgtatataggcaggagctaattagcagagagtgctttgatttatcaacaaaattccattacagtgatttccttctctgccatcatctacccttaaacccaaagaggtgtaatttcattgtaattttgcagtaactcagtactaaagaatgaatgataaggaaagggaacctcacctctaataaactctgaatgcttgtagccatgtaagttttatagcattctgttcttctgctcagagtaaagtgttccatatgcttgagtcatttatggaataattatagttacttttagtagagtaaaaataaaataacaacaaaaaccttttaccataaaaaatttacttgttgagggaaaaacaccatgttttttcctgaacagagcaagataaatttacaaagcaactcctttgttcaatctctgaccccgaaatccgagagttcaaatcccagagagaatagctatattgttctacacaccaggaaagaaaggaccaaagggaaaaccaaaacatcagttttttatttctttctcagagtactgatgtcttttccaaaatcttatatttagctaggagcttgtttttgccacctttagaaaatcctaatatgtatctatatcaggtatgctacactgtgacattgaatatttatgacaagcatataaaaacagtagtcacta

SEQ ID NO: 26847 - DNA, 1029 bp, Homo sapiens
gaaacatttctctggagagtatataaatgaaaaataagcatattaaaaatgtttgacattattagccattttatggaaatctaaatttaaaacacaatgagatattactacacctatcagaatggctaaaataaaaagagtaatgaaatcaaatgtgggagaagatgcagagaaatgtaataatgaatacatggttggtgagagtgtaaaatggtacaatcactctagaaaatagtttgctactttcttaaaaaaaaaaaaaccctgactaaagtgttactaccatataacccagcaattaactcccgagaatttattacagaaaaatgaaaattatatttatgcaaaatcatatacacaaatgtttatagtagccctaattgtagtagctccaaactggaaacaacccaaatatcctttcatgggtaaatagataaacaaattgtagtaacccatactatgaaatactatggtcaataaaaagaaacaaacaataaacacaacaacctggatgaatctctgcatatgtattctaattgacaaaaatgccaattatgaaaaattacatactgtacaattccatttatataaattttaaaattaccaaattatagtaatggagaagagattagaggttgcagcaatggagctctaatgggtaagtttaaagggaaggtgggagacaagtcagtgtgaagatacaagtacaaaattaaggattcttgctatgaggaaatctgtattttgcctatatcaatgccaatgtccggttgtgttactgtactataaactttttaagatcttatgagataaaactgggtatctataacacggtatctctctgtatcattacttacaactacacattaatatacaattatttcagaataaaatattaaatttaaaatatttatattataaacccaaaagataaaatagtgaatcaaaagttgtagagctcataagccacatatgcagaaaaacataaatagaaataaaataaaatcattttaataatcaatttatcca

SEQ ID NO: 26848 - DNA, 1061 bp, Homo sapiens
atcctttagctagacagagtgctgaatggtgcatttacaatcctttagctagacgcagagtgctgattggtgcatttttaaagagtgctgattggtgcatttacaatcctttagttagacacagagcgctgattggtgcatttacgatcctatagctagacagaaaagttctcgaagtccccactcgacccaggaagtccaactggcttcacctctcactatttttcttcagcacaattccttttatggtattatcttactcacactttatttttagatagaaccatattaaattcccttttttctaagtaaaataatgatctgatatatcagttttatgcagttcattccattttaaattctttgagcaaagtatctttactatatatttagaagtcttcttcacctattctaaaagttccttttttatttcacaaaaatatagccaagaaaatagttttaatcagtgattgcaatgacaagagtttcaattatgcagtgttgtctccatgaattaatctagtgagttttgacttatgaacatattctgtagaagttatgtttgaacaggaatctctggaaaattgccttttctcatctaagacaatgcttgaaaaaaattgagaacaaagcatatattctctactgaattaaaaatatagtgtaaaaactcttattttctgctgataagaaacagatgttatagcattaatttggctttaacaaactattagctgtgattttatcatcatacaattattgtaaacttgttattgtttttatccctttagccgataaatatgttaaaaattaaaatggaaaatttgagttctagcttgaaaataaacacttgctagatctaatgattattctacatgtcatgcaatcagaatcttgaatgagatttttaagagagatatggcactaccttttatctgtgtctttaaatattttagtaacagcaaggttaaataaaatttttgaataaatatgttttatattaacttggatacaactttaaagaatttaaaatgctgaatatagaaaaagaaaagaaattg

SEQ ID NO: 26849 - DNA, 1115 bp, Homo sapiens
acagagaggggtcccagaaaaatgagttgctgatttcgtggtgaaatgcaagaggttttatagatgagctagtggaggggcggtatctgatctacatagggtccgaaaaactggttagaccagttgcgtcatttgcatggggcacaaatctcagcccccccgacccccaccccaatcttttattatgcaggcaggttctctgactgagctgctccatgttgcccatttctttcttgtcatacatgtgctaacaaaaaaagggaagatggagcttccatggcagacatacctggccctcaggtagtccttctctattggcgcagctgccagcattcccccgtgcaagcttcaagcttgcttatcgatgtttgcggctcagtatttcaggctgctctttgttagcaaaaaaataatttcttggactgctttttgttaaaagggaaactgccgatgactcttttgccctcactatctgcctaaataatttatttctaccgcctgtatcaccatgacctttgctcttgaccagtctgcttttgctttggccgagaccacttccacttctacttcttggtagccattgcttttatgtgctttgtttttaggattgtaacggtaatgccatgtttcacttctttttaaaatgcttcgaagacattctttaggctcttggtcctatttgtttaaaatttccatggaaagctctggtcttgtgtgcagctgatctgagtgccatggtcttggcacccattgagtggaaagtttgcttaactttaattttccagtcaaaactgagtaagctccactaattgagatgtctgtggcattggatattacttgtgccattaaattgttggtcctcttcaattagggcacaaacaagatgaatattttccttgaaaattgatgtggttggtctgccactgcaggtttcatcttcaatattatcttgtccattcttaacattcatttgtaaactgttcatttctttgggacattttccccatgaactttttgtaaagcatcaatgatttcaccgtaaatttgaggtgtatttttgcttcaattttagcaagattcatgttgctctgatacaggctgttttcaaatggatg

SEQ ID NO: 26850 - DNA, 1060 bp, Homo sapiens
taacccaattggaaaattccagtcttcactataacatgtttagatattagctgctaatatctatcacaagagtgagttgatgaaattggacagatgggggttgttacctcagatgatgctctagacaagcaagtgtcacagacagaggataatgaaatgctataaatatgatacatgtgggaaatgggcacctttagaaaattttggttaggtgacatgttttaacatctaggggttccttatgggtaggatggccctttaggagaaggctctgtgttgacagtgtggatttagggttcaggaacttagcttgaacaaaagaacaaaacctagggaattcatatatgatgatagagggaaaaataaaagtaagacattacttttctgccgtttccgtggtacattttcatagtcagggtttcaggaaagtttggtaggagaactggatgttggagagacaactagacgtgccatgtttcagagtccagggtagctatttcaatattaaaactagagaaagaagaggaattggtgagtaggaaaaaataactggattaaggtcttagaaataagctgaaacaagaagaatgaaaacagaagagataaacaggaaggtaacaggaatcatgtatccagagtgtgttgctattagatgcaggtgtttaaacgtaatagagcaaaatggatctgagaaacttagaataggctagtctctaacatggagcaattatgtttatattgtactgtttcagaagccagaacttaggttcatttataagaagacatattttagttccaatagagaagtaattttctctatttcatattatataaaatttgaattagtggcctcaccggggagtgagtcagtccctcatggatagaattatgtaaataggctgaattatcaccattgagtttttctataatgcatacaaggcacaaagaaattatttctcaaaatcttccaacttttcaaagagtaacgtattttattttattttttattttcgagactgagtcttgctctatcgcccaggctggagtgcagtggcacgaa

SEQ ID NO: 26851 - DNA, 1040 bp, Homo sapiens
gaaaaaaggtcagaagaacacaaatatcattattttaatggcacaatcaagcgctggtacacaccactgcctctttataccaatgaccataactaaggcacatagacatgccaaacttcaagagaagctaagaaatgtgcccaacttcaacacaggaggccttttattaaaagacaagatgccattatccttagcaaactaatgcaggaacagaaaaccaaataccccatgttctcactttataagtgggagctaagtgatgaggacacatggacacaaagaggggaataacagacactgtggcctacttgagggtagagggtgggaggagggagaggatcagaaaaaaaataaatattgggtactaggcttagtacctaggtgatgaaataatctgtacaacaaagccccatgacatgagtttatccatacaacaaacctgcacatgtatccctgaacctgataaaagatatttatgatatctatctatcatagatatcaatatttatactttcttcttttaaacttagatcgtactctgacagcaggtatcccataactatctataatattaacatgtacaaaaatggaactcttgattttttcttctaaacatgcttcctctatagttcgttccatttctgtgaatgtgagctatgttcctcaattgctcatgacaaaatcttcaggtcgtctagaattattttccttttttatttatgacttcaaattattttcatcagtaaatgttgccactccatttatattaaatatatgcagaatcctacatgtctctgcacatccaatgcttccactatggtacaatcatggttatttctaacctggattattagagtagcttctaaactggtcttcctacctccaaccttgccttccaacagtctattttgtacacaacagccatatgctgcttttcagattgtgacacttctcgaatgtatctctctctgggttgagtaactcacaaggctgtaggtgtgctacctctgttgttcttcacactttaatcttttcccctc

SEQ ID NO: 26852 - DNA, 1055 bp, Homo sapiens
aggtattaagtaacacgtgaccatatataaatagatataatcatgacctaatgataattatggaaaaataaaaatattaaagcaattgaatacataaatccaaccaacattgttttatttcctcgttgccaggaaatatttgtcaaaaagggtgctggaaaaggtatgctttgaaatagcttatggatatttattgcagagaatatttcacactataaagacattgaatactatcataacagactaagcatatatgaacattaatattcagggtatgtagcttacttgtttataatattctaataatttacatgggacattagcttttatgtatcagttaatattttacatttttcaatcagtctttaagttacatataagaaaccagttataacatatataatttttaaatttttttattagcttagaaatgtactcttatctagcttataatatatattaattttttatttgtgatacagttatttcaagatgagataaataaaggccaagtctatgctgttcatatgcttctggatgatcttacaacacaaaagaggaataaatgtcttcatgtttgtactacaattgcctctgcatttttatcacttattggtgagaacaatttgctacaaagcaataataaaacggaatgtaatcaaatgtcactatggtctgttatattgcagtaatgtcaaataagaataataggtttcataaaatgctgggcaaatctgagaacaacctgattcagtgggtgttcggaatcatggctcaataaattgtattcatatacatttggtatacactcaccgatatataataagctatgtctgtgattttatttaattatatacgattttttccacagtagattattgaaggactttattaagtaaggttttatgagccaaaattcctcaatagatttgaaaccccaagtataatagtagagagaaaatctacgtaattgttcttcatcctagggtcctttgtcagagaagaaaaagggaccagttctgtgccctgttgtggtccaaatatacaatacttta

SEQ ID NO: 26853 - DNA, 1114 bp, Homo sapiens
acatggtgtgtgtcatgggaaatgtgcccacaggctgaagtgtatgtacaaaggcatcacatggggagaacatgctggaggggttttatttgatgttttcaaattgctctagggtctgtcttgcaagaaacccttttggttttcttttctttttgattactttttattttttatgttttaaaacatacatatttcttttgaaacatactgccaagagaaagagtaaaagagtaattacaaatgaactatgcaatcatattctctctgtctctctctctctctctctgtcacacacacacacacacacacacacacacacttattccaaagataaacagtcaagttctatgtttgtatctgtggagatacctgccacagtcagcagttaggatttgtgaaattgcatatccagaatttgagatcacaaactgtactgagggcaggataaagaaaagatggcactgaagtgaagagctattacatgtacccatgaaggtatattttcatttgcttattggtatggctgtgtgtatttaattatttaaaactattaggagacatatatattttcctactaaatgggagtaattaaaatagcccactcccttgaactcttaacatctcattaaaggttgaaatcaggctttgtgtcaccccaaacttacacctagctcattgtttttggagctttagattaggacaaagtattctgcaaaactatcttttcaatatgccatagaaagctaatttgaaattttaaacctgacaagaacacttcaactttctataagtgactcaagtaattacttcttcacaagacagacatagttttgatgctatattcatatcgttttcatttcatgagtctttcattgcttccttttaaactgaagctggacactcatgggaagcttagtattcataacagacagtttgcaaagaatgaatgtatcttgaaggcccgatggtaaaaggcgtgctctttcttcctcccaggaagaaagcatgctgctaaacttctgtttgcacacaaaagatttctacaggagagtttatgttgctctgtggtttaagaagtccgagccctcttaccaggggtagcccccagcctggc

SEQ ID NO: 26854 - DNA, 1029 bp, Homo sapiens
catctggctttcttacattgttttcaccaccaaaccagttttcttaactatcagtataagaaatctgctgaagtagcatccaattaatattgcaaacacatttctaaactttagtaatctccatctgatataggaaaaactgtgtgatttctaattcctcatttctccaagtcaatgttatgtatctggccacggaaattcagggtaaatgtaataactcttgggctgtattatctgaggattagtcttagcattcaaaagttgtcagaggcaatattgatgaatatcaaaataatatatatttgatacattcctgcttattgatgtgaaaaacatgaaactaaatggtagtgttaatacctttattaattttacaaagtgaggttataaaatcttccttttcagacaatgtcaaaaagattagaaactgtgacaatatactttagaaaggaattaccgaatccctcaaatgttctgttacctactattataccgtgactagagacaccattataacatattttattttatataatcataataaccactggtctaaaattaaaagacttttttttagaaagagacagaaatgaatcattgattgacctattgctgaccatcaaactaaacttggtaaggaaatattctacagtaaaatgaataggtaagatggttttaaacctaaaatattagcaaattgaaaaaaaggaaatcaatcttcaacacacacaaaaattatagacagaggtaaaagaaattcaagcaagatgtcccatttgtagctacaattaatttagtttatgaatgagcatgattaattacaaagcagtaaacactgagaacttttgtgcccatgccgattttacaataatttatttccattcatttgattcttttatgtttagttaattaattttcaataatgtgttaatgtcattcttagttcaaggcatctgtagctaactgaaattaaacatagctccagagtctgaactattcagaatgttttaagatttattcaggataccc

SEQ ID NO: 26855 - DNA, 1051 bp, Homo sapiens
aactgcaatgaattaaaacatatcaaatatttttaagtgcacaagttcataattatactaaaaaacaaccctaattggtcacctttggatcctaactttcctgtataaatttattcttcacggtaaccgaaatggttgataaaggaagttttgttttgttttgtttttctaaaagcattccagtcaataaaatagattggagatgatagaattataatgtcataactttgcaacccctaatgaagtaataggtccaggcaatggccttaaatgactgctaaattaatacaaagagaaacatccagacattatatgccttctgaaggaagttcacatcactacctgtgaaatgctttttttttttttttctttgagacagagtgtcgctgtcttgcccaggctggagtgcagtggtgtggtctcagctcaccacagcctctgcctcctgggttcgagcagttctcctgcctcagcctcctgagtggcttggattacagacatgtaccaccaaacctggctaattttgtatttttggtagagatggagtttcgccatgttgcccaggctggtcttgaactcatgacctcaggtgatccacccgtctcagcctcccagggtgctgggattacaggcctgagtcactgcacctagctgaaatgctcttccaaaaacattgagtctagcttagctcagcattggttaatagaactttctgtgataatggaaatgttctatatctgcactgtccaatactgtggccactaaacacatgggactaaatttaaaataaaattttaaattcatttagtcctgctgcaggaagtcagggacccccaaacggagggaccagctggagccacggcagagggacataaattgtgatgatttcgtggacatttatcaattcccaaataatacttatataattttttatgcctgtctttactttaatctcttaatcctgttatcttcataagctaaggatgtacatcacctcaggatcactgtgataattgtgttagctgtacaaattgattgtaaaacatgtgtg

SEQ ID NO: 26856 - DNA, 1029 bp, Homo sapiens
actcttgggctcaagagatcctcctgttttggcctctcaatgtgctgggctttaggcatgagccaccacacctggcctgtatactgttggagaaaagctatagttgttatggaaaccccacatttggtccaggtcccgttgctactggcacaggaagccaatcactgagacaacaagtattgtcaggaaagaaagcttttttattcgggtgatgtcaaatgggagaacagaagaataatctcacattcacctctctgagcaactaaaattggggtatttatatagcaggagaagaaatgtcactacagtgttgaaagaaattagggaggggtacgggagtagtaataatgaatgaggagtctgacatctcactctctggatgtggttttagtcccttgcctgtgagtcagcttcctgaggaaggaagtcagatgagacaaatacaagtttcgagtttcaagaccaaaagggtccatttctgtgtttattctaaaatctataaacatcatttctattggacaactgggctggtttcacattttaagtaacttttagacattcagtaaaatttggttagtcattacttctattttacatataagcagactgtattagtcatggttctctagggggacagaactagtaggatagatgtgtatatgaagggaagtttattaaggagtattgactcacaggatcacaaggtgaagtcccacaataggctatctgcaagctgaggagcaaggaagccagtctgagccccaaaatctcaaaagtagggaagccaacagtgcagctttcagtctgtggctgaaggcccaagacccccctggcaaaccactggtatatgtccaagggtccagaagctgaagagctaggagtctgatgtttgagggcaggaaacaaccagcatgggagaaggatgaaagctggaagactcagcaagtctgccctttctaccttcttctgcctgctttattctagctgcattggcagctgattagatggtgcctacccagattgcaggtg

SEQ ID NO: 26857 - DNA, 1027 bp, Homo sapiens
aaattcaattttaaaactaaatgtatttaaagaaagaaaccaaagcttcacccaaagtcatgaagatctactttccttttttctgtgttttatagtttgagcttttatatttatgtctttgatccacttggagttaattttctgtgtatggtgtaagacagagatccaaactaattcttttgtgtgtacattacagttatccccatactatttgttggaagaactagtttttctccattgaacagtcttgattccctggccaaaagtcaattgaccaaatatcaattatgggtttatttttgaactcttaaatctattcaattgatttatatgtgtattatcttatgacactaccacattgtcttaattatcacaagctgtgaaaccagaaagtatgaatcctccaaattgttctttataaagactgttttgactattctgtatttcttgaatttcagtgtgaattttaacatcagcttgtcaatttctgctagaaagccatcggagatttttataaggattgcattgagagtgtagatcaatttaagaagtattgatactttaaaaaacatatgcctttaatttgggaaaataagatatcttttcatttacttagatctttaatttctttcaataatatatagtaagtttttaatgcagaagtcttgtactttttaaaaaattattttcattttttctttaagagacaaggtcttactctgtcagccaggctagagtacagtggtacagtcgtagctcactgcaaccttgaactgatgggctcagcaactcctcccacctcagcttcccaagtagctagactacagacacatgccactgtgcttggcttttttcttttttcttttttttaagacatggttcttactatgttgcccaggctggtctcaagtttccagcctcaagtgatcctctcacctcagcctcccaaagtgctggaataatagacaggagccaccgtacccagccttaagtaattcttttgatgctagtgtaaatcgaattgttt

SEQ ID NO: 26858 - DNA, 1032 bp, Homo sapiens
tcctctctcctagaatttatctaccctgttctttcagtatgtccctgttttttctcttactagttttagaatataccattcttaaacctaagaactatagcctattctttactatttgtttggagtactctcagtgcttagtatagtcatacaaaaaaaaaaaagctctcaatgttttctggattggactgtgtatgcaggaggaatttctaaatgagaaaatgaaaataacaaaagtaatgtcctcctcgaagagtcatcaggtagctctctatctcccctgaactttactcaacaatgtcaaaacaggctttttgatttcacaaccctgatattttgtctttagatttatttctttcaaaagacataggagctttacatactccagtataatgattctatgtcttaccaaatcaaatatgatgtttagtaaaagtttcattcatttcaatgtaatttaagagacactgctaaaaagatatagtattacttttatatattaattgtatatttgattgtggtatttctagccatttctataaaaagattagaattaaatcttgattcagatatttaactcttacagtaagttttctatggaaaagccaatattcagtttgcaatacctttatctagactataattttttttctaagcaagaggattttttatgtatttttaaattattgtaatgttttggcgatggaggagagtcttccatcataaagcgaacaaacaaatataaattacctgctcttatcttcaaatctctgactatcaatcttgatatgtaaatggtgaccagaatgaaagtttaaagtttagtggtcattccgccatactaggatgttaaagtcttactttatctttaaaatgaatttcatgatatatatttttacccatgaagcttagggatatttgagtttagggttttcagtactacctctaatacatatgtatttaagaggatgaaataaattataaaagttactgaaacctagtggttatgattgacacctctcactctaatgc

SEQ ID NO: 26859 - DNA, 1068 bp, Homo sapiens
atttacttttgtattttctaatgtaagctacttcagcaattccatagtttggagtatttattaacatgtattgtcaatacatgtcaatataatttgtataattataatggaagattaacatctttatttatttatttatttatttatttattattatactttaagttttagggtacatgtgcacattgtgcaggttagttacatacatacgtgtgccatgctggtgtgctgcacccactaactcatcctctagcattaggtatattttctggttgaaatcttaaaccgaagaatcatctcacatgctggtaattgtgacacaatatcttaaatgacagtctcaatgttaataatagtactcaaatgttttatgtattatagtatagtattgtgattctgcattttttgtctagatcatctttgactgtcatctgagtctatatgcctctgttttcccttttaacagtagagtcaagtaaactccaactgtatttgaccttagggttcggcctctgagcaatatgtaaaatctgatcttagtctaaggcagaggaaaaatgtaagtcttagtattatatatttaaatttgattttaagggagaagtgttctacttcaaaaagtaggcaaatttaaaacttagttcattaccttcagaggaatatgaaaagaaaataatggtggagatagtctgaaattcttatttttagaaataactgctataatatagagaaaatagcaaacatgttgacgtattttatcgctgcatacttctatctttcagtattagtcttttgaatattgttgagtatgttcatttaaaaaaaataaaacaaacctctctttgggtttccttataaatttggttggctcattctgatccctgtttcattctttgactctttagtttatttgcctgcaaaagtggcagagaaaagaagacttattgaagacgtttaggaacaggaacatagtttgacagtcttttgctccagggtgggtaggttgagtaaaatttggttaaaatcaggtcgggaacaatttagttagattaaggaagatcctgattt

SEQ ID NO: 26860 - DNA, 1028 bp, Homo sapiens
ttcatattgattctagcagctgacatctaaattgcattacagatctgtggcccctaacactataaactccaagcactttcattgtaatgcttagatttatatatttgcaactggagactgccactcaaaaaccaccccctgtttcatgatccatggttcagagtatgagatacaattgctctttcagaagtctctaagtagggaggttgtgtggaagtcacctacatactgggttggacaaaatgtcaggaattggatgtttaatatttttcaaataaatatatggaacacctgctaggttttcacatccttttatagaagccagagacctcaaaagtagcaaaaataaatatgatcattgtgctgatggagatcataatggagaagtaagatattaattcatcaatcacacattaacaacaggataagtacagaggtacatggaacaatgaaagtatatcattgggagatatagcttggtcagaaaattttaccccagcattattatttgactgaacactgagggataagaaagccttaattgaatatagcagggagggaaggaccttccagccagagaaaaatatgtgcaaagacattttggcaaatggttggtcattgttaacatatcatctgttgccatctcaaacaagatgggaactagggatacacacaagaagtcagcacctgctatatattatcccaggaacaagaggtcttaggagaatgctatattcctattcattcccttctgctaaaatcatcagaattaactcttaggctgggaaataaaaccaaatctctggtttttataactaggtcaaagcaatgctgggcatttgggatggcgaataaaaagctttttctttgtgtatgcttatttgtgtccacttgatagtgtacttatgtgtttagatttaaaatagatcttccagtctcctgtgacattaagtaatttgtagcaaatatgaaatatagtaggtgaaagtgatttaatgagtacatattcttatatactcaaaaatatt

SEQ ID NO: 26861 - DNA, 1029 bp, Homo sapiens
ttcattttgtttatctctatcagtctcctagggtgtcatgtgtatacacgtaccatggcattgagacctatagaaaataagtataatatatattctgttttatgctatagattgtgagcttctcaagggcaggggcctggtcctatttgtcttccctttgttaagtgtagtgtcctgagcactgaatatctattgatagaaggaataagtgatagcacatatctacccttgtgcctctcctgcagcatgttagaatggaccccagtgggcccctctccacataggggattttccaggggaagaatagagacagtaggaggcagccaactagtctaattccacttccattcctatgtggaaatatgatgaaggaaacactgccaccagtagctatccagagtttatttatttcagatgactttataatgagcctgtagacagcattttgttgttcattcacgtgatcatttactcaggttacttttctattaccttttcatttagtagactaaagatttaaatgtgaaccttttctacacataatattcacggtgctttttttctgatctcagatttagacataaaataaaatatgagagaaacttaattcccattttataatatttatgaatttaataatttaaaatcattttaattgaaataacatccttaatgtaatcatgatagtttaaagcagaatgacaatgcctagtagtaaacctatcttgataattttgaccaggacctctgtaaaaactgtccacaggaagtttgctaggtacacagagagagttcttgtctgtagagcccactgtgtgtttcttcttccagtaatatacagtgcaagtgcttgggacagttccacttggcccaatcccattttccaggccagtgagcataatggcagggtagaaatgagatgtgtctatgtgcctttggtaattactgagtatatgttaatgaagagcttttccttggccttccaccagcacggttaaatatgaccaacgagagcttttccttagtgaa

SEQ ID NO: 26862 - DNA, 1047 bp, Homo sapiens
gttgttgcaggggctggtaccggtttttcctttccatatttagtgcttccttcaggagctcttgtaaggcaggcctggtggtaacaaaatctctcagcatttgcttgtctgtaaagaattttatttctccttctcttatgaagctcagtttggctggatatgaaattccaacaaacatatgaaaaaacgctcatcatcactggccattagagaaatgcaaatcaaaaccacaatgagataccatctcacaccagttagaatggcaatcattaaaaagtcaggaaacaacaggtgctggaaaggatgtggagaaataggaacgcttttacactgttggtgggagtctaaatgagttcaaccattgtgggagacagtgtggcgattcctcaaggatctagaactagaaataccatttgacccagccatcccattactgggtatatacccaaaggattataaatcatgctactataaagagacatacacacgtatgtttattgcggcactgttcacaatagcaaagacttggaaccaatccaaatacccatcaatgatagactggataaagaaaatttggcacatgttcaccatgaaatactatgcagccataaaaaaggatgagttcatatcctttgcagggacatggatgaagctggaaaccatcattctcagcaaactaacaagggaacagaaaaccaaacactgcatgttctcactcttaagtgggagctgaacaatgagaacacatggacacagggaggggaacatcacacagtggggcctgctggtgggtaggggtctaggggagggatagcattaggagaaatacctaatgtagatgacgggttgatgggtgcagcaaaccaccatgacacgtgtatacctatgtaacaaacctgcatgttctgcacatgtaccccagaacttaaagtgtaataaaaaaattaagaaaaagttaagtatgtcatagatacataaaatattgtagatactagtttattttctcatttatggccataaaatatacacaaacctattataagaagt

SEQ ID NO: 26863 - DNA, 1539 bp, Homo sapiens
gctaggtaacaaagcgagactctgtgtcaaaaaaaaaaaaaaaaaaaaaaaaaagtcagcacttatgtaatcatctcatttaatctgaacaactttaatatgcattttctccattgtaaaagagaaaactgaggctcagagaggttatgcaacccatctatatttatattttatatgtattgtgtccagatataacacagagatacctttttgaaaaagttactgaagttgcttttataaatgttatgggtagtacagaaacttatgtgggtctagaaactttgatgtgttcactgaatttcaaattcgttcaatatacttattatgaatcactaaggtttcttgtaggcccacttaaaatatttgtactgttttaaaaaataatttccttctgatattggttgtatttcataataataatgttaatgtttaatgcttcagtaaaccgtaagaaccaatgtaatagtagttagctgcctgttttgttaacaagtaaccctgaattaatatgtacctcttgctttgaaatctcggtctcagtaagatttgaagtgattatgaggagacactcaagggagccaacgtgtaactcatgttgcccattatgacatttgactatatctgtgtcgaataaatgtccttaatgctatgtaaaggacagaaagataaacaatcatgtcaaatcatacatataatatctagccaagccattgacccaaatcaaaacatatgtagaaagaaataaggggcctatcatccaagaaatttgttttgatatctattactgggtatttttgagcctgaatattagagagtctagagttatataaaatctattctactcgaataccaagctgtatattgtaggtatggctaggtattgatgcaaattcttactttataaatcaatttttgatgctcaatttttttataatttttcctcctcttaaaatattgtaagtcctcatttttaacaaactgaatatctgttattgactttgcattccatatatttgtcataatcattttttagatttttaatccaggttgacttcgtaactagcatttgggaccatatatattttcattcctgctcaaataactggcttaccacctaacccactactctattcagtcttcccttgaattttgtcattatggcaaaagaactgtgtgaagttattagcaattttggctacagtctctcttagaatgtttgttgtccttagggactcacagcaggcaaaaaaaaaaaaaatcacagtccccttcagcaacctgtgcttttctgaaatattggctttgacaagcctgcaggggtgagaaataattttgtgtgtgagggtttgcacttcatggatgtctttctgagttaattaccaggaggaaatggaaagagagccattctcacccttaccttcaaccacgtgattatgtgaccatagtgctgaatgattatctctgttttggcgaaagtctataactgagccttcatttaaaactggtacctggcactaatctgattgagtatattgatca

SEQ ID NO: 26864 - DNA, 1069 bp, Homo sapiens
acaatagtcttaaatactgcaaacgcattctaaaggtagaggcctagagtttttttttgggttgcttgtaatattttacttattggcctgggcagtggtttatatgggtgtgatcagtgtttactcattaaactgtataatcgtgacttgtgtacttttctttatgaatgttataccagaacttaggaggaaaaaatttttgagcatactgaatattaggaattggatatctccctaaattattaaagttcatcttccataaattctgtaaaactgaatgtagtatttccccctcttcccatgcaagtaactgatatcactttagaaaacctgatatgaacattatttgttattgtgcttttatgaagaattctgtctaatcttctcataagaagaaagaattagaaccaaaaatctaattatcagatttagtaagatgtaggcaagatccacctatttttttcatttatgtctttcaaaatcaatcacattctattattcaccgatccactaaacagatgtagaattcctattatgtagcaggcattgttctgttaatgcaataatataatcaactaaaggaaaaaaaaacaaaaacaaaaaacccgctgctcctaagctgttcatggtttcgttatactctcaatgttaaacacaatgattgggttaaataataaagctctatatacattagatgttttcaaagtgagaggccgacagactatttcctcttggttcagtccatgacatcatcaccaagtgaatgtctgaactgagacttcaaggatgtgtaaagtaatttcttatttaatataacaggaagtttagagtaatacgggttacttttctagaggcttaactatgttacctgccattaacacttttggctttaccttaggccttgctggttattcgtgtggtcataagacggctgccgaaagcaactgtgatagcatgctgcctttttcacatccagcaggagagggaaagaagtcacagtttaccagttcactgaggagtgtcgtacacatgttgacttacgatattctggaaattcgtatgagttggt

SEQ ID NO: 26865 - DNA, 1041 bp, Homo sapiens
tcctacacctgatgaatctaatctctagggctggagcctgacgttgctatttcttacaagcccagtttgattctcatatagccagggtggagaactcctgggttacatgagtaaaaattcaaggtattttcaacaggtgggaacagaacagaaatctttctttaaaaactaaatcaaacctcagtaggctatgaccatgtaatcaatgaactttcatactttatcatactgtttttccattacagtgttctctggcactataaattgctaatgactgtgtgtaaaagctaaaaaagcaattctatagtctcaagttgctgtgagaaaatcctataaatgacattctttaagtaagtgtgaattatcctgtccttcaggcaagaggcctagttttttttttcttcctctcttctttttaatactttgttattcattgcagatggcaaaataagatctaaactcacatgacactgagttactccttcattattaagttgtctggtacctttaaagtgaaaaaatgaaataacaagctctcagtaaactgaagtggttttaaattaaacaagttcttagtacaatgtgtttctctcacatgctccaaaatgttcactaaaatgggataaacataaggcatttacaattgtaatttaaatttttcttatttggggcaaaagttatcaaatatcatgttcagttcagaaaatgcatgtccaaaattggccctagtcagcactaaatgttttataaggagagaattcacagctgtattcagctgccacattagaatcaaaaaccaaaaggaaatgaaactaaatttttatgtaaactaaatgtttccatataaaatagcacaagggaaattagtgtataattattcttataccctaaaaatttagatttgtctctaaaggagatttcttgcataaatttcttgaagtgtatcagaatatcagtatgaattccccacaaattcctcctagcctacatactatatggtataagaaatcctcagtgtttcagatatttgagttttaaaga

SEQ ID NO: 26866 - DNA, 1039 bp, Homo sapiens
ttatttgttaaaacatatcaattttgtattgttaagatgaatcttatgtattatataatatggattttcaattactctgtgccttattttgagaccctccaaatatgtagctcctctttatacaattttagaacctttatcgtttaaatataacctctgactctaccagtactaattgaaacattaaaaaggttacagaggcatatatatcactatagagaatatttggattttatgttttacagaatagctctcattcaggattcaaaaatgtaatggtaaaaactggtaaggagtaagttaaattaaaagacagcattttctttaaaatatatttttttcaagaatttatccaaatataaaccctgatatagtgatctacttaggaactgtttacctgcttacttatgaaatatgagcactgaaatgaatgatggtccccagacgtatttataatgtccctttggaatttatgttttctcaaccagtagaaaatgttgtcatgaaatgaaatgagcatttaaattactgtatctggatcatatctaaattatctaaattcattggcatcagatttttaataaatatgaatcttgagaggtagctttttatgttcattcattcatgtaacattattgaatgtctgccatatgcagtacactgaatgagactgatataatacttataaaaataaggcctggcttgatccagtcaaggaaacaaataattataatgcaatatgatgagtgctaaaataaattctatattagctgcaattagctgctaccaaataacaaacaaatacattttaactaacaattccttgatactataggaacagaaattataggattaatttatccatgcatatatacatgcattcactcattcacttattcaacaattaattattcagtaccttctttgtacagagcaagacactgttcttgctctgggaatatatcaatgaacaaaatttcaaatatgtcttgtgctatagagattacagtttagtggtataaagaaaatattccctgta

SEQ ID NO: 26867 - DNA, 1044 bp, Homo sapiens
aaaaagcaataatgacttattctttcttgaaaaaaaaaatgtaaagtagaacattctttgtttctgtggtaaatgtgcgaatgtaattattatcttttattttctggtttagcatttgttttcttacctttaagaaaacacagacaatcttcacaatagaatattgggttctgtttcctttgatgtagtaatgcatatacaatattgcactaatgattaactggtgtgcccctgaggtttcccagacaaaactgcctttcagcagattccttatctgctatcaggggagtgtttacagcagctagaactcttaagcgccttgtctctgagactgatggggataattaagccagtgtttgccagccctctgctcttcttggtgaggttggaaactaggaaaaaacagatacattagcccaaaacaaaacctgcaaattcatgttcagcaatttgaaatagattttattggttgattttcttctaaaccttccactttatttctgatagaaacctatctgaaccttcaggcagaatagaaaactgccttctcaatacagatcatcaaattttctatcaaagcgatatagattgatggagatatatatggatatatatatgtatatatatacaagtttttaaaatatgtaaatatttctgacttttatatatcacatttagaacaagtttagatatatacaatagtatttaataagatattgcacagtattctgagtcaagacattttaaagggggcttgctgttgaagatttcatgatttttaagaacaatatctgttgtgaaattatgtggcaaaatatgatgttgcattggtttattttccctcatcctctgcatttctagaagaagagttctcataatcagttttaaatgaattgtgcagagatgtagctgaaatagaataatttataccagttactcatgcagtaaattaggataatatacttttctaaacttaatatatattcagtgaatgtattcatcttttttcatatattgtatatatcttttgacatacaaggtttc

SEQ ID NO: 26868 - DNA, 1048 bp, Homo sapiens
caaaattgcagttatgatgttatttactttacagacagcctatatgcaaaaccttccctctttgatatactaactccagaaagagccactctgtcttggtgtcagctttcaaagatgtcactgcttcatcagtatgaaatatttacctaggctatttgactggtggtgtctagacaaagaaagcatggaggcacatatggtttgattcaaataatgtagagtcttcctgaaagcctcagatcagaataattaaggaaggctttatcaattacattgtatgaaccaaatggaaatgttattacacaaaatttcccttatcctgaaactttaattaaagtatgggttcaaattctttatggaccttggggatagacttgggataatactgagactacacatttgtaaaacatagaataaaaaaaaacttttggtcacttttgtttggatgttgaactcacttgtttagaatccatgttgagttggctgtaaactaaaaatttaaactaaaaatttcctctgagaaaaatctgttaagaagatgggactgtatcatatctgacagaagcaaaatctgggcttattaatacctgattgagacatctctgtttcatcctgattaactcacaaatagttaagtaagtctcagtctaaatcactgaatttttcatcaaggaaaaaaagtgaagaatttagatgattttagacacactgaaagagtagcatgagttagtaatcttatgtagattttaaagatttttcagtatggtcactgaaagtcaccatgctttctgtggtagaaagggtcattttattttccttaaaatcttggtaaatatccatacataatcattaataaaaatcagcagttgctactaagtttggtcatttagcagcatttactgagagcccatgatatgccaaacattagattaggcattattctaataaaaaagttgctacaagagtcccgaggaaaaaagaaattacttccagttacataagggaagcaacagagattgttttgaattcagatatgagacttggagct

SEQ ID NO: 26869 - DNA, 1958 bp, Homo sapiens
tggacctgcccttgacaggtggggggattattgcaattcaaggtgagatttgggtggggacagagccaaaccatgtcaatcagctaatcaccaattcattaatttactatttctctctatatctccctttaatttctcattttttttctaaattttccctggatcctaaaaacatttgaagacatgaaatgtttttcacaatgattttacaagacgtgaagcaaaagagataacttgctttaaacgaaattagtatattccagccagatgcagtggctcatgcctgtaatcctagctattgtgaggctgaggcaggaggatttcttgagcccacaatttccaggctgctttgagctatgatcttacactgcagtccagccaggcatcagagtgagaccctgttcccacaaaataaaaaaaggtagtgtattactttacaaaatcatttattactagactgctagagagcaaggttaaatgacaaaatctctgatggattaaagtaaacaaatgccataatatacaggcattaaaacaagcaatggtaagattcagataaaagaaaatttaaaattaaaaaagaaagaataagtagagatgagtgaagaaaaatagaaaactaaaaatgataacgggaattattaattttggacagatacttatatatttaaacatcttttattgttacatttttttaattcaatgctacatgtaagaaaaggaaatttgacagcagagattagaaagtcaaatgcgtaccagggtcaggtagataacataagtaaatgaagaggactgcaatgaaccctgtcacagggaacatgtagcattctgttgtaaaggaagcagtgtcactcagctccactgttgtcatacagaaatgttagcctatttttatataatcatgcaatttatcaataaattaatctctttttatgaacttttcctccttttaattttggcaaataattcaagaattttaaacagtgtagagaccaaacaaaaaatgtaatagaccacatttagtttgtggcttgccactttttgcaacctttgttttagaaacttaatgagtcctagatcagtgcttgtcaaatgtgcactggggatagtgttacaaggtagattctaattcagaaggttggcctacagcctgcctgagattctgcattccttgtgagttccaggggatgtcaatgctgctggtccacgggccgcacttgtagtagtagggacctacggtgctattaatagtactaaaaccgagctcatatgtcttccaactcaggtgtggagaataggccatatctcccaagataattcccactgattggttatgattaccaagaatagtatggtttctctgggcatgggaaaaaagagtggtggtatatgtgtcttatatttagctagcctagcttgatcattttacaaaggaagaaacagattcagagaaattaaatgacttcctcagcctcaaacagctatgcagttacagaagaaaagctaatattgatggacaccattaagagtctttttttttccataagttattggggtaaaggtgggatttggttacatgagtaagttctttaatagtgatttgtgagatttcgttgcacccatcacccaagcagtatacactgcaccatatttgtagtctttcatccctcgcccctgtctcactcttcccctcaaatccccaaagtccactgtgtcattcttaggcctttgtgtcctcatagcttagcttccacatatccgtgagaacatacaatgtttgattttccattcctgagttacttcacttagaataatagtctccaatctcatccaggtcactgcaaatgctgctaattcattcctttttatggctctgtagtattccattgtatgtatagaccacaatttcattgtccattcattgattgatgggcatttgggttgcttccacgatt

SEQ ID NO: 26870 - DNA, 1062 bp, Homo sapiens
aattacatgttttatgtcaaatcacagtagctatatatgtgtgtgtatatatatatatggatatatatggatatatatatggatatatatggatatatatatatggatatatatggatatatatatatggatatatatggatatatatatatggatatatatggatatatatatatggatatatatggatatatatatgatatatatatggatatatatggatatatatatatggatatatacatggatatatatatatggatatatacatggatatatatatatggatatatacatggatatatacatggatatatatatatatggatatatacatggatatatatatggatatatatacgtggatatatacatggatatatacgtggatatatacatggatatatatatggatatatatatatggatatatatgtggatatatatatggatatatatgtatctccattggttttattacctttcaaccatatcatataaaatagaactataacttgataccttaatacctcccattttgtatccttttcacttttaaagttatttaaactgctacattattcttagtactttcattattaattactttgcttaacaaactatagtaaatgctgtaaaaattctgaaataatccttgagtaaatggaaaaccacacaataataatgaaaactgtaactattactatcattattatgattttatctccagtttcattgactgcaaaaatggctcctaaaaatagtcattgctataatctgattaataatttaacaagaggtgttataggagtttattatgctttcctcacaaatcagttgcaactgaattcaaattaggctctgtcaacttagttagctgtacaatgttggacaagttactaaaactttgtactctctacctaatctctaaaatgtggataatataatgctactttcttgggcttattttaattttatttttggtgttagataaagtatataatgatttacagagaatctgagatatactaaccacttaataaatgtatttagtgttgtcat

SEQ ID NO: 26871 - DNA, 1083 bp, Homo sapiens
ttgctatgggattccagatgtgattttaacaattattgaaaaagggtgcaaggtagtaattataaatgataaagatgtatgatacattttcaaagagcctaaattctcgtgagaaaatatatacataaatactcttaatacattaaaataaaatatatttaatataaatgaaatatatttaagtataacttaagtgtattttttatcaagtacactatcttaaaataaatgagctgcattcctgatgtcaatttcctaaacaaatacatcagttgtaaatctgtttttatcacttagcataacatcatacacacacacacacacacacacacacacacacagagtcattcctcagtatctgaggtattggtaaatccatggatactcaagtccctggtataaaatggtagtatttgcatataacctatgcacatcttcccatatactttaaatcatctctaaattactagtaatacctaatacaatgtaattgctatttaaatagtttttttaactttattagatgtagaatagtgtcaagaaatagaagactgtacatattcagtacagacacattttttcccctgaatattttctatttactaatcattgagtctacagatgtggaacccatggatatagaagaccaactgtgtgtatgtagatgtgtgtctgtttgtgtgtgtgtataatcatgcagcagagtagcagaaaaatataaaatttaaaaaaccttattagatggcagctataaagagacttactgtccttagccctactacttgaacaactctttagcattttctgtatcttcaaagtagaactgatacaggtgcctggtaggtgtgactttgcggtacatttattttgtattttattttgaatatttaaaaatgcttacaatgttttgtctttcattgctttcagcctcccattggtagtatggaaaatgcacacacacacagacacacacacacatacacacacacacacacagaggagagagagaaaagaaaaatatatatgatagaaaaattgagtgtttttcccccaaaatatcagggtgggggattaatttttaag

SEQ ID NO: 26872 - DNA, 1699 bp, Homo sapiens
taaagatggtgaatatttcaagttctattcagtcatcctaaatagctaaaaagtaggtcatttacctataatccttttaaattaaaaatttcgcattgcttattttatttattttgtcaattttggggagtcttgtttctgactgtgaaatagaacaaagacaatcatatgtagatactttaaatttacatgtaccatatataacttcttttatatataatcccacataatattatatgtcaatataatatattgacatatatataatatatgtcaatattatatataatatatatgtcatatatataatatatatgtcaatatatataatatataatataatatatataatatatataaaatataatacataatataatatataatattatatgtcaatataatatattgacatataatattcacattgctgtacaggagagactttgaagaatccataattttatagacagtgctgttggtgatatatctatgaggccatacaatgcagaaggtctaaatattttagtttaggggttaaaattcaatttgggaactgataaggttttactttgatgagagaacataatttattttaattaaagtctgctcattaagcaaatatattaaacatcagctgtgaatgaagcattgtactaggcactgctgacagaaaggtgaccaaaataaatcttacctttaaagatatagtttactattgataatgatttatacttctgttaatcatatagacaatcagagaatttcataaaacttattattgttctaattattgcacattaaatttagttggagttttaagtagaacgcctaaaagaaacaattttattggtgtattttaggacatctgttttctattgataaggcataagatcttgatgaatttgaagttgtctgtgttaaagtaatggaaatattagttcatggatggtggtcatttattaagacgtaaacacagcagtgaaagtgaactgatgaggttatatgctatctcactttcacatattttaggaatttcatcagagagctaaatgtgtctacatgaaaggaattgtgcatttttagatttgttttaaaaccatgaaaataactatttttatttaaccaattctgcatagaatattcacaataaaactgtgctatatataaagtaagacctgtggaccatgaaaacaattaatgtcccttttttgaactttaaccttccttgtgtctgaaagtattaagcttaaagaagaaaaaataaaaagacttgtggaagatatccggcaccaataaagaaattaaggaaatatgatgtcttttgaggagtgtcctggagaaagtgttcataaatccatttgaagaaaaatgcatatgtattagatattataatcttctgtttcagtgaattacattttgtaatccctcattatatattgaaggacatagcatagctttcctttctagcatctaggtcactagtggtatttgagcaatataaatgaagcaaaagaaaaaagaatagatgttctgaacatattgttttggcagaattgttagctgagaaagactttatatatgatttttttaatgtgtgtaaattccctcagagataacaggtgaaaaatgatttcattatttaaaacaataacaagaaaaacaaaattaaataaaacttgatatttagaatgtttct

SEQ ID NO: 26873 - DNA, 1040 bp, Homo sapiens
catgttgttaagatataggaaagagaggagtgtaataacaaggtatgaatgcaaccttgtaaaatcccattgatttggaagacaaagttgcaacctccctccctcccttccccccttccccccttccttccttccttcctttttttctttcttttctgtcttttgacaggggcttgctctgtcacccaggctgagtgcagtgtcaagatcatggctcactgtagccttgacctctaaggctcaactgatactctcgcctcagcctcttgagtagctgggactgcaggagcgtgccaccatgcctggctgttttgtattttttgtagagagtgggtttcaccatgttgcccaggctggtctcaaactcctgggctcaagtgatcctcccgcctcagtctctcaaagtgctgagattacaggcatgaaccaccatggcctgcctagcaatatgtattttaaaaggccattctgatattttataactatattacaggacaatattctgacatctggaaaaataagacatttatatgttttttaacaatagaagaagtatggtaaagattatttaaaatatctaaaatatgggattaaatggttacataaatatacaataccaattgattaatatacagtcattaaaatggaataatatacatttattgttctttgaaaacaatcagattatacatcagaatgattttattttttgtttttatgtacagacacattcttatttgtttaaaatgtaggaggttattatgatgaaaactttgaagaaattcttaaactttatcttcctctgtggattgaggagtaaaaatcacaattagagatgtttaaagaacttcttttaagaaataattcaaaaaaactactcatgtcattaagtaaaaaatataatacatattagaataattggtttgggtctgctatggcttaagtaggtattgtgaaccagtcccatctaaatatctgccacattaaaataattgaaaccccttttttggagatctctgtaggccatgaaatttctgtaa

SEQ ID NO: 26874 - DNA, 1025 bp, Homo sapiens
attatgtttgtggccttttagttttactgagagccttactctatactctaaaccacagtaatagattgccaaggagaataaaaaaaattatataataacgcaatccatgtacaaaaataagattataattttatcatcatgtttaataaacataatggttaatttcttctctgaaatgagaacatttattattataaatacttcataagctaagcttatttcatttatttattttggtgtatgttcagtcatttcttggtacacttgcaaaaactgttataccacatattgtgcagatctgttttagtagtgtaaatatattaacaaatataaaaactttttcaaagcacttgtatttcaaatcaatatgagctttcaaaccagcttttgtagagaaggcatatctaatcaaaacatttatttagaggccagtcatgaagtaagctaatcttctatttatattgggttttatcttttcatatatattatcttacttgatcttcacaataactctgtaaggaagtcatggtattttacaaatgaagaaattctgactacattgctagttaagtctcgttcaagactgcagagctaataatggcctaatggtaaaactgtgactgggatccatgtctaatgctggatccatgtgttctgactagtgaaagcagaaatgaatacacagacattgggtaaataataaagtccatgattaatttttaaggctaatgcttaccgtatgaacactcttttatacctaacttaaaattggcattaagtgctgtatcgttatgaaccaaaacatagcattctctagcaatttacttcagattcagctagcatttattgagctactaatatgagaggtgctcttttaggttgtactatatacatgcaaatattaattaattttgagaagagtttgctaagagttttaacaaaaaattgttgccccagacccaagtagccagtttatctttcaagagttatatctttttattaaagttcagagacagagtgggtaa

SEQ ID NO: 26875 - DNA, 1031 bp, Homo sapiens
tttcatatgcttgttggccgcatgtatgtcttcttttgaaaagtgtctgttcatgtcctttgcccaatttttaatggatttgtttttcccttgtaaatttaagttccttacggatgctggatatttaacctttgtcagatgcatactttgcaaagacatggaatcaacctaaatgccaattaatgatagactggataaagaaaatgtggtacatatataccaaggaatattatgcagccataaaaaagaatgagatcatgtattttgtggggacatggatggagctggaggctattatacttagcaaactaatgtaggaacagaaagccaaataccacatgttttcacttataagtgggagctaaatgatgagaactcgtgagcacaaagaaggggaacaagagatactggggactacttgagagtggagagtgggaggagggagaggagtagaaaagataactattaggtactgggcttaacacctgggtgctgaaataatctgtactgcaaacctctgtgacacgagttgacttatgtaacaaaccttcacatgtacccctgaacctaaaataaaagttaaaaaaatccccctacaacaaatgcacactttccagctgtttgccctgctgattttcttttacttgtcatcctctaacatgccataactcacatgttctgtattttactttttaaaaacttattatctgttttcccttttactactaccagtgtcataaggacagaggtttttttcttggcactaggtgttgggcacatagtcattgctcaaaaatatttgttgaatcaaagaacagatggataaatgagtgaatcaataatgagggacactgtgggaacaacgggaagagtgattacttctgcctggggtccaggtgggattaacagaatttgatctaagttttgaaaaataagtagtttattgagtattgaagaaagaggaggaaaaaggatgacttgagaaagtaattctagtcttgacttggccattgacttgtggcaagatttac

SEQ ID NO: 26876 - DNA, 1066 bp, Homo sapiens
cccgcctcagtttctttatctgtaaaataggaataatgttagttatgtattgattagattgttatgacaataaatgaattaaagcctcagaagggtgtctgacagttattaagcactcaataaatattagttaccactattttatttttactttcaggtattcaattctatagtattgcttattaaagcatgaataaaacttgctcagaagttttgatccagtgaaggcaacatacatacatatatgtatttatatgtgttatatcatatagataatgtatatttatatataatatatgttatgtatataatcttttaatattgtgtgataagcttaacagtcatatttagaaggggaagagatacctaacatagggaatatgggcagtggggttcgggaaaggcttccaaatgaagataacacttaagctattttaagggaattcaccctgttgggaggtgagggagaaaggatttgtgcagagagaagagtatgtgcaaagagactgaagtaggtgttgaaagcatggcatgttcagagacctaagaatggaagggtgtggaatgtgtggagaggaagaggagagtcacctcatgaagacatttgtatcttgtactaaggggtttgggctttttcttgatggtaatggagaatcactgaaggactcataatgcaagtattggtatttttgaaccattaatctattgactcacaaatacattatcccaaatgacaaccagagtcagttcccagtcaacgatgagtctctgagaggtttttaacagtgagcaacaaaggcgaatgtttcattaatgtacccgtcctttactcttcattcagtctggcttttctgtaatcttaaatcatttagtccttataatgaaaactagataactataatatgtgtaatcatcttttatctgcaatttgtaacagcacataagtagtagtaattttgcctctaatatggctttcagccatgtgtgctgttctcattttataccaagaaattggccatttcatcatcccagactgagtggtcatactagttctagatctgtggtc

SEQ ID NO: 26877 - DNA, 1048 bp, Homo sapiens
tactcatggcggagggtgaagcaggaataggcacgtcatatggccagagcaggagcaaaagagaaggagtcgtggggaggtaccacatactttaggatcttgagagaactcactcattaccaaagggagggcattaagccattcatgagggaaacaccgtccttatccaaacacctgccatcaggccccacctccaacacaggaaattacctttcaacatgagatttggtggggacacagatccaaaccatatcacagagagaacaaaatagtttaccaaagttggtaaatactttaccaaaatggagggggagatttaagatttatgaagtgagattcttgtaagctttgatttctattctcacaccctcaagaagggaatgggtgtgggcatgattctttccatgagtatgtctttaagaaaattaaagagagggtttgcaggatatggtggactgatatgtgagaaagaagctaactaattgcctttattttggagaaaaactgtgttgaactcccagagttgatctaagaagaagaagaagtctttcccatagaccagatgtgggctacaggaaggaactggcatggtgttatcttgggtcctgtctaagaggatggtctggagggtctaagtgactttataatatagtatagcatagtatagtatagtatagcagatactataattagggactaagtaagactgctgcattcacccttgtcaggggaacttcaggaagaaatatctcaaccaaaggtgcaagggagagagagactgttgacttccccacagagatcacaaaactacctaggggagaagaatcactttaaacaagtgtttagttctgagagctccaacacgagatcctcaccaatcaagtaacttttctattcctctatgatccaaaatcagaggattttaaaaattggcattggcaagctgagggagaagaggtagacgcatattctagggagggagaaaagctgtcacatccccttcctggtagcagtgtttgttcatcagaatagatatcaccataaatat

SEQ ID NO: 26878 - DNA, 1042 bp, Homo sapiens
agaggaatgaaaggatgttgcaaacagtacactattgtacatttctatcaaaggcaggaagctgcagggcttgatgtgtatcttaattcctctactttttgcccttgctgccatgttttcaacagcttgttcatttggatatggcagataaataggtatgggtggactcatttggagggtaactttccgttgatttagtttgtacagaaagatgctttagtaactacctctcatgtctcttcaatcacactagcaatacaaatgcgagtcaatagaaagttttgttgatggtcccattcatggctagctttgtgggtatgtaattacacaggcccctgtgttaagaagagattcgtgctttgttgctgctgtcttgaaattcttagttcaagaaataaggggcttcatgtttttattttgcactcagttccacaaattttgtagcttgccctggacccatgaatgatatcataatttgaatggaaaaataaaactttctattcgttggatgttccaaataaaaagtcattccacatttggatatcaacacagaaaactagcactttgtaaattattttaaagaggagaattataaatagcattagaaactcagttaagaaaatattgtggtgatatttaactagacactcattttcatatttaactcagtattttctctttattttgtcataaaatattatagtatatcaatgtcttctaaataaatacatttattcttggttatacatatatgtccttttagtcttcaagtaatttggaaaagtctcttgtttagcatatttttcttccatccaaagaactttatgtgtcacgttctttatttactaatattttccaatgatttctaaatgctatttcctttaactgtattgaataaaagatctgcaaatacaggtatacagcatgccaaaataagtgacacacacaaacagagccctatttaaattatttttagttacactactatttttcattaatagtattttcttttctaagtatctaatctaatagtatctgcttt

SEQ ID NO: 26879 - DNA, 1050 bp, Homo sapiens
agacagcatcaaatgcacagacttcaattaaagaattttagaaatagatatgcatgcagtattacaattatttttattttgattatgctatatgggtagcaattaacatttaatcattttcatatatatgtttgtacactaacccagaagctttatacagcagacaacttatatgtagataaaaataaggcacatgtgtgtcatacttagttgctgcttttctacttatagtatgaactgaaatgatcaatatggcattttctccctgaagatgcatgttattttgccaatggttaccaactcttgacattactagttgaacctctatacatggtcttctttcagctcaaaggtgacacctcttttttctgtgattcagataatcactgtagcttttggcatcttctgctgtcactttttagaaagatagtggctgtgttacaaagcttttctttgtgctgtgtttggtgactgtaacgtgttttcagcccatatgactaattgttcctctatgtatgctgatcattctgaatttgcttataattgcatttttttttgcccccttcacttacctaaaccctatatacttaagtgtcatagatatggttatgttactagctttactcagagtatttatttacacagattactttacatttttcatcgtttatcctcttactcaagttattattttggtttcttctaaaaatatggaatatagaattcatatattaagaataaaaaattctttaaagctattgtactctgtggtatttcacataatattaaccagctgttagcaatgactgatatatacttcccattgaaaatgatgtaaggtctgaaaggattcattttgacaattttatatcacatatttatatttaccttaggtggttctttttaatgttttaatttgggaccacactaatttctaacttggtaactcatctcttaccaaaattaataccaagccaagaaaaatggtttcatgaatagaatctactagtcttttatatcttataatggtagatcactgatgaggtagaa

SEQ ID NO: 26880 - DNA, 2356 bp, Homo sapiens
ttacttttgcaccaacctaatattttagtgtgcatttggaaataaatgcacgtaaaaagtaactaaatcaattcaaaacttattctcagatttgcttggagccttctataaagagtgatatcacattcaaacttaaaagtagagaacaatgacaagtaatatatttacaaagttgttagagtctaaaatagattataaagaagttcagacattgtaaaatgtgaaaggagataaagtctcagatttgaatttttgatataagaagacatttctgaagataaatgattgaatacgtgaacattgattcagaagaaaagtttatgattataattaaaccaaaaagctgctaattctcatgattaggtgacttatcctgcatgttaataatttgatttttaaggcattaggtggataggtacaacaaaatgaggaatacaaaaacttttctatctccccaaatgtgggtaagaatgatggataccaactagcaagaaaatgttaggaaaaagaatgaagcaaggacagtgatttaaaagatgttgttcattgatagatcactttataaatagtgaagtgataaagatacatacagtgtaaccaagaagggaagagggagatggaggaatgatgaatttgttacctgtaattttcctaagatctgaaaaatgtgtccttctaaatcaatattatgtttatactataaccaatatgaccaaattgcaattatgttaaaatatggatgtgttttattttgaggagactttttgatattattgttttaaataaccactgcctccttatttttggagaaatatacaattactttgtaataatatactgattattgtataaatatataaggatacatatgtgtgtatatacatatatatgtatacatatacatatatgttcatatatatgtatacatatacatatatgttcatatatatgtatccttatatatttatccaacacatatatattatatattatatgtaaaatatatatctgttatttattatatatcacacatgttaaagttctaaataatttttttaatgtgagcaaatattgtcagactaaagtttattaaaatttgatttacttttacttcaaaagagttaatgaattagatccatgatactaaattaaattcttgactttagtattacaaatattttataatgacagttttaagaaagcttagaaaaatctgctagcatctataaaatgtcatatataaaagataaatctgattagttgtgttcatatttctgtgcagtactttttcttcacggatacatggataacattaggtatcacctacaccattatttttctttatgtataactaaaatgacatgggtcatagtctccagtagaagaccacaattaataatttgatcaattgtctttgtgcttatactttcatttctgaagataagtaaaaggctttttctttgtttatagacataaactaagtatttgtggatttgtatatttttgggttttccaactgttctctttcacaacattccccttctacaccaaaaacaaacaaacaaacaaaaaaagaaaacaaaaaaaaatttgttaatccagggtaatctagttttatctgattactataggtgagctatagctgttattagaggtcaattcattgctccagtaagacatcaacttgatttgtttagcaaagttttagtatatatactatgtactacttgtctgtaaaaatacgtgttagaaaatagcaaggctctcttttttatatagccttgaaaagttgttctcttataattgggagaaaaaataagtgggcttttatgtgcatagatggactttacctgtttcttttggatatatgtggatatatgtgcatggggaatagcttgaaggggagtcaacaggaatggcacagaatttcactcattctgtaggctccctagtggcagggaaagtcctaccattgtaaggtccagacacagtaccagacacagagtaggtaggcattcagtacatatttatttaatgactcatcagtctgaagtcttgaaagtaaaacaaagatagtctcttaggttctaatagctaagtaggtagttgattataggatgacttgatgtatcctatacatcaactttgtattagccccaaggagactcagacaccaaaatgaattctaagataaaatgctaaacaacatctaataagaaatagcttatattaagccattattgccaatgattatgattaattaataattgtagattgtattttagaatttattacttttaaaagcttatgattaaacataaaattccaaaaagttatttaggttttaataataaac

SEQ ID NO: 26881 - DNA, 1047 bp, Homo sapiens
tccagtcctggacaactatcatttcaccctttggttctatgaatttgactttttcagattcctcatataatctttcttcctggtttaggtttcaaaaacaaaagccaagaaggaagattatctctggaaaaaccaatgaggcaaggaaatataatggcctagctatttccttggaattaaagaaaaacataatatttacaaaacataagctgataagaaagatgaattaaagcattgttccaaccactctgtacatataatttaagaaaaaatgttggtataagaaaaagtattttctactgtttaaatattattatcatttcctgtatataaaattcatgcccaatttgtatgtcattcttgaatccatagcttaataaaaataacaacaaaccaaaataaggtttcataagtgatttgtcagttttatttatatatttgcaaaatggagataatttatgtgagattgagatcctttctactatgtacaccttcaatataaagacattattattctttctcagttctgtatttctgaaagtctgtcaaatactttaaaaaatgatcagatctatgcaagtgaagcttgcagaatttgcatttgccctcaatccctcttcttcctctagcttttcatgtgtcttgcctttgttcccatttcactaagcaagcattggcctgctgctaatgcactcacgtttccccacaagctctcacattccctggaatattaaacgaaaagagagcaaccaggacaggcagaccaatttctttcaggtatactgaataaattccagtaaggctcacaaatatttcctttattctctaactactcaaattattgctagtttctctccttacaagaaaataaaatttatttgtaggaaaaggaagtgaattatatgaccagtgatgctattttatttcataatagtgaatttttattgtgtttttcccatatggcataaaaactatctcatacagtgcgaaacacttacaagcactctcacaattatttccacttccaatgtgcaaatcacagggaac

SEQ ID NO: 26882 - DNA, 1095 bp, Homo sapiens
gttcttttaccttacatttggtctttgctaggttttgtgaatgtccttattgtagataatttaccttgccctgagattatacggtttgctttacaaccagtctttggcgtttacatggccctgggatctctagccttactctcttgcttgtactaaaatcctctggtttacctagtctccaacccactcttttctagcctctagtgcttccatttataacctctagtttgcctggcctccaacctattcttgtctctggtgtgctctacccacttccattctttgcctgctggaattaatgatgaagcatttaacttaagtctaacctgcaaaagtctctttggtttgagaaaggttcggccattctagttatgttcatgggattactgtttgaaggtttactggcaaatatagtttgagttttattttgtcaaccttaacttttgttacttgagctgaataaatatagaattcatttatatattttcttcccatgtgtcaaaaatggcaaataatattctataaaactgttgtatttaaaacttgaatgtagagaagctgagacttagaaaggagaaatgaaatctctgagagattgacacaagatcacatagctacttagtaaatatttatcttattctttttcctcttgaggaaatatcagtgcatttctcctggaaattgaatcacctaccagtgtaagctggctaagtcttttaattattgtagatattttcttatcatatttggtggatgtcagtcatgcctacttggagataatgtgcctttctaaattttttgtttttcatttgtagaatgatgtcatatttatttcttttaatatgtgatctatagcggatataaactttttggtttctaaatgaattgattcagttcagttttaagatcttaccgattgctttttctgaggttttttatttaccatgtcctgtttatatggctgacagtgttgactagaaacttattctagagattacatgtactcatttattcatcaatttctcgttttctctatgttatatacaatgattgacaaattttgatggcacattttcctgcttttatggttataat

SEQ ID NO: 26883 - DNA, 1101 bp, Homo sapiens
gcattattgttttcttcataataatacatgactaatattttgtaagtttcatacctacagaaataatgcatttcaacaatagagaacagtgttaaattaaaataccaaagctatagcagcagaatttcataccttagtaacctgaatgtgtagatttttttttcatggggagaaaggtatatcctagaatccattaattcataaccaatggatgtcttctagatagtaagtttggagacggtacatttgtcatagctgaatttgtgtattaaagatcaagtcttcataatttggttgagttaatggaaaacctgataaagttagagatacattttattgcaaacgtagaagtgaggcagaatatttaattttgtatgctgatgagctaggtattccagctgtatttcttgcaacataaccactagcagaataatctcgaagcagtcttttacgtgttctggcctcattttactcatctgtaaatttgagcctatctcagcaaggacttgtacacactatctaaggcaaatcttgagaagtagtgaaacactgttgaaagtgtgttcctttcaaagctagtgcttacttactttctaacagtgtgattattggagagttacttggtctgtctgaatattgaaagggcatccagtttttctaacacaatttattgtaaaacgcaccatgtctcactggtttggtatgctacttttatcatgtttaattcacataaatacataaatctgtttctggattccctgttttgcttctttattctatttgtctgtctttgagccagtatcataatgtttaacttttaaaagatgtaatggctcttgctatacattcattcttctggtttaatgacaatatccctcaaatttcatcccttctccaaaaccaccatcttaccaaattgtaattttgattgaaattatattaaatatacagattaacgggaagctaaggaaagtgtttatattatcattaacagtttgatatgcatttactcagttcttccattcattcaatacaatttatattttccaaagttaggattattaggaatttaacttgtaattgttttatgtatgtgtttat

SEQ ID NO: 26884 - DNA, 1050 bp, Homo sapiens
cattccttattgcaaaattgggtttctcagttttctttaacaaatgatacactttctcatgcatgcacctttctctacttgaatgccgtaatccacctttcctcaccatatgtcccttacagatttctatatatctttcagagcctaactaaaaagagaattcttaccatttttttcctgattccctaccccctaaaaaaaaatggaattttccccttggctgcctttgcatggtcctttcaaaagatattacagttttttgtcgtaatcattctctcctgctccactcatttgctttccaatgtttctgctttgtttttacatgctcagcaaatggcaaagtatatgacacatagtaggtatctaataatatttgttgacatgaattattttaaaaaacagtagggaatcaagacaggcagaacactagctgattatttcctattaaattagaacatacaatagaagaacattatttggtgaatactttgtgtatcataaataatattaaatctgaataataaaaaataataaataataaatatttaccttagcaaagaaaaatccttgtaaatattactagggtgcctacggatattgccagtatcctatttttaaaaatgatctttaagatcaagactttactctgattccaggatgttagtgcaaattaaaaagaatattgtgtttggatttcacatataggcctaattctagtcaatactctttaccaggaagttatctcaatcatcctttcaaatggttctagccaaagagaaaggaattcatggagaaatttgtctgagttgcttaaacaatgttgaataaattttaatgtgagtattaaagataacagatgtagaagtaattaagccaaattatgccaatagagtgataggtagtgatttaatggtattaattctagagatatcacaggacaatcagcaagaaagcaattaacatgaaatgaagcttattatcaccttcgtagaaagcttgggggttatccatttctgagaggatactctgtgtgataacagtgcaagtaat

SEQ ID NO: 26885 - DNA, 2049 bp, Homo sapiens
tgaagtgttgtttctccaatgttttcttctagtagtgtcattgttttgggtcttccatttaagtctttattccagataaagttggtttttgtatattgtatatggtagatgtattagtccattttcacactgctgataaagacatacctgacactgggcaatttgaaaaagaaagaagtttaattgcacttacagttccacgtggctagggaagcctcacaatcatggcagaaagcaaggaagagcaagtcacgtcttacatggatggcagcaggcaaagagagagagcttgtgcacaggaactactctttttaaaaccatcagatctcatgagacttattcacgatcatgagaacaacatggggaagacttgcccccatgactgagttatctcccaccaggtccctcccacaacatgtgggaattcaagatgagatttgggtggggacacagagccaaactatatcgttctgcccttgacccctccccaatctcacatcctcacattttggaaccaattatgcctccccaacagtcccccaaagtcttaactcatttcagcattaactcagagtccacagtccaatgtctcatctgagacaaggcaagtcccttccacctatgagcatgtgaaaccaaaagcaggttagcttacttcctaaatagagtgggggtacaaacattgggtatatacagtcattccaaatggagaaattggccaaaacaaaggggctacaggtcccatgcatgtctgaaatccagtggggcagacaaagctccaaaatgatcttttatgaccccttctcttacatccaagtcacagtgggatgcaagaggtgggttcccatggtcttgggcagctctgtccatgtggcttctcagggtacagcctccttcctggctgctttcacaggctggctttgagtgtctgctacttttccaggcacatggtgcaagccgtcactgggtctaccattctaaggtctggtggatggtggccctcttctcacagctccactaggtggtgccccagtagggactctgtggagggggggttcccaccccacatttctcttccatactgccctagcagatggtgtctatgagagcccttcccctgcagcaaacttctacctcgacatccaggagtttccatacatcttctgaaatctagcagctttcagccatgattgtagcagctgaaatgcatggcaccaactccctaggctgcaaacagcatggggaccctggttcctgcccaagaaaccactttttcctcttaggcctctgggcctgtgatagcaggggctgccatgaagacctctgacattccctggagacattttcctcattgtcttggtgattaacattcgactcctcattacttatggaaatttctgcagccagctggaatttctcctcagaaattgggactttcttttctatggcattgtccagttggaaattttctgaaattgtatgctcttctctatttacaaaactgagtgctttaacagcatctaagtcacttctcgaaggctttgctgcttagaaatgtcttccaccagataccctaaatcatctctctcaagttcaaagtttcacaaatctctagggcaggggcaaaatgatgccagcctctttgctaaaatataacaagagtcaccttggctccagttcccaagaagttcctcatctccatctgagaccacctcagcctggaccttattattcgtatcactatcagcatttttgtcaaagccattcaacaagtctctacgaagttccaaactttcccacatttttcctatcagccctccaaactgttccaacctctgcctgtaactcagttccaaattggcttccacattttggggtatcttttcagcaatgcctcactctactggtaccaatttgctgtattcatccattttcatgctgctaataaagacatacctgacactgggcaatttacaaaagaaagaggtttaattggacttacagttccacatgctgggggagcctcacaatcatggtggaaggcaagga

SEQ ID NO: 26886 - DNA, 1219 bp, Homo sapiens
gctttgaaatttggctccaattttcatatgctttagtgatcctaggtaatttgcttactaagttttttaaatagttattttaggctaaaataggtgtgtgtatattttgtaggaaaacactttgtaaattatacagagatatgaaaatatagattatcattgtcattctgattctgcttcctcatccattcagcaaagaggtgcgctgtgaccatgactgttcgctttccctttcatttattcatatttgccttcttcagcaaattttaagtaaaatcaaacttaggaagttgtcagggcttaactttagcaattttgattatgccattggtcttggtctcttcatgaaaatttatcattcttgagatggaaaagacctaggaggtcattttgttcaaccctccttttaaaatcgggaaacaagtctagagagaattatataaatgctggactgctaaccaaggtatcttatttcctagcctcctgggctaattcttcaatattgtaattctgtccgcttcactttacatttatttcaagtgtgtggcttggaaaatctcacataggtagatgttggcagaactaggcaagagcagagttttactatcgttgtattataatatttctgattgtctttgactgtcaatttgtactgtgttagtttctaaggggtgtgtgtgtgtgtgtgtgtgtgtgtgtgtgtgtgatgtttccctttctaaatagattgcaaaacctttatgatctttgattaaaacaaatagttttgagtgccgactatatgtaaatcattgttgctgttttcaaaagtcattattaattgaccaccatttgttttgtgggaaagaaacagtttaaactttgtaggtaacaaaacttatttggggtcaataggctcgaagtttcactctagaaaactgacatagttgcttaaaatatataatgtacttctagctatgtcaaattgaattactaattgacagacattggtactcttataattagaactcctttgaaactacgatccatgaaatgtgaaaatgagaataggaaattaaattctttattggttctcaggcagctaaactggcactcccatgttaaaatgtctaagtattaatttcataattgctatgaaaaaaatctgttcttacctgtttacaaatgtataaaacaaaaataatgaacaacaaacaaaacaaatgactgcaaaatgatt

SEQ ID NO: 26887 - DNA, 1064 bp, Homo sapiens
tgttattctcacagattaactctacaaagttggacaatagctgccaacatcttccagtctcatatcttcttaactttgccattcaaagaataaggttctcttcttcccttaattccaatttggaaaacctcagagaaggtctctgattggcccaggtctcattgtaaaactgtatgtgtggctgggaggagttggtcctatgataggcaatccttattttaatcacgtagttggagtaagcagaaaataggttcctcaaataaggcacgtatttttttttcacctcaaagctaatgatgataggccagttactgggtgaagaagcacagagaggctggcactattttccagatagatgtgttgtaagaacataatctttactttatttgaagcagtatgagggcttacagctaattatatcttggttgggtatgggtgacaacaaataatgaattagcagtctttgcctttattcaccagaaatttataatctacttgtaggtgtataacagacaaaccggacatttaaaaaaaatatattgtgaacttatgtgatattgaagactgtatgtacaatagaattttcagagaatttcaggattactatgtgctatagtcttctgaaggttttgaaaagttcagtttgacttaacttagaataatacagtattaataattagagctaaagagctaaagataactgatgttccatccgaaaagaggagcatagggaatattttagaaacaggaataggtgcaggatgtgccaaaaaccatgagactggtccattgtagtgttggaaattgttgtggaaaaaaagattaagtatgcatgatcacactagaattttggaaggcattgaaaaatctgaatgtgtgcatattgttaaaaaaatatactgtttggtctcaaatttgaggtagtactctccaaaaaattaaaaaacagtaatatcagtaatatcatgaatagctgtaagagatttacctgtgcagttattgaggaaataagagaattcaaaaagctttttatggtgctaagcatactgttggaacgcaagaca

SEQ ID NO: 26888 - DNA, 1007 bp, Homo sapiens
taggacttttttttgtttgtcaacataacagaaaaaagtagaattatcataaatgcaggaatgtacattggagattttctttgtgaggccatgacctaccattaggcagcaatcatcatgaagtcctctgttaaaatgacattcactttcatcagaacctctctgtgtgctacctctttcaattctagtctcttgccagttttagagctaatggtttccaccaaacatatatctcagataaattttaaatgcattttctatcatcagcacacagctttgttgtaatgttacatgtagggcaaccagacaggcagaattacggtgattgtgagtggatattttggttctagttcagatgctgttacttcctaatattgtgagctgcacacaaattttaatcattaaagtagggatgttaatagaaccttcatactaagagagagagaggaatttaatgagttaatgactttcaagcgtagtgctcggcgcacagtaagtactcaatattgggtgctcttgtgtttataaaaagttgcttttcttaaattgcaaattaagaagtcctcttgggggtacaaggtactatgtttcagagcatggtttaattggtatccttcatggtttacaagtataggatgccctggtcatagcctgggtggctatgagaaagagaaagagaaagagagagaaagaggtagctctaagagatctataaggaattgggggctttaaagaggcaatcaggggagataaagggagtctgtcaacatggcaggaagatggggcttaagtagagaagataatgaatagaagttcctttatgataagaatgactgagaaattttaagaatagggatgcctggcattgaagttattggctgtaatgtaacaatcattctggttccagattttaatagagtcagccatacaaacatccctaaatatatgacactttgtggaatgaagggcttggcatagtgcccagtggggcaataatgatacaacaa

SEQ ID NO: 26889 - DNA, 1030 bp, Homo sapiens
ctgcagactttaacacattcaatcagcggcatggtgggagtttttgttggtttgtttttgatttgggtttttaaatttagctcagccagcattcgatcatttgcaagtgaagcacatcttatttaccaacatgcttatgaattgaaagtctgtagtgtggtcagtgtcaacacagtttgaaatttactctaaatgttcaaagaaatgtacctaaactgaagagtaaatctccagactgtttatagagaagtgggatgtgtgccattgccttattaacttaggtttacattttgggtgcacaagactcaattgctgctaccattaccaggcctgctgtatagagaagacttaaaagcaataactctctaaatagctaagtgtaatttgctggtgctgaactcttttaaacatgcaatatgtcaatctggaaatatatggatgaaaatgtaattttttcagctttctttaaatactttacagctctgcaacggtttgcaggtattgtttgtgggtacttcatctttgagaaacattgctatgaatacttttttgtggaatgctgctgaagacattttccaaactagatgagaagaaaattagtatttgttgtgcttcttctgggtgtcaggcattatctcctttaatcttactgcagctttgcaaatatattgttgttttagcgttgaaaagattggagctcaaggggtacatttcccattggtcacatacttggtattagagaaattggaatttgattcaagggtcagtgacttcttttagagcttctcatttgttttatttggcagagaaagaaagaaatgttctactagaatctctttatgctaggattaaaaagtacccctctttgtgctttctgtttagaatttatcctttggtataaaatttgcatagagtgattttttaaataaaataatgagcaaattgtacctttggaagatgtttaacatactaatgcattaaaagctgctttcaaaaagcattcatatatatgggtatacaaagtcatgta

SEQ ID NO: 26890 - DNA, 1030 bp, Homo sapiens
atgtaattttctgggtagaatacaaggggaaaagaactagacagtgagggcatgaaaatatcaaagtgaaattaataaaaggaatgaaaagcagagggaaagagaaacagtggcaatgctgtcaaacagttatttgatctgtttgttgtgtatttgacagttcgctatgtgcaaggcattgtgctagaagctggagatgaaacaatggataagatgtagacttcagttatgacaaactatagtatatagattaatagaaatatgcgtgtgaaatagagatagaacaaagaaaatgattagtcatcccacacccaggagacaagaaagagaaacctttacaaaggtgctcttgcaagatatttatgaattagacagaaggtctaattagcccagatcattctaggtagtggtaagagatggggctagaaacagtataatgggtttgggaaactgcaagtagttcaatattcttagaacataatattgttagaaacacactgaaagaaaaatgaaggaagtagtaaaagacaactcgagattttagaccaggaggtttctgtgaccataaaaaggagcatggccctttaagcaatggggagacttggttttaagtcacagaggaagttgtatattattagacagtttcttaaagttcatatttacacttgagaatgtgaattaaatacagcatgtgagaactctgctgaactgttcttctatagaataatatatatatatatgtatatattttttccctcaattcccaaaaagagaagtcctagctccactgatatttaaggttcagataattgtttctatttaaatataccatacgttagagttaatttttattggctatcaggagctagcaagataaatatttatatttcttacattggtgaatctgatgacccaaagaaatacaaacatcctctacttaatacttcatttctgatttaatggacttgaggaagaatatcccatggaatgttgattttaattttatggctcagagtttgggggagtgagc

SEQ ID NO: 26891 - DNA, 1082 bp, Homo sapiens
tgtatccagtatacatataatagttatactggccactattctttgtgatgcaaagaataaaaatttaataagaatttaaattagaggtaagaattcttaataagaattttaatccgtaataagaataagaattttccttgtgtttctcttagtggtatattctaataatactcatttctttgtttttattaatgtgctactaatttctactgtaaaaagtccaaagttaaatgggcttattcagactgaagagagtaatcgattaacaaaaattctgagattactacttaaaatcacattttgtaatgaagacattacataaagaagctaaaaggcaaagttacataaaagttttaatttaatgagtgttagcacataaattgctactgtcaagacagaaggaattgtgttgatttgattttagtgaattctaatgttaatgcttgactaaattcaaagaacataaattaaaaattgctgaagttaaatttgctttatgaaatttgaactatgtgtctgcgaagtaatctgtatcctaaatatgactgatactgagccaagttttttagtatgtggaataattgttatatttgcagagtaatgaagcttaaacataaacaatattagcaatatttaccatatcataataaatatgtttgtaagtcctggaaatgtttgtatttttatttaaaaatacttgatgatgttaatattatctctacataacacttctatacttgtctatttctttgcattaaatattaataaaatttgaatatatataagatgatttttaattagtggaagttactatggaaaataaagtacatttatttatatgtgtgttgtgtatacatagcgacacatttataaaagcagctttcaataaataactaaagtcattttaagcataaaatttagcctttttgctattgagtatttagataataactttggttctttattatttataagtataggtacacctagatttcaagaaatgtgaaccaaataatcagaatgtatttaacaccatacgttcactgaaggatttaacataagaaataaacattgacagaagt

SEQ ID NO: 26892 - DNA, 1028 bp, Homo sapiens
caggtcaatcaacaatcgatatactttgtctgttccatatttagactgattctttattctggttttctgcttgaaaatttttcatcctaaaatgttttaaacatcctaaaatgtttaaagtgaaatgttttaaacaaattataaagatttctctaagacaacctctgaaagtttggtaactgcaatttgatcattactacaattggataactattattcaaccaaaatacaaaggtttatctaagagaatctttgaaaatttgataaaaattctacctgatgccgtatcaagtaataccaaatatagggaaatagcactttatataattacaaaaatcacaaatctctggttgttatttttgtgagggagaatcagcaaagtaagtaatcatagagagctgtataaattattaagcaccataaatagtaactacatattacaccgttatctttgtagtctatacgcttaataggtaaaaatagaatcctaactttccaattctgtacctgtatgacattcgtctatgtaatttaagggatctgattttgtaggaaagataatgtattctggagctgatctttcctgaaggctataattatgtgccagggctaattttaggcatcaatggggctctcacaaatgctgtcaggtgagacatagcacgtgcctcgccaggtacatttctattggggccaagtatttattaactgaaaaagtttcagctacatatactttttttgtcaatacaaacttgggaccagatggtttaagacacatacagtgttcctttaattagttgctagtagggttgaaaatgcccttttaataggcaaataaaatagtaggttcataatttaaagcaatttatttttttcctttgaggaagaatgggtgctaaaacttaccaagtttaaactactctgacacaactaagtgattcccactcctggaattgtttgcaaactctgaatcacagggcacagaggaaaagcacatgggtgagagacaggggattttattacataag

SEQ ID NO: 26893 - DNA, 1064 bp, Homo sapiens
ggacagatggtaattcatattacagtatgagagtagggcatttccctagaccaaattattgtctacccagttttcaattagagaaaactgccaattatctggagtgggttttgttttaattaccgggtgattaggacagctaggtaactagcccgaaggaaggagagctcaactgtgtatgtgaatccttattatgcaaacctatgaaataaatacagaaaggccatgtgaataaactgcttcagtgaaatggtagataatttacctgaggcagtctatatccttttactcatttgatcaataaaaagtaagtttgaaatgctaaagtcaccatttatttgtgaactacactttatcgtttctatgagaaaaaaataaattccggggaaagggattatatgttagcaatcagtgttcaacatgttttgtatttaacatgtgtgttaatgtatggtgtcatctcatgagaaatcacttatcaggtgacatttgtcatatgaaatatggctgagacttgaggcacagagacaggatgaataaatccctattcttttctgtgtcttcagttttttacttgagctccttttctacatctgcagttatcctctgaatatttccaattaagtgtgtcccatcacttttaacttcaacagttctaaacgaatccaatttcctcaccagaccagcttctttaccaaatttctatgttctcctctctgccaagggaaccaccacttcaacattccttcaaacatggatggttatagttattgattttatgctatcatcctcctctttctgtcagtcatcttttggcaaatttcgtataccagtacctttatctccatttgggctatcattcctatccagattcccacaggctcacagctaagctactgcaacagctgttgctgactaaatattctcatgtctctaaataattatttaaatagggaacagtggatttatacctgattcctctacattaaaaaatatttctttcattattacatcaagagtaaaatatataaaacattctgcctcaatttcaaggtcttcattaa

SEQ ID NO: 26894 - DNA, 1023 bp, Homo sapiens
tcagtagtgaaaatgggatagaattctgatcaatgaaaggggaaatctggcaggcttccagagaaactctctaatgaaaagagaaacacaggggaagcactacccattttagctaaagatcattatgtctgcatatgacacctggaactggcagcccatcctttggtactggatggtgacacgaatgccatccccaaaaaggcaaaatggattcttcatgacattgtcgagcttctgaatttttacatgcaagacattaaatctctaatttttaagccacgtttatggccaaattattttacttaatacaagccctaaatgttcaattacaataccttggcttacttgttcagttacctaagtagcagattcattcaaatatattcctcttcctttaagttgactcccccttcttggtcattagaaagaaataaatacgtttgaaaaaaaataagtatctattcgtttcacagaatcttggtctgaaagagacgtgaaaataaagagtgaagactggtaggttacctaagattataaggaacacagttataaattaccaagctgttgtacaataatataatttcattgtgctttaaaattgtcctaaattttgtaatagtttcaagagaaataataaactaagcgactctttctttggatgtgcccatttttaagtgttgattatccactgaacactgcacttgaattttaggtgaagctatttgattctcataaaaactgtgtggttaggatggaaggtgttttgtgcccacaaaatgtttcctttggaagcctaatagggaatgctcatcagctttcaatgaaaagatactctgtttgccgaaggtctaaaatgaggtaagacaagacaaaaaagttacagtggcatctttaattcttctatacatctatattatgtcaatcttttcagtgtatttgcaggtaaaataatttagagaaagaatattaactttttccttccttgtctaaaatatccgtttttttgagtacatgccatgtata

SEQ ID NO: 26895 - DNA, 1687 bp, Homo sapiens
attttttgagacggagtctcgccgtgtcgcccaggctggagtgcagtggcgggatcttggcgcactgcaagctccgcctcctgggttcatgccattctcctgcctcagcctcccggagtagctgggactacaggcgctggccactacgcccggctaattttttgtatttttagtagagacgggcttcaccgtgttagccaagatggtctcgatctcctgacctcttgatccacccgcctcggcctcccaaagtgctgggattataggcgtgagccaccacgccaggccttgaaaacttaattaacttctttgtgttttactctcatatttaaaatggggaagatacttttacttctcagggctgttctgatggctaaattgaaaaatatgtataaggtatttagcatgacatttcactcgctgtaaatacttgtgaaatgttactgtatttttctataaaggcggtaactttttaatgctattttttatcatctcagtattttaggagatttgtctttagtattccattttagagtgctgaatatataaaacaaatcaatttatttcatttcattcagcacatacttattgcgtggctacttccataccagtaaaggcatcaggagtttattaaacaatctagtgaggaagacagatgcaaaaatagatactttccaaattttatggtaaatggtaagcaaaagttactctggaataacttagtataactaaagtctggaaaactcttctgggaaagacagtttctgaaatgagttatgaagatgataagaattagatgaagagtggaaaagtggtgcggaggatgtttctgataggggaaactgcaacaatagttttgaaagaaataatctcaagatgtaatttggacaatttatttagagtgattaaagcataaagatgtcaggcacaaaggaagagagtgaaatgtagaaacaggccacgggaactttcatgttctgctaggggcttttctttttcctctttcatttttttcttaaaataattgatggtattttatatgctgatttgatttatggaattatctgataaggaaaatttatgtgtgttataatcaaggtgcatgataccctatcaaactagtatttgacaaccctaatagtcggtgatatatgcagaatgaaataggaaaatatcaagtaaaatactttttaaaactgagaattttgcagagattgaataatcactttaggccatacttctcagaaaggtattgggctttgttgtgagaaggcaagaaatgaggagggcctagaaatggaaacaaacaaacaaacaaaaaccatgcaaacagttttaaatactatttattgggttctgccatgtatcaggttctgtgctaggtatttttgcataaattacacattcctgacaacacagacctgtttaaaatacctgtatcatatttgtttttttttgtgtatatatatatatttgtgtgtatatatatatatactcaatatgtatatttttctcccaatataaagagaggttaagtacttatataaagagttctaaaggtatgaagtcaggatttaagtcaactttcccctgactccaaaggtgtagtgtagaaactattagagggtatttcaatgattacttcctttacctcttccttgctggcagaataaactttaattcaatt

SEQ ID NO: 26896 - DNA, 1046 bp, Homo sapiens
gaaacaattcagggatgactgagatctatactacattcttatttctgagaaggctagtaagcctctctggatttatttgtgctttgagaaaaagagtgtagaaacgcagtttaggttttgtaagtttttcatttttcccagtcagaagtcttgattagaacaccagtgcctgtgattctgggtacacacaggatggcattagtaatagtcccatataacattttttcaggggagatgatataacagctgtcctttttgcctgtgatccctatttggagtagtctcaggactgtgaaaaaaatcttctctaggattattgcctgacatgcaactattcaggtccccagacctgacatttactccctgccctactttctccctggaatcactgtttgtccagaaggagttagatattggatggagatactgtgttagcagatattatctcaacacagtacttattcctcccctcccgttcctgtattttaactctaaacaagtgcatttaacaacttgggctgtctgttttctaaactctttggaaattattaagtataagtagattgtcaagattgatcttcgcaaaaaaagatcacatttttttctaataggggcttgtggtaccataaatggttaatttttacacaaatatttgattcttagtggtttcatgcatcatggcaattctgttagtaccttttgctatgctatatagtttttacaagtatgcaaatgttgaaggatatttaataaccctgacgttattaaatgttcagttatctcccaaggtttttaaatgggtcttgggaaattttgagattaaatcatataatttgtaactgagacataatattcattcttgaatataatttgcagtgacggctttatgaaggaagaactaattactctcatgattgagatcagagacaattattagaattatgttttctaaggttatttttctatgtacaaactatgtcccttgaaaactgcaagctgacgtgtgcttattgtgcttatctagaaaatcagttccttatcaatta

SEQ ID NO: 26897 - DNA, 1031 bp, Homo sapiens
catccttattgttttttaaagtgccttcaagagaaaatggtttttaatcaaattcatgagataactttttatgttacattttataggcatttaaacttcaatataggacacaactaaaacaatgtatgactgaatgtatttttggaaaaatttctgcatgctagagcagaatcatccacatctatacacaaacactgacagaatttgtcacatagaagataatctgtaaattgttgtgattattaagtgctttccctatattacagtttttcacatttattaaggaatcaggtaaaggctatgcatgacatcataaacttcacagagctatgccagtggtgtccacttgctaattaacattgatgtgccacaaaaccgtacatgcttaaaaaagatattagtaatggcaagggcgatttctgctcttctacagttgagtgcttgcttttttgcaacaacctcaaactccctacagtccgtgggttagaatttctaaaaagttatttctcctatcaaccaatgtggaaactttttcaaggatgctgtgaattcttcatttttgcaaaagataagaacaaatttaacaatgaaagctatttttttagactgagagataggtagaaattttgtatacaagctccaccacatgtcattatcttattcagctgacaggtggtgctccagaacaatatgggcagtggggatgtgtgattagatttccatcagtttctgggacaaaccatgagctatacctttaagataaaaaccttttaatgtagtagttgaattaccgaaatttttatgtgcaagaatagtaacccaataaaataatttttacatgcaaataaccttatacattttaaatgtgttttagatgcaggcattgaactagactgggatgaagttttcatgtagtttcaactcaactttttactttactgcaaagcaataaattggagtattaaactataattaaaatcaatacaactgattttcctccatccgttgtattatttagcattattatgaca

SEQ ID NO: 26898 - DNA, 1038 bp, Homo sapiens
atattagacttagattttaatttactatttttaaggaggcaatgaataaaggtaatgcactcaacaagaagtaagtctatccaatgcttctgtctggctgtggtcctcttcatctttttcttactgtccagatgccctcccctgtcttacctctgcgtagattattctaagctcttacccctatacagagctctaaaccttcctgtttctactgcctgctcgatatctccacttggatatgtcacagcatctccgactcaagctattcaacgttttacttatcgcttttcataatttaatgtgcttttcctatcttaattgttataaacttctgtacatcacacattaactcttcattggtaaaaagccaagaaatcataatatctagtacttattaaaggccaactgtatcaggaagtgtgctaggcacttcttatacaatatctcacctgaccttaacaatatggacactaccatccttattttacaaacaaggaaacagaagctcggagaaattaaataacttgcaaatggccacacttgtgcaggtggctgatcagcaatgcctaggctcctattaaattcacatagtctaaatatcaacattttatatatggcgataaatgaaaactcctaagaagtatgctggcaacatagatgaatttcttaagtattttaggtcattgacagtgattttgcttgatactcataataattctaaataaccaggaatatttgtgaatatatcaaatatggaaatgggatcaagtatattaacaataggtgccactcttctaacttaacattgtggtttcattatatttataataactcaaatagagtaaccattgcagtaactttttggaattgatcatgcgaagtaaaactttgcaaggagtaaaatagaggaatctgagaatttaaatagtgcaggtttgagtccaccatgtgagtataggtgaattacttaatctttttaagcttcaatcatcccatctaaaaagggaattgaatattaatgttaacctcatagttgtg

SEQ ID NO: 26899 - DNA, 1028 bp, Homo sapiens
cttttaatgtcatttaaaaaattttaactagaatagataccattgctagccatgaatgaaacaatgcatttcagttaaaataatagagagtgtagatctttggtaatatttttaactaatatgttaacaaatttaagaaacaataaaaagattagtatttcaagtcacagttttaaaaaaatatcaactaaacagttaataatatttcccagttgttaacttcaaatttagcagcccattgtccctggtgatatattgaaacctttaaaaacgtattcggaattaatggaaattgaagtgattggtattcagatataattctttagtggcccttttctttcttctaaatacaggataaaaattgaaagtataaaaagcttcaagatatattgaaatagacaaaacattttatgcaactgttggtaaaaggggcattcattatttttttctgtgcttactgtattgcttgtggccagaattagcacaccatgagccagagaaaaagataagacaaatagaatggcatgtagctaattttgtttggcaaatttagatccgatacatgctatttcactcctacaaactgactcagtcactctttgagaagtacagatgaagtttgtctcccacagtttaacagctttcactcaatatttataggctatataaaaataaatttctataagtaacatatttcttactggcaggatgagctctgtgaaggcagatttattaatgaaaaaaaaggagaaccaaaaatatttcaattgttccagatctgcagaaaataaaatacctgtatgtcaaaatatcagtaatagctttgtttcaaggacatttgtagtggacttttggtattcaagagttttactacttgtgagtcagtcagaaatcccattattttatgataattttgtgatttgaatctggtagaatttcatattctaaaagtagtcattcacctgccagatgagccaacagaatagaatccactgtaataatcaggaagttgcttaaaacaaaacaaa

SEQ ID NO: 26900 - DNA, 1507 bp, Homo sapiens
gacccattcaaaggcattggcgaccgacatgcaggcttagccgagaggaatttctacgaggcgacctactgggggctgtctggttcagcctctgccactgggggaccccgctccgagtccgcagcaatttggtattaactgtgcggctccgagttgagctatgccgaaaagcccttttcagaatttctgcaaggaatgtaatccaaattagttctgcagctgtcctcttcctcgtctcaggcgacactagctcgcgccctcgcttcgtctcttctcgtttccctgggcgaattgtcagacccacaagtgagcccatttagagcgcgaggattagcgtgccattgttgttccgtgtgtgactctgtacttgaaattctgggggcacaaaggcgagcctcacttgttcaaaacacaaagtgatccagatgaaagggccgcacaaagaaaagctctcgggtgcatccctggtataattgcaacacgcatactaaggtgatccattggaaactgtaaatgccccgggggacttcgtttttcatcctcccccacccccaccctgccgcacctggcagggaaagttcagctggttttaatgcagtgctattataaaaacaagttactgtctggggtatgagtgaggctgtgtgtgtttgtgcctatgtatgtgtgtggctgtgtgttcccaactaaatacatattgcgcgtctcccctctcgcggttagcagtcagtagcagtttggaggagtttgttttggtccaaatgagaaattaagtgcggataagtaaactaagctgccagagggcgacaagatgttgagtgaattgcttttagatgaaacaaattaaggaaacgagggaagacaatctgcttctcgcattattagacacgcttggagttcaggggaaagtggcatatttttgaaatgctaatttcttaagcagaaggaatgcaccttatttactgctctatgtgaacagaataaaaatatagggcgggggatgctgttgtatagatctttaagatatttcttaattgtaacagaagagaacctcttttttcttttgcttggaaaaaaattcagcattagagaggatgttttttagaaattctaaaggactttgtctcattttcaattatgcattttatttagatatatctagatatagccaaagtccctttatatggcaattataaagcctttgctaaccaaaggaatggttctaaaattcgtcttccttgtataatggaaaattatcaatattgccttggtattgaagaaaatgtatagtagcattgaggtggtactcttatataccttagtagataaacgatgaacaagttcagttcccatttcttttttgcaggtaactcagtcttgcttttcattctataaaagtacatatagctttcgtacatatttaagatacatcattatatctccaaaatcatggggttatttttcatttgagaagaaaaatgttaataaaagttaagtggtgaaaaag

SEQ ID NO: 26901 - DNA, 1031 bp, Homo sapiens
aagggatgaatagggaacagcattggagagtatatgtcaaatgaattagggcagtagtttagtgagccaatgtgccaatttagaaatggattcttcttcctgctgaagagctctttttaaaataaattacaatcataaagctgccacagtttactgtgcatagacatgttcagaattggctcttcttcatgagggctgcttggtgcaggtatttaagctactgccaataaggctaacagctcatcaaatagaaaatacgctgcaggaaaatacatgggttaagaaaaacagttaaataccgtgctgttattttgtatgtctgtttaagcttttctctcaaacaagttgacttacttaaattgttttttaaaaataaactctaaaagccttgaaaatagtgcagtcttaaaagtagtattgattttagtcaatgctaaaaacactttcaggggaataagatgagaaaccacatgaacaagtttgccaccaatagtggcaacagtgtatgtatgtcatggatttaagagagactcaaataaaaacaaatcctctggtgtatatgtgtgtgtgcaaatttaaagagtatactttcacactagagggtattctttctacttgcttctactgaagcatactagcttttataacacatatcgagatggcatatccagctttgtatcatccaaaatgttgaagaaattatcagattgcatttttctatggttttgtatagtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggtaagcattacaaatgcttttgtttctttgcaaggtgatgttaataggaaaaggcaagttcccatgtattagaaatatatatggtgtgtttcagttcatgaaataaatacccatctcttttcttcattattcttttttactctctgacattctg

SEQ ID NO: 26902 - DNA, 1050 bp, Homo sapiens
ccctcagaaataatgctgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatgtatatcatttttttgatttttttattttaattttttggggtacatagtaggtatatatatttatggggtacatatatatatttatggggtacatgttttgatacaggcatgcaatgtgtaatataatcacatcacttaaaatgggatatctatcccctcaagtatttatcctttgtgtatatctttattgaggagcatgaatgggaagagactgacatcagtgaagacaattggtttctacagcctatattttcagatgtatatttctcattaatacaattcagtcactgcaaaacacatgctaccatacttgaaccacaagtgtgatagaagcaggttggaaattagtggctttgatatatttcatgtgataataattgcaattacgggttacactgaccgtataaataacatggtgattttcttgtgattaaaggagaattgagatgcaggagaagtttaaatatctttgaaatctaggggaggaatcatatctttatgcaatggcatctttcactcctgggtgattaaacaccacatattagcatttgatccttgactgactgggtattttgttacctatgaaatacaggactttgtaaaggcagtatgtgatctgttaaactccctctagaagtaaagaaagaatttactgagaccttcatcaagattgctacatctcttgcagattgattctgggtaccagaacattctataatttaaaccaatctaaactaaattgtaggtttgaaaatatgacttctttttttagccttgattatcttttgagcttaagaaatttattacactgatctctctatgcatagtattatcacagaatttagaaaaggaaatcactgtcgattttttttcctcagtaat

SEQ ID NO: 26903 - DNA, 1030 bp, Homo sapiens
ggtgcacataaaagaaagatgagagaacctactatacagtgacctttatcttaatacaatattaccagaaccctggagaatttagagttttcaaaaagaatagagagaaattcattttcaaagcttgcatcagtaaatgaaataaaaaccccacaaaaatcccacaacctttataaatgacatcagttttcctatcaggtgacacatgtggatcaatttacatttgaatttggtgatcagaaaatattgaagtgtgacctatgatttgcaactgcatagggtgagacagtacagctaaaacactgggtagtcattgcgatgctgggatggagacagaatccaagacaacccttggtgaggaaggggttgagagaggaagaaagtaaaggcaggacgaaaataggcagtcttatcataagagaacaatgtgtgccattttaactgcccaaagagcattttttgtctcaactttcagtgcttctttaattaaaatgaagagatcaacacataaacagaaactaaatcattctaaagaaattctaacttctttatcctataggtttgattacaatttgacctggtatgctattcatcaaaaaaggtattaaatgactgttacatagctcacacggtgttgggaatagaggggaaaagaaaaaagaaaacagtgtcgctagcctcgaagggttcaatgactaatggaagagacgagtggtttcatatgatattatttcatattatattttacatgatttaatattattgcagtgtgatgtattacattattgctgtggggtagatcactagaagtggtgaggagcttagattctgcagtcaagctgcctggcttggagtcctactttttcctctttccagctgtatggtcttggacaagttacttacactctgctgcttcagttttcttatccgtaaaacagtgctaataaaagtataattctcacagtgttattgtaaaataaaatgtgttataatatacataaagctcttcacagtatcagacaacagttac

SEQ ID NO: 26904 - DNA, 1044 bp, Homo sapiens
agccttctgaaatgcagcaaagacttggactgtatttactgccagtatgggggaaaaaggaagccactaatataatcccttccccacagctagcattgtttattctttctggttcccttcttgttgaaggaagggctggtttgtgcaactctagtggattgattcagggaataaaaattctgaagagaatcctaaattttcaaatgcaaaatgtttacttcaaaataactatagtctttaagaaaaatttgttgaactattagattcccaacactgatgaggaagaccattctaatttaaacactggcattatgctaagcaattttcctatatctacttacttagtttttgtaataattctatgaagcaagacttgtttttatctttatctcacagatgaggaaatgggctgagaaaggtttaataactttcccagggcctatggtagtaagaggcaaaggcaggatttgaatccagtagcctaactgctataatggactgccacttggtaacaagaatcaccattctgtgtactgatgctcctgctaagaaagagaagtccattaacttgggtgtttggtgcatgatgagattattatggaaacttagagctttttaactttctacaaatgtgagttagaaaaccgtagttgccaaagttaggttgccacaagtgttacattcttggagacctcgacatcttcaagctttggaacctggtaactagatgtgcaggcatctgggagaagtgttaacagataataatccagtaaagaccaataaagcattggaaactgagaaatattctgaggaagatctaagaccacaagacttagtgataagactatatttgattttttgaatagggtttgaataatgaaaaacataaatgagaaaaataaaaacatcacattaatcattggtggcttctcaccctgccctgaacttggctttatttatgtactgtacgccatccctttctgactcagaatctcttatcatatgcatgtgatttcctcttctgttttcattaaattgttttta

SEQ ID NO: 26905 - DNA, 1042 bp, Homo sapiens
ttatacccctctttcttgatttaatgactttaagtaacatttatatactaaccactagaaaaaacggggaatttagtgtatatatgctactttccactcctttctgaattttctttgtagtattctttctagttttgtttccttagaaccacaaattaaatacctaaacttctggattttgaaccattaatcttaagcagggtctagttatataaaattaagaaattagtatacctacacactcccaagtctctttcactccttctgcccagtcattccattgacttttttttcttttgagaaaaaaatatattaaaaaacctataaatatttttatatattatatatatagtgtgtatatatactttatatatataaaaaacatatatatatatataaaacatatatataaaattttttttttttgctctgttgcccaggctggagtgtagtggtgctgtcatggctcactgcagcctcaacctcccaggctcaagtgatcctcccacctcagcctcacaagtagctgggactacacatgtgcaccatcatgactggctaatttttgaattttttgatggagatggggtttcaccatgttgcccagcctggtctcaaactcctggcctcaagcaatctgccagccttggcctcctgaagtgttgggattacaagtgtgagccactgcacccagtttagtacactgattttacagaggtgatttatataaggaaatgtttgtgtgtgtgtcattcacatgtacatagaatataagtgtttatttttctgtatactgatagagaaaatatatgtatttgagagcaaaagagtgtagtgagaaagagactcattccaggcttttaagatttgtccataggttgattataaaacaataaacagtacataatacgctatgattatgtaggttttcttcattacagaactgagattttatgattaagtccaaagagaaggaaacataatgctatgtcattaaacctgtgccatttgaaggagaaattatcggtattacgatcaaatg

SEQ ID NO: 26906 - DNA, 1060 bp, Homo sapiens
agtgaatttttaaaaacttttgttcctttatgttaacaacactagacagtgaaggggatacctgagttattgttccaactttcccgataccctctgctattaaactcctgttctatgggaaagtgtatgaaattctgaagaacgcataggtgaataatatatggttcctaccctcagtgataaaatgaagtattgagcaaaacaacctcaaagacaaataggaaattgtatggagggtttgtttttatgatgaagataattcattgtagtatctagtttttagaatgcttcttgcattttatccacagaagcccggtgaaaaacattgttttcattttttatttccataggcaaggaagcttccagaacaagtaattgggatagccaagtccttcaactgcaaatctcaaatttagtttagttatatgccatcagaacagaagcatgataaatatatatacatgccatcagttccctcgcttggtggtaaacaggcattatccaagatgttgtctctagctgaagctgaccatgtccttcatgattggtcctgggaatcccaagggttcctttcatttctagagcctagcgagacaattggtactggctgccagccagtggccctacttagggattccccacccaggtgccaagcagtggaatgactctaaacagtgccaggctgagctgtctctattgcttttgctttttaacctgaagctgtgaacagacttactcaagccatcaaaagaatgcttttttttttcctgcaaagcccaatcaaatcatctctagactagcaacctcagttgtgtacctgtcacatgccaaacctatcccaagctctgcttgtttattttaggaagcgctgttgaacccctgttgtgtggctagctgagcttggtgctgtagactaaagcacattccttcatgtcaaatcacttacagtttaacagacgattagacatataactgtcaaaatgagcagtatagatggtaagtgctcagtttaggttattgtgtcatggactttttattcaccttaattttgggtaattgc

SEQ ID NO: 26907 - DNA, 1094 bp, Homo sapiens
ttaagtggatattttaagttacttgggaaaagaaaaagacttactggtgactgaatgaagtaaaaccctagagagacccaatttaaaattgaagaaatgagatgccctgggtatagagagctatcacaattgacattttcttgagggaaaaataaagagaaaaaatttatttaaaaggttctgggtgtagattcaatggaaataattgaaaattattagagtaaactaagtaatgaaattcaagcttatatcaagtaacagtctgtttaatgtctttgtctagtcgtctaatgtttttaacactggtatctccttttatattaacagatgaacactgggcagcgtagggatggacctcttgtacttataggcagtgggctgtcttcagaacaacagaaaatgctcagtgagcttgcagtaattcttaaggctaaaaaatatactgagtttgacagtacaggtgaggattttgaattttgggaggtggggtagaaaaaatgttaaatagatgatccttttggagaactacctttgataatttacatatgttttaaccattgggagatggctgtatactttgcatcttgtaatacatctaaattttttttcagtaataaactacttatagacaacaacgtagttaggaaatgtaaagtttaaaggtttgcatatattttaggacaagacagtatttcagaagagcaaatttgtgacttttgctagtgacaaataaattgttgtgcagtgtaatgtcataatcccttagctgtaatttgaaaataaaaatttgtgtttgccaatatggctttaagatatatggtttatgatctgatttttcatattgatggccaggttagagaactagatactaaatagaagtagtcttacacttaagtgtaaaaattgttgcctttgaagattcagatataagcttacaaaatatagatgagttataagaagcaggccaaagaaatactttggcttgtatctttctttctcttactgctttttttgtattttagtaactcatgttgttgttcctggtgatgcagttcaaagtaccttgaagtgtatgcttgggattctcaatggat

SEQ ID NO: 26908 - DNA, 1027 bp, Homo sapiens
cacgatgcagccaagaatgggcatgtggatatagtcaagctgttactttcctatggagcctccagaaatgctgtgtaagtagttcaacgtaaaaattatttttaaaatggacctatattcttgaatcaaggtgtgtgataaagcagactttaaaatagtcaagttgatggctttcttcactttcacaactaaaattagatgtgatcatcacattctgcactcataatcagccttcatgccctttttatgatacagttggtccttcatattcttgggttctacacttgaggattcagccaactgcagatcaaaaataattgggaaatatcaatgacagatcggataaaaaaaatgtgttacatatataccatggaatactatgcaactacaaaaaagaatgagatcatgtttttttgtgggcacatgatggagctggaggccattatccttagtaaactaacgcatgaacagaaaaccaaataccgcatgttctcacttataagtgagagctaaatgatgagaattcatgaacacaaagaagggaacaacagacaccagagtctacttgagtgtggaggatgggaggagggagaggagcagaaaaagtaactattaggtactaggctcaatacctgggtggtgaaataatctgtacaacacacccccgttacacaagtttacctatataacaaaccttcacaacttaaataaaaacctagaataaaagtttaaaaaggggaaaaaaaataacactacgataataagtaatataggtaaaacaatatagtataaatatttatacagcatttcatactattaggtattacaagtaatctggagatgatttaaagtatacgggaggatgtgtgtagtttacaagtaaatactatgccatcttttataagaaacttgagcagcggcacattttgacatcacgggttgaggaaccaattccccatggatagcaatggggataactgtgctgacatatttgggggagatttactttcttaattcagaaacagtt

SEQ ID NO: 26909 - DNA, 1028 bp, Homo sapiens
catttgactatcagaaatggctcctccagttcaccacaaaggagctgctttttaccctacaatcagctgttccttttactgacctgttcattgacgttcattctctttaattattgcctcaacacctgagatgtggcagcgttttatggaacctggcctgttttctgaacacttggcagtggttaatctttgaaactgacacaaacactacatgtgaaatagagcagtaggcaccatagctttataagctttgctctgtgatttcatgcaaatgttaggaaagtatgatatggtagaccttagtactaaattaggatagcttttatgcagtctcagcgactgtacgtagtcaattcacccaggaaatcctttggtcttctggatgggtagagaactttgggacacctgggaggaaccacttggaggtccacaaacatgaggctggtgggcaacataaaacatttgagaagaacatggagtagacattgagtgtggtccaaagattcctgtatttctgtgtggagaaagggaatagcataaactgagcttatcccagctgctgctggtttgttttccttgcttttcttccagattaatgaggaatacagtcagctctgtgtatctgtgcattctatgtttatgggttcaaccaactgcgaatcaaaaatatttgggagaaaagccaataacaatacgcaataaaaaaatgcaaattaaaaaatatcgtataacaactatctacatagcatttatattgtattaggtgttataagtaatttagagatgatttaaagtatactggaggatctctgtaggttatttgcaaatacatcattttatatgaggaatctggattttggtatctgctgggattctggaaccaatcccccacagatactgagggatgactgtactctatttctgataccagtgaggcagggaccttacaacatgaccacatatcctttggacatgttgaatttttgcacttggctctggttgtgttttagtttgatttttgcaaagcc

SEQ ID NO: 26910 - DNA, 1041 bp, Homo sapiens
tcctttaattccttaaacttactacagttgccccttgaataacataggcttgagctgcatgggtccacttatatacagattttttttggtcaaatgcagatggaaaatacagtattcatggaatgcaaaacccaagtatacagagggctgactttttctacactctgcttctccaggagtgagtacaggaattgagtgtgtgggtattttggtatccaagggagttctcgaaccagtcccctgataatatggaggaacaactttgtatgctctctgctattgggcttttgaacattttatcatcttgctcttgcctcttggtctaggtaacttgtgatcttttagaatgctttttaccatttctattactgtaacacttgtcagagccaatatatttcctcttggatgatagccacataattggctattgtttctactcttttctttccaaagttcctcctccacatggcagtcagagtggtaattctacaatataaaacattatatcccttttctgcattggatgtgagatccacaggactgtttcctttacatcatttacatctcagctcaaaaatcaacttctccttgatgccttccttgatgaccttaattaaagtagcaggtgagtgtaaagaagagtatctctcacaaaatctggcactttgtgtacatagagacaattttttttctttttaaaaactctgctgaatctttgtatattctgtctaccctcaatggaatctttgtgttttaattcttgattataaatctatatttttcaaatttttaaaaagtattttatatatatatatgtagaaaaaatatatattttctaaccatatagtttaatgaatttgcacaaactgaactcacccagaacaaaaacaatactctggaagcccctcttgtgctccctttcagtcactacttttccctgtaggggtaaccaactactattctgacttaacacattaaatcagttttgactgttttatatttgatgtaagtgaaaacatataatgtgtatgtagtttattt

SEQ ID NO: 26911 - DNA, 2426 bp, Homo sapiens
agcaaattacatgagcaaccttagatttgatgtatgtattttactctttaaaacagtattcaacaaggatattacaattgaccattgtatgttagaataacctctgctccatttatttctgttcaaactgtttagtttttggaattaaattctgctgaatgggttgcttttttttttttttttaattattttaaagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcaggtaagaactatccctatctctcttagttaaattcatcagttaaaaactgatgaattcatattcataaagtatataaaacatctatctggagttctggaatacgtatttcagattttaaaatctgtaggttttttttttttttttttaaatagccattgagtctctctatgttgtccaagccggacttgaactcctgcactcaagggattccccccacctcagcctccctggtacatgcatgtgacacacccggtggttttttggaagatcattttgagaaatgacgggaaccatagagataattaaagtctaacccccttattttatagttgagaaatcaaggtccagagaggtgaaataaccttgcctacagccgcatgtgtagttagtactagaagctggagaaataaagcccatttctgactgtaaatccaggaacttttttgctgctttacattgcctgctttttacatttatgataacttctgcagaatatatatggaatagtgattttggccttaatagcacttaactcacttaaatacactttcccaagatagaatacgacatttttccatggatcacttttctagactgaattaattagatgagcacattttgaaagagcagaaatctaatattcattttcttttctatttaagtgggggttaacgttttttaaattgtccttagactctgtgtattaactgtgtatctttccattgtgctttctgctgagaactaattaactgtggaaagaaagtaaaatgttttgtatcttcataattggatattagagttgtctttttattgaccagatcatgctattttagtgtgtgtttgtagaagaacgtgttcttgactggcaggatgccatggatgattgataatgctcatataaaattgttagatttctatttttaaatcttttgttcttagaatcctgccatgatgtcttattgtcagctaaagatgaagttgattatacaaaataaataaatgtggcaaaaactttgagtcttaccacaggtccatatttttaagaattagaacttaaatcactttatacctattaaaattttccttcagctagttatctgcgtcattgtattcaactccattcttttatgataaaatgtgctgtagtgcagaagtttttcttactttcagatgtaactatacacacacatttttaaaagttgccgttttttaaaaatgatattgtagttgtaaacctttttaagaacacactgaagaaaaattctgtcattagttcatctgaactcttcttatttaaagacagtactgacaatgtttattttctagttaaaagagattggtgtgtgatctacctttctctccccacatagataccgagggtcagtgcaggggttcttaatcaagggcccatgcacctttggcagtgttcagagttgaagtgggtaagggatcagtgagcttcttgagttaattgtgcagtatgaaaactgttcatgtttgtgtgaaagtgacttttgttagattcttaggagtgtgtggtctgttaggattattggctttgcactgaaatttggagtgctactttgggatttgtggctatgatgatattttgatttggttcttcaccagttgctgtatagtaatgtattcatttgctagaactgctgtaacaaagtatcacaaactgagtggcttaaacaacagatatttattgtctcacaattccagacactggaagtctgagatgaaagtgtatgcaaggttggttctttgttgaggtctgtgagacagaacctgttttaggccagtctccttgtcttgtagatggccatcattatgttaacatggttttctccttgtttgtgtcaaatctccccctttttaaaggacaggagtcatattgcgttgggagtccaccctactccagtatcgcttcattttagctagttacatctgcaatgaccttatttccaagtaaagtcacattctaagttactggggggttaggacctcaacatgtgaattttggtgggggaggaacacaatttataacaatataacatttttaatgatgataaatg

SEQ ID NO: 26912 - DNA, 1036 bp, Homo sapiens
ctatagctaaagagttcagtcatcttaggaaggaaatttaaagttgagaaacagaatcaaggcgttgagtcaagtattgccagagaaagccggaaggctacggactgcatcctgggggtatgcctacatggagaggtaggaaaagcagctaaggaaatgctgaaataggcagatcaatgtgtataaaaatattaaaatgcggtggaaggaaaggtttcaggaaagaagatgaggtcagtgctgtttcccagagtggtcagagagaaggggaccaaaaatgctttggagaacagtttcagcagagtggagggagttaaagctaggaaggtgaggagatgggagtagctggtatggagcactcatttaagaacttttatctgttcaagaaagggaagagatggagcagaaggtagaatgggaggtatgatcaaaactgtgttttttctgtgtcaaaggagagattacctgttcatgtgtagatgcaaatgagagaagaaaggcaagtattatgaatatctagtgctttgggaggcagaaaagatatgggaactataggtagagtagcacattttaggaagagtgactaaaggagatcgaattttcctcttagactctaggaagggtaagatgactggtgaagagataaaaatgtatttaggtgttaaaaaacttacaccattaagttccagtaaagttaatgagatgaggaagcatagagattgttttgaatagccatctattcatttgtttgtttatttatagaatattgaatacattactttggtagagatacaaacatgaagaggctaccaaataaattttatgtctttattttattttattttaatatttttgagacagagtctggctctgtcactcaggctggagtgcaggggtgtaatctcggctcacctcaacctgtgcctcctgggttcaagtgattcttgtgcctcagcctccccagttcctgggattacaggcgtgcactaccatgcctggctaatttttatatttttaaaattttatttatttattt

SEQ ID NO: 26913 - DNA, 1004 bp, Homo sapiens
ggcatcagcgtttgtaagagtaaaccccaacacttgagtcagggaggcagaatctgtaggctcagttaaagattatgggggtgtaaaaatggacagtgaatgggatactagaattgtaatggaaaatgtttgccaggtgcagtggctcatgcctgtaatcccagcattttgggaggccaaggtggtaggatcacgaggtcaggagttcgagaccagcctgaccaacatggcgaaacctcgtctctactaaaaatacaaaaattagccaggcgtggtggcacacgcctataatcccagctacttgggaggctgaggcaggagaattgcttgaacctgggaggcagaggttgcagtgagccgagatcgtgccactgcactccagccaggatgacagagtgagactccatctcaaaaaaaaaaaaaaaaaagggaaaatgttttacaaggcttgaacttaagtaataattctcagctgttaaaggaaccctattgccattgacaagcacaacatactgccccttttattaaagtgtcagtgtgaccaggtttgtttgtggggacacagtgtgctctagatgtgcttggggtgattagggaagtggtttagtttgtggctgtaagtcttaaaaaaagaatataggtaatttgagaagaactggggtaggtcatgaaaaatatggaaaaattagaaagtagaaatcaagctatggaagtggggcgggatgagcaaaacccattgtcaaatcagatccacgcggatcatgaattttacccatcattaagctttactaataattccgaagaggcaggctattgagaggctcagataaagcagagagaggtctggggcattgaggatgtctccctgggaccccctctccctccctagacctgtccctctgattcacaatactaaatgggtctaagtaaggtgtacagtgcaaagcttttaagttttaaaagaactccatttgatacccctcattattttgttggctacatga

SEQ ID NO: 26914 - DNA, 1062 bp, Homo sapiens
taaaaaaaaaaaaagttgcttatgttttcttctaaaatgttgaaattcattttccctacagattggatcgcatattatgtactgttctgtactttgcttttttcccacttaatatattttggacatatttccattttaatatgcttagatttacttttttgcttcagggaactctctagtattctcttgcacggattcaccatcacttattcaaccagttcctattgatatttacgttgatttattttttttcctgttggaagcaatattgtagtggacatccatatatatttgtatgacctttcgtagttttttcagtagaattgttggatcaaagtatgtgcatttgaaatgttggaattgtgacagtgcttcatgtattagtctgttctcatgctgctaataaagacatacccaagactgggtaatttataaagcaaagaggtttaattgattcacagttcctcatggctggggaggcctcacaatcatggcagaaggcaaaggaggagcaaagtcatgtcttacatggtggcaggcaagagaacttgtgcaggggaactcgtatgtatgaaaccatcagatcttgtgagacttcgagaacagaatgggggaaactgctcccatgattcagttatctccacctgaccctgcccttaacatgtagggataattaaaattcaaagtgagatttgtggggacacagccaaactatatcacttcattcttgggaaactaggaaaaacacttcaaggtggagaacagaggttgcaatctcagatctctccaggaactaggcaataacatcagtgagggaagtgggtaccccctgcccttcaccccacatattgaatggcattggaaactcatactgcttttaatgggagcagctgttaagctctagatagctgcttgccatgttgagaatgtgaacccactcgccatgttgagaatgtggacccacaaatactggaatttttaatttttcaaaagaagctgaaaatccagattttcatataaaatgtccagattttcaaataactcaattaaaaaatatgccag

SEQ ID NO: 26915 - DNA, 1050 bp, Homo sapiens
atgttcagtataaagaataactataggctgggcatggttggctcacacctgtaatcccaacactttgggaggccgaggcaggtgcatcacttgaggtcaggggtttgagaccagcctggccaacatggtgaaaccctgtgtctactcaaactacaaaaaaattagcttggtgtggtggcggcacttataatcccagctactctggaggctgaggaagaagaatcacttgaagctgggaagcagaggctgcagtgagccaagactgtgccactgcactccagcctgggtgacagagctagaacctgtctcaaaaaaaaaaaaaaaaaaaaaaaaagaataactagaaagtgaatactcgtgtaaccacctccatggcaagagatagctattgccagccccttatctcctccttgatcatgtctagacttctagctttcccacctatgtgtgcaccttaaagatgtacttttgttttgcctgcctttaaactttgcataaatgggatcaaactgtgtgttctcatagaactcactttgttggtggagctttgtgagattcctccgtgttgttgtatgtagccttgttcatggtccttattgctttagactgtattccattttgttcccctattctactcttggtggacttttgggtggtttccagttttgggctattaagtatggtttaaagtcagcatataaggtgaaattaattattcatctctcagtcatactggcttcccctggttcctcaaatataccacccacacccctgcctcagcgcctctgcactttctgcctgccctgccttgaagactctttctctagttttctgtgtggataactccttcactttatttagatctcttctcaaagtcattttatcagaacattctaccctgaccactctcttaaaacagtgccccacccttcactgtgtcccttactcactatgtatttctttacagttctgaatgtcacatggcgtaaacatatgtgcttatcatctgcttcctcccacaagactgtaaggccaattttcataaattta

SEQ ID NO: 26916 - DNA, 1013 bp, Homo sapiens
ttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccact

SEQ ID NO: 26917 - DNA, 1032 bp, Homo sapiens
atgtctgaaaaaaaaaaaaggaaagaaagggattgaaggagcttgccaagggtaggctgcctaaattcacattttccctgggtctttccgtgaaatggggacaccagaaacccaagggtcgggtctagtgccctcaactctctggggatgagagtcttgccttggggtagacaagaggcagggcagggaggagcagagccctggggtgcggccgtcctcaccgcctgttgctctactcaccccagtgcaaaccttcccgtggccgcaaacgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaac

SEQ ID NO: 26918 - DNA, 1026 bp, Homo sapiens
taaaatatatatgggaaacaataaacctttacccctacttcacaacatatataaaattatttgagctagatcatagacctaaatgtaaaaccataaactataaagcttctagcaggaaagatagtagactatctttggtattttaaggtaggaaattattttttagatggaatacaaaaatatctaaatataaaacaaattaatcaattggaattcataaaaaaccaccaaaaaatgataaaaaacaaaaaaccttcacacaaatatctaacagaccaaaataaaactgattaacaacaccgaatattggtggagcaattgcaacattcatgcattgcttgtgagagcgtaaaatagtacaatcacttgaaaaaatagttgcacattcctttttaaataaactatacagagagtgatgccagtgacatggcaatgtaaggacctctgaaaattttccctttcataaaacaatttttaaaacctacaaaaaaaagtcagaatcaactttttttgaactctggaaattaactaaaagtttgcatcaatcagggaagatttagtcaagaaaaacagctaaatcttggtaagaacagtgaatttctggtgttttaaatttaccctattttaattcttatctctcccactccatgaaagccttgaaaatcaataccttgctttctgagtaaaaatcagcaggctggaggccaccagagggcgcagaagagggttggcattctttcaaaacctaattcccagagattatcataatttgacctgtctggtgattctctggaagattccacttgcaaagctgagagtatttgaactgacttggcactggcccagtataaaaagctttttcttttaggggtgtttgttgaaaacaattatggacaattatttatttctgaggctgcctaagacagtagataacagttggggcaaacaatggctaagaacaacaacaacaataaaactttaaaattaaaaggaaaaggtgggaataagtttacatgggggctttga

SEQ ID NO: 26919 - DNA, 1047 bp, Homo sapiens
atccagtaattttttcatctcagatatgctttttatattcacaagttttatttgagtgtatttatcatccatgtccctacttaaattttgaaatatgaaataaaattataactatttcaataaccttgtttgctacttctaatatatgtgtcaattcggggttggtgtcaatttattgaccttttccttgcattatgagtcataattttttgtttcttggcatatatgtaatctttggctgccagagattttgaatttcatcttattaggtgctgaatattttggtaatcttataaatattcttgaatattgttctggcataccattaaattatttgtcaacagtttgttatgtttgaattcttctgttaagatttgttagaatcagatttgcatttattctaggtctgattatgcctcactcctggggcaagatcctcctaatactctactcaatgtgaattatgaggtttccagtctggctaataagaataggcactattcccagcactgtgcaaacctcagacactgttctttctaatcctttcaggtgattctttaactggctttgattagttccctcacataacaggcactgatcctgactctgcagtatattagaagggactctctgttgatctcctggattgtctctgtttgccagcctctcttcccttgtactctcccatatgaactctcacgaccttggtctacctggactctcagatgcatctcctcaagtcaggaagtcttatgggcactacctgtgcttttctgccctgtgccaagacctacagaccctaagtcagtaagctggggcaatcagagttcacttcatttgttcccatctctcagaggtcactaacatttttgcccagtgtccagtgtcttgacaactgttgtttcacatgttttgtcactattttttggttatttcagataagacactaaatccatgaattgttacttccccttagtcagaagcagacatctgactattctgtatcttgactgtcatggttttcatgactgcacacatttgtcaata

SEQ ID NO: 26920 - DNA, 1064 bp, Homo sapiens
aggacagttgatggactcttaaaaggtctgggcagagcagtgagggatggtaaagcaccccgagtgctccctatcaggagcagggagccatcctcccaggccttaaggaaccaggagggagctggagggcagggctgctgactggagtgtggctagagggaggtgggtaggggatgtagccactggcaccttgcccttctctctccctccctctcataccctgccagtccctccttactagccaaaggccaaagctatcctgagccagagactaagggggtctggatgacatagtaaataaaagtctgccttcagggatgcagatcagggtagagagtagatcaggagcgacgtcagtgaattggggaagagcacacaccttcacagtgtcattcacataggtttcaacttgaacttcagggaatgagaaaaatggatgtgtgcctctgaggtcttactatgtgtctctggatggggctggagggtaaggatcatgcttctgtgactttgtggagcacatgcagattgagggcctgctgtgtgccaggtgctgtgtgagggctcggcacacagatcagctaggcaggctctgggagcccacgggcagccaaagagtggctttctctccctggctgggagagaggtggtgccgagagccgtggggacctgggtgtagccatgatgagtgcctggaagggtctgggaagagttttcagagagtgacctagggtggcaagagacgggaggggagagtggactctgatcttgggtgtcatttgcatggctgtgggtgagactccctctgatgttctcttctcccaagttgggttaccagttgcccaagactaaagacactcactgaaactattggcttcccgacttgcagagggttgtatgtgcagtgggtaagggcaggttggggccagactgcctgggttccttggctgactgtgccccttgccagctgtgacctgggcaaggtacttacatcccccgaatcctacttttcctgtataattgtttgctctttttatcactaggaatagccctatggagttggcttt

SEQ ID NO: 26921 - DNA, 1063 bp, Homo sapiens
attcatacactaaggaccagacagggaggtgattggagttcagaggtgggaaagagatcctacttgctggggtggccagggagggctaactggaggaagagagccctccttgtaggaaaagaagggaaagcattccataagtaaagacctggatgtgggaacaggcaagaagagtttaggggctggggctgatggagcagagcctttgtgcttggaaatggaggtgtgtgaggcccagtggtgggtggcctgaaagcccactgaagtaatgagactggctggctgcactatttcaggctgctgggatttcacttagagccccaagatggggttcaaatcctgccgtctctattagagttgatgatgttggctcagtcatttaactttcttatctgtagagtggggataaaaggtattaatggtactcacctccctggattcttgggaataaatgagatgctgtaagtcattgacctctccaatttgtggggtcagcaactgtatgaaccagaggcctggcgccgggcactgagcgtgggtctttggtgaaggtttgtggaaccagatggttctagcactattaggatggttttccacatgtcaaactctccctcctgtgcttggggccagccagattatgcctgagtcttgggttggcctcatcatccctgtctcagggggcattctgcccatcagggccactagccatggggagagagcccatccctgggatgtctgccctaagggctcatgctgtttctccttctgtccacagcccatcaccactgagaatgcaccaaagaatgtagtggacaaggtgagtgatggcaggtggtggtgggggagctggaacagcctgggcaggtgtgagaaggctggaagtggagagtggatttgggggagagtggacagatgtggttggggaaatgcttccggagtagatttggggaacttgcagggaagtagtggggcggctgctgactctgggagaagggcatctgaccatccctgtgtgtttggaaatgggctgctaggcaactgggcaggcagagagggaggggca

SEQ ID NO: 26922 - DNA, 1054 bp, Homo sapiens
agtgaaatgaagtgcacagaagtgcttgggactctaagtgtcactgctctgcacgctcgggctcaggcctgctggggttgtttaccttctttgcagtggtccctccttccctggtctcactagggccaggctctcccgggcctcagtgctgcccagccctgctgctgcagatgtggagtgttattcatacggagcccagtggagggtcatctggcaacagcgggggctggggggtggagtgcagtcgggcttggaactgccagcaagaaatcgcgcttggattgcagagggacaccatgggagtccgaggagggcgggcggggaggggtgagtgtccatttctccttattccagctgaactcccaccttgtggctaagaacagaatgtccttggctgctttatgaggctgggggttcagggtttagggaccaccaggcagaagctagatgtctggctgctgggagtctcatgagctttgtttacatgaagagcggtcagaggttaggacaaaagggaataggttggcattccagctggggggactgcagttagaatccagaagagactcgtgcctgagcaaggctgcgtgtctctgtgaggtgccccgcctgtgcagggggctctgcccttcgaggaggctggatcagccacctggtggtgaaatggctgtgtcaccagacggtgctcccagaggctcccctgcctgagtcacaacccgcctccccagcggtaaagagcgagggagttagaccacctccttctgcatcccagctcccccgctccctggtgtacgaccctgacattgctaacctccctggacctccgtttctcttcttcataatggacgttagtgacggtacctatgctgtaagcctgccaaaagaccaaagtgagcacattaatccatttaattcatgttttccaagtccttcaatgctggcccacctcactggagcaaaagctcaggttcttccgttggcccaagcagccctacgtgacaggtttccttttgcctcagctccttctcgttcacccgtgtcttgtcattttcct

SEQ ID NO: 26923 - DNA, 1067 bp, Homo sapiens
tttaagttatagatatgctgaggtaatgatccccatatcccttagggcaggcagcaggtggcaggatctctgagaggctagaccatttacccaaatgtgccatacaaatacaatcatgttctgtgtgccatacgataaacaaggtcaagaatcacagtgaaggatgcctgcacggtgcttacttaatatgtagtagttacttattcaatatctacccccacccccaatcctcaagagccctggttttctcagttgtaaatgagatccactatctgtcacagaaatgaaatgaaaccatgttaaggcatatagcacagtgcctagctcatagaaggtaatcaataaattagttcttctcctaggtggagtcagagatcggactctgaagctgtggttgggagaggttttaggattgcggtaattccctgaatcaggaattggttagcagtacaaggaaaaacagaactcctataagtgtcagactgctgtaatgtctggaatcctagaacaagccggctgggtaagtcctcagagttactgcctggacaacccaagacactaaaacataatcaattcattcagacaggttttaagagctattcttaaaaccctttagaaaaaattttcttctatcttttctctaaggaagcttctagaatgtcaataatcaatccagaaagggcttctggcaactgtattatctcatcttcttttctcattaacaactttggggtttttactcctgaatgcaccctaggatccaattccccatttttttcttttttcttgagatggggtctcgctctgtcacccaggctggagtgcagtggtgccacctctgctcactgcaacctccgcctcctgggttcaagtgattctccagcctcagcttcctgagtagctgggattacaggtgtgcgccaccacacctggctaatttttgtatttttagtagacatatgttttgtcatgttggccaggctggtctcaaactcctgacctcaagtgatccgccctccttggcctcccaaagtgctgggattacaggcgtgagccagggtgcctgg

SEQ ID NO: 26924 - DNA, 1084 bp, Homo sapiens
ggcccttcagcgccgtagcagctaccaccgccgccatgttcagatcccacccccgcttcaccgcgctccccgccgggaattgtagtttgcgtaaggggcctcccccgctccttccgtcctgcctacagaccagaaactacatctcccagaagcccgcagagcggacccaggagaactactcttcccaggagaccccggaggcgcgcgcgctcgcttgtttccctccagttgggggcggagtcaggtggggcggagtttgggttctctccgccacgccccggccccatcttccaatgccgctctgtgattggtgaggcggccagccaaccttcgtagctattggccgaacggccgtcgctcttcctgctggggagtcgcctacgcctacttcctgccgggaggaggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccaggtgagaactgccgctcctcaggccatgggacaggagacgctcacccctggcctctgactcctgcttttccccgctcccctccacacccgactggtcattcctaccgatatccctcttcccctcctcccccactcccaccctcacacttagttctcaggcctggctggggtgggggttccctgacgcctcctctggcccttcccctcacacacccccttcccatcatccccttggccctcccttaccgcacggtctctggccagccgtggcctcccgtcctgtgtcccgcgcgcccccgcggaccccggtgtgtctgactccaccttcccttctcgccacatgacccgccccagcctcaggcctcctcatgcttctctccgtacctcttaccgcctcccgagccccatcttctaaccctctccccaaagcagatgacctggcccaggagatggaagatgtggactttgaggaagaaga

SEQ ID NO: 26925 - DNA, 1078 bp, Homo sapiens
cagggtcctcctgctctgtcacccaggctggagtgtggtgacacaatcacagatcacctgcagccccaatctcctgggctcaagcagtcctcccacctcaccctcccaggtagctgggactacaggtgcacgccaccacaccgggctaatttttgtattttttgtagagacagggtctcactttgttgcccaggctggtctcaaactcctgggctcaagcaatctgcccgccttggcctcccaaagtgcctgggattacaggcatgagccaccgcactcggctgagtacttggttttggaagaagagagtaaatataaatgatttggggatcagtggatggggagaagctgccataccccaaatctgtttgtagcaccctccccccaggttcctcacagctgtggctgctatgtcctaggtctttgctctctctggtccagccaggctggctcttccgctttgtcaagactgctggactctgacccctcaggctagatagcagggactacccatcctagtggacttgtatctttccattggtcctgttcttgaactctgcagtcctgccagctgattaccagcctcacccatgcctacatccgcctccctgttgtttactcatcagtgcacaaatacttagattactatcttgctctgcctgcagccagacccaccaccccactgttgtcactggctcaccttgcaagattggagcagacagagagatctgaaaacctctcctacactcccacatgacactgaactcagctctcccacaagaatgtatactacttccatgattaaaaaatcagctacaggccggccgggcacggtggctcacgcctgtaatcccagcactttgggaggccaaggcgggcagatcacaaggtcgggagatcgagaccatcctggctaacacagtgaaaccccgtctctactaaaaatactaaaattagccgggcgtgatggcgggcgcctgtagtcccagctactcgggaggctgaggaaggagaatggcgtgaacccaggaggcagagcttgcagtgaaccgagatcgtgccactgcactccagcttg

SEQ ID NO: 26926 - DNA, 1064 bp, Homo sapiens
ctattttgaatgaatttattttattatttttatgtattctccaaatttgtacaaaatatatacttatttcaatcaagaaaaaataatgtattcttatgtatttattatttttaaagttagactcaccatttagtttatatattggttattgattgttaaataacccaaagcatcaaagaaaggaaactttttagaaataaagttgctactttaaatactaattaagattgctatatttgtaggtattctggtttcttctaaaagtaactctcttcttcaggattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctgggtaggtttaatgaagattaaacctctgtgaaacaaaacataactctttcaaagttttgtagtgacaaataacctccaaataacgggagataaatagaaaaattagctgagcatggtggtgtgtgaccctaatcccagctactcgggaggctgaggcaggagaattcgcttgaaccgggaggcggaggttgcagtgagccaagattgcaccactgcactccagcctgggcgacagagtgagactccttctcagataaaaacaaataaagggaggtgaagtggatctgtatataacagggttgatggcattttcattctgtattataaaaagctttgaaaaatgagaagcaaatattgtgactagtacacagatactagtggtaaagtatgccatatccctttaggtatacatcactagtaaaactagccttcttatgtgcatttaatatatgtttgtgtcagttctgaggtgcttttctcaccactgctatttcagaaattcatataattctttcattttcctatatct

SEQ ID NO: 26927 - DNA, 1049 bp, Homo sapiens
ttccaagaaaatggcaacagaggatacagctgctgagactttggaataattataagaactagctagtcaatttttaattcagtaatgtgtaatattcagttatattttgttgccctgtgttgtgctgtagtctttttctgttatcccatactttcagtaaaaacctgctatagacacatacacacatgtatataagaataaaacagggagtaattttttgcagtttgtgcgttccttcattctaaggatcttataaattagtaaatttcctgtaatcataagataaattttctgatataggaatgaaattaacttatattgtatctgctctgtataaacataaaactgaagtagttacaaaaaattattatgtggttacaggacagcttttagttctttccaagaatagatcgcaaacaccaaggttgttattaacattaagtatttatgtagcactttgcctacagagtgctttactttcttttattagcttcaatattctgtcagtaagtgtggaatttctggaacctagcccctagagactagttcttttacatttcataatctactcctttctagaaaatgggagttggtttttttttttggttgtttgttgttgttgttgttgttgttgttttgatacagagtcttgctctgtcccccaggctagagtgcagtggcacgatctcagctcaccgcaacctctgcctcacgggttcaagcgattctcctgcctcagcctcccgagtagctgggattacagctgtatgccaccacacctggctaatttttgtatttttagtagagacggggttttgccatgttgaccaggttggtcttgaactcctgacctcaggtgatccacctgccttggcctcccaaagtgctgggattataggcataagccaccgcgccgggccaaggaagttggttttaaagaaatgactttataaaggctgggtgtggtggttcacgcctgtaatctcaacattttgagaagccaaggtggaaggtttgcttgagaccaagagttcaagaccagcctgggc

SEQ ID NO: 26928 - DNA, 1026 bp, Homo sapiens
gcctattgtctagtatctgaaaatagctgttttctctattttgtccagttttctcattgtttatagtaggaaggtaattccagactctcaaacttcctcataggcagaagcagaagcagtagttctctcaggtactcaaaattgacatcacccatgggcaacacaggaatatcatgtattcctggatgtgatgcccttagaaggatacagtgtccaccagacatgtggctcacacctataatctcaacactttgggaggtcaaggcaggcagattgcttgagcccaggagttcaaaaccagccttggtaacatgacaaaattctgtctctacaaaaaaatacaaaattagcctggcatggtggtgcgcatttgtaaccccagctactcaggaagctgaggtgggaggatcatctgagtccgggggggtcgaggttgcagggagccaagattgtgccactgtgctccagcctgggcaacagaatgagaccctctcaaaaaaaaaaaaaaaaagattggatgtgagggcgatctgactgtgacatctgtcaccccgttgttcaccagggttgatttggctgatctgactggctaggcgggtatccccttcctccctcaccactccatgtgtgtctgtcgcaaacctgcgtgctcagtcaaagaggatgaccatccccaatagaggaggactggtcttcagccaagagtatacgagtagctgcactcccctgctagaaactccaaacaagctctcaaaaaaaaaaaaaaggcatgacatggtatcactgtttgttcatgtgctcttccagtttaggctgaatctcatcatgaggaaatagcaaacccagtatgagggatgttctattaaaaataaggctaggtcaggtgaagtgcctcacacctgtaatcccagcactctgggaggctgaggcaggtgaatcacttgaggtcaggagttcgagagcagcctggccaacatggggaaacgccgtctctattaaaaatacaggctgggcacggtggctcat

SEQ ID NO: 26929 - DNA, 1034 bp, Homo sapiens
gattacactggctggaataaaccaagagtgcccctttcctctcaccaacagcagcaactgcaggggtaggtcaattctttcattttactttcttttttataaagtgattcaatagaagtgtgctttggtgtaaaatgtaattaaaggagtcacattaaagttctaaaatatttagaaattagatcacttattaaagatttattacatccataagtaatgttaacttcattttctgttcaccaaacaattttagaactttggaatatatataatattcattttaaagcagaaaatgtgtattttccaacccagtacacttcattctgctgctgagatactttcaacattttttatatattttccctaggttcttcatggttatatatatattaaacacaaaaatgagatcatagtataataactgtagtaattatagtagctatcttttaaattttttttttaatagaaatgggatctcactatgttgcaggttggtagaactcctggcctcaagcagtcctccctcctcagcctcccaaagtgctgggattataagcatgagccactgttcctggccagtagctctattacctaaagtgtttattacatgccagatactgtctgctaagtgcttaaattgattttttttaaattttaaatcttcgcaacaagtctttgagatagatatattaaaaatctggttttatgaataaaataaggcttagcaaagttaattaacttgctcaaagtgatatagtcagtagtacagcagtagtaaatccaggcagtagtgctgcagttgcattcttaatcactatgctatattgcttctctgttatctttttcactgcacattaatcttggcacctatgtatattaatacagaactttcaaccatgtaagtgtgcataaggtttctcttttttccaaatgtaattcaggctagagtgaagatcgttatacacatatgtatgtttttaatgcttgttggaaattttctgtaggataaattgtcggaagtaaaattgttaagg

SEQ ID NO: 26930 - DNA, 1045 bp, Homo sapiens
cctccacctcccaggttcaagtgattctcctgcctcacagcctcccgagtagctgggactacaggaacgcgccaccatgcttggctaatttttgtatttttagttgagacggggtttcactatgttggccaggctggtctcgaactcctgacctcgcgatctgcccgcctcagcctcccaaagtgctgggattacaggagtgagccaccgcgcctggccacagtttactttttaattgattcttttggtcttagtagctgaatcattttatctggtcttgcttttggccaagaaaatctaataatcttgctgtctctgatttgacttttatataaagaaaaatgctcctttacttttgctaagttatcagagtcatggattggattggctcttgagatagtaattaaagattatttttgtaattttcatttgtttaagtcattgaccttttgagactaacaatcttgtagcttaattttcaagcatatcaatgaatttggcactttaaatgtaaatgttttaatgacaactatttaaaattaagaacaatatttttatacacctgtactatattgatgtaaaattattaactataggaacaacaaggccatgacagatccctccagaaagtatttaaccagcagtagagaaaagcagctgagtttgaaacagtcagaagagaataggacatcaggtaagtgtttgatcttacaataaataaggtgctcatttattatatatttattagattagaaataaaaacctaacccatctgtacattctttttatttttatttatttatatatattttttgagacggagtcttgctctgtcgcccaggttggagtgcagtggcacaatatcggctcactgcaacctctgcctcccgggttcaagtgattctcctgcctcagcctctcaagtagctgggactgcaggtgtgttctatcatgcctggctaatttttgaatttttagtggagacgagatttcaccatattggccaggctagtttcaaaatcctgaacacaagttatccacctgc

SEQ ID NO: 26931 - DNA, 1062 bp, Homo sapiens
aatgtagggttactttattagcattcttgtttctgcacatcagggaggtacaccagaatgtggttgtgcatgccagtctagcatgttcactacacttttgggaagtcccagttgttccaattagaagtctgtctgttaaacactaggttaccgatccttgttctgggttactaatacttttacaccatcacatctagattttttttaagtttgcactccttagaagctgacctagatgaatatacttgtgcaaatgacatttaaagcagtgcttatagaggagacaaataacagagtgggagaagcaggccagagaagaagaggaagccaagcaagagtgtgatctcaggtaaaagtaccacagagaataggcttcgtcttgatctagcagggaaactcttgggttgttctagcttgaggcagggaggctgggatttcctatttccatactggaccatctttggttaccagttgctctggctctgtccaggtgggcaaaatgttttaagtagttaaatgcagtcctctgaagaactgcagatgctgactggtgaaccacattgaaaatacacagtctaggggtgtgtaaaggataaaaaggatcttagagactctgatggagcgtcaccattgtccactaaaagagttggtactatagttcccccttcccctagcttgtaccgtttatattgactcctgtcttgtattaagtttattccattttgtcatggattcttcatattgttgcttcccacttctggggaagaatcttacaaaaggaggcttagtgggattaaccacagtgtgttgctgcaggtggtcttagggctgtaacccatattgacatctcttcctaccatcaattccatgcatcctctattaacacttctgctcatcttgatagtttgactgaatggcattaccgagatcttcatctgagggatttgagcctttggtcaccatgtgcttgtcagactgtggttgttgtgattgcccattataattacatgagagctatgcttatcactgagcatgagagcattaagaggcaccctagtgaat

SEQ ID NO: 26932 - DNA, 1033 bp, Homo sapiens
aacttaatcacatggttatatcaggttatgagaaggtctgggaaatatgcctgtatttcaactattgtggcaaaagcgtacagtggttatttagggacaactaatacaactaatagtctgccttagtttgcccctacagccactgaaataacccagttcactattcttccatacatagaacacccttatctctatccaaatggagaagaactccaaatctcatgagaacattgtatccagctcagagtctaggatctttgagtgatctttctctctgggtgcggtcttctctagaaggtctaaatgtaccttggaccatgcccctcatggtctggtacctaaaaactaaaaggcatgttaatttgcattccccactccagacctcatgcacacatcattatacattgctggagtaggaacagaataatcacagtaaaaatttctgtttaaaatagacaagaataggaaactggaggggtcttgggtctatagcagtgataaaatcttgctaggtggaaattctgaggacagtgaaggcgttggaataagttcctggttagcccatctagcagtctgattctgttgtctgggagaaacccccttgcccattgtactccatgtgacccctggctttgccctctggcagattttccttgtttgttttctttaaaggctaccaccaaaatagattttgaagactatatttttcatcaaggccatatagcttttatagcctgcttcatccaagtttaaagattctttaaaggtaaaacaagcaggcttgagaaagaattggggtctctctctctctctctctctctctctctctatatatatatatatatatatatatttttttttttttttttttttgtgaaacggagtcttgttctgtcacccaggctggagtgcagtggcacgatgtcagctcactgcaacctccacctcccaggttcaagcaaggttgaagcactgcctcagcctcccatgtagcttggactacaagcgtgtgccaccacgcccagctaatttt

SEQ ID NO: 26933 - DNA, 1034 bp, Homo sapiens
ttttcggtaaaagtcactgaaaagtaagtaatgtttttgttttggatatatgtttcaaagagcatgcaatctggcgggaactgacagttttgtgtttgttttgtagtaatagtttttgtgttttggccatactttatttaccactgaatgctctctgattaaggatgttttcaaagcagtacctaaaatgtgagcacttaaataaatgtacagggcatagaaacatttttgctaatattgttgctttgagcattcatggtgatgctcaaagttgaacagtaattttaataattgtgaagaaatttagagaaagaatctctggacatatttaaagaataattcattttaattatcttttgtcttcttatttttttgctttaataagacaattaccattaccgagtttaaggaaaccctgtctttgtcttaggttcataggaagtttaactgttactggatcatgcttcatgctgaaaaagaaacttagttttttactcttaaccaagtagagcaagccctgataatataatgaatgagcaaatgtagctgtcaattcatttagtgcaaaagcaggtaatgaactaaattgaggcattatgaaaaagtttattatattggttctgccaattttatgtcctacatcttttatataaagctttttaaagagggtaatgtgtaaattgagtcttgattttagagccaggagaagaaattaaggagggttggggatggggagaacacataaaaatcctctagacatgacctctgtgtatgcaaaggtatagtggcatgagaacatagagatttttgaggaaattataagtaattcagaaggatttgggggttttattgggaatagacaggtaagcagggcctgagtcctgaagggcctctacgtcacattagtgagtttagattttattgcgagaacaagtggagagctattgaatgatataaagcaagagagggatatgatttgatctgcagttcattataaggctgtctgaaaggtgtatggaggtagaatttttttt

SEQ ID NO: 26934 - DNA, 1061 bp, Homo sapiens
cggaccctcggcgcaggtaaggcgggccggggtagcttctcaattgagccgttttccctacctcctcctccttctgtgcgatccgcccactcggcgttcactcctctggagttcgccctgctgctactcagcccgcccacaacccctcgatgcacccccagcctcacaggtactacctttgggtgcactgccccggcttccacctctcctttgacttggtctccactgccactcgctccctccgaaactcaaacctggccccttttctctggggctgttgtcgttcgcctcttaccttctaacagggcctgctgtctcttcaggtgactttcgttacggcacatccaccaggccttggacatgatactcattcactctcttgaccatcttcaccttcctcttgaccagtcctcactgcaaaacatgaattgtatttttgttgtgcatttccttgcgcccatttctagccgccagatcaggttgttagatgtaactattttaagtcatgatccatgaaaggaaatgatgattgatgataaaatcctgtgtcctgaagagttgtcctaaagtggttttggggtattcctctcaaaatttcagctctgtataaattcctttattgaggtggcaattcctgacaagtgtctaactggaagagatacctgagagggaatgtcaagtaggcagttggatatagtgggtttggagatcttaggagagttctgggctgcgtacgtaaatgtgcgcggtgtgtgtatgtgtttgtcatctgccatattgatagtaattgaagccatggatgtggatgaaattgccgaaaaagagtatagtgctgtaaaataaaggcacctaggatggagcattgacgaattcctgctgtttaataaccaatagaggaggatgcgtcttgcaagccatgaaaaaagtcatcagtagtgttgcattctgctgaaaggtaaaatggaaggaggactgaaaaacccagtgatataaaagtactcacttgtcttaaagatgtttgatgaagtaaaatgagtatttgggttcagtcctaggtcctc

SEQ ID NO: 26935 - DNA, 1114 bp, Homo sapiens
tttaggaaggcagtacagaatagggcttagaacacaggccctgaagctaggctgtctctgctcctggcttactttgtaaccaaccttaggcaaattattaacttctgtgatttagtttttctcacttggaaaatagagataccagtttcatagggtagtgaaaaggagggttacatcaggtgacacatgtatgatactgagtgcagagcctggcccacagtaagtatttactgactgattcttagttgttgtgattaattattgtgattgcctccccctttccctccttgccaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatcccctt

SEQ ID NO: 26936 - DNA, 1062 bp, Homo sapiens
aacctggccttgagtcatggctctaccactaataaacatagtagtcttaatctcgtagaatctcaggaccttgttgtcatagggctgttggaggaccaaatgagagcgtttattaagcctttctttatcaaagtcttgcccattgcttttaaaacggcagcaattattatggagaataataattattttcagaaggatattctccattttatccattcctgtgcctttgtaaagctctttacagaatttgaaagtaaagctcttaaccatttatattgcagatattatccctagtttgtcattttcttttggaagtttctggttttcacttgggcaaaatatactgtcttaatgctttctggatttgcttgcttgttcactcatttaacaaatatttattaagcacctatcttgtgccaagtattgtgctaggaatccaaacacacgtgccagatagatggtccctgaccttatggggcctacagtccaggtgtaggaccagacttaaagtccatctgtactctacgaatattaaaagattcacctacattttctactagtaactaactcctatgagtcttgttccatctgattctatgcctttctctgtcggtcctctgcctgcaggtgtcctggtaaaggtggtggaggtgtacttctgtgagcgctgtgaacagagcttcgcagagcccactctgctggccctgcaccagtgcagtgagacccatatacagcctgtgcagggcctctctagccccccatgctctgtagagctgcctcccagcaacccaaccctccctggccctctgcagggccagagcccgccagttagccccctatcatgccctgtgtgtagacaggagtttgcccaaccccaggccctgaagagccacttcaagattcaccggggcactcctgacaccttctcctgcccagaatctggctgtgtgttctctgctgaagatcgcaagggtctgcagcaccacctgaggcagactcacagagcagttcctgtgccctgttctttccggggctgccccctgcttttcgggagccagcagg

SEQ ID NO: 26937 - DNA, 1049 bp, Homo sapiens
gactaagccttaggtatgactaagtctttttcttactgatttttaagagtttttaatatattttggaaatgagttctttgttggttatatgtattgcaagtattttctcctacattatagcttgcttttttgctctcttaagtgtctctttagatgaacagaagttcttaattttaatctagtccaatttatcaaccttttcctttatggtttgtgtcctgttaagaaatctttacctcctcaaggtcatgaagatcagtaccttattttgagtgtgtgtggcaggtgggggaggtggtgcgtcaccctatagagtacgatttctcagggcagagaagacactgtcaccctccagagaggcaggcagcaggcgggatgggggcagggagtccatgagaacttggctgctgtgggctgtgttcccagctgtcaagcgtgtaatctggagtgaaagagaatccttttggtggtggaggtcctacagagaatactgcagggtactctaaatcaactttgtgccctacacacccagttgactgtcctctcttcgcaccaagtcagggaaaaaaaaaaggaatctgcactcctgcacagtgctagtagcacagggcagggatgaagagctttcagagccagactatctgccttatagctgtgattttctttttgttattaaatctgatgcttttgttctttccagtttctaccacattgtttcacttccatttgggaagaggatgttgaggtggctgaatttgagagaggtgctaaaataatgttcaaactgcttgttcccctgctaggctggtcggagccccttccctgagccagagctgacaggagctgcttgttcttcttagaggagtgggagtagagaaaagaaggaatgagagttgctcctacactttctgaggggctctgaggatccgtcccccccaggaaaccacttgcgttccccgagcccctctgctgctcgttagttgccctccagactagaaagccatggtttgtgctggggctgggtggggctccagggacagtttaggctc

SEQ ID NO: 26938 - DNA, 1044 bp, Homo sapiens
aaggttatcatgtctagtctcagacgtcacttaggccatctgtctaacttgagcccctaatcgctccttttttatcctttcctcccccaccccaagtcaattatgtgaccctccctggaacttcttcaaacttatctctacagttttggtgccagggtgcctgacattgggcgcaggagccaggcaaggtcttcttagacccaagagaaaaagaccatttctctgtcttcaaggcatgatgcctcctagtcctgggatctgaggcagcttagttttgctggtattacctttctttccattcattcatggaatgaacgtttagtgagcacttagtatatgctggtgccttattaaacaccaagaatataattctattttattaaacttaaaagacatttaagtaattactatttgcaaggcattatgttagaagatggatcttcaaggaaaactgaaactgaaaccttgccttcaaggagcttataaccccatggaagaattggacatgtaaatactgaattgaaatacagtatagaacgaaatgagagcaaatataggtccaagtaacgtaccatgggaaaatgaataaggaagatttaattctggccatttgaaggagggaggattgtaggcagtagaaagggatcagggaagactttaaggaagagaagaaatttgagttggaccttcataaatgagatttccctaattagaggataggaagacagtgtattagacagaatgaacagaattcattctttatttcaagaggtttttttgaaagaatgagaaaagggcatattaaatggaacagcatttgttaatatttcttctttaaatacttcgtgaacacctcctatgtgccagtcactgttctagaggcagtggcagagcagcgaccaaagcaaagtccttgttctcatagagcttgcagtctagtgagctgtcaaaatggatgtggcagggtttcccttctgtcccattgctgtgataattaaccacatgtcttactgtacaagttctttgaactaaaaaaagtctctt

SEQ ID NO: 26939 - DNA, 1025 bp, Homo sapiens
ctggagtctcttcatttcattccctgtcatcattccttcccccaaaatgaaatgcttcttttccaaatctcagtttgcaacttagtttttctgaccccatcaaggatcacttgtgggtctgagatacctgggagctgtaaccccataggtttttccctgaagggtttctggctagtgcacttacttgatttctgagctcccttcctacgtgtttcaccatcctaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattggtgagcaggaggagcaccagctcagtgtgctggtccttcatcagcctggtggctgggatggtccttacctagggaggtgggacagagctgggtggtcagaaagagactgtggctggtacctggggccattttgcctgaagagagtcctgggcgccataagtgggttctgactcgtttcctccacagtgaacttgctgactgagaaggcaccttggaactctctggcctggactgttaccagttacgtcttcctcaagttcctccaggggggtggcactggcagtacaggtatgagagactccgccctcaccctgctaggtataggtccctcccacaggcattccctcagcatccgcctctcccagcattcctccccagcccccatgtactctcagacctttcacatcctggtgctgggctgacgtccctcagctcccaggccctactgaggcgtcccccggctccctgcaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgc

SEQ ID NO: 26940 - DNA, 1079 bp, Homo sapiens
taccccttcttttctcaactgctctgcagggcttggtttttccttaccttacctccccaggaatcaacctttcctgtccctttacctctaggtttctatggggctagcaggtatcaaccagaagctgaagactatctccattaccaaccctttctccccacaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcac

SEQ ID NO: 26941 - DNA, 1074 bp, Homo sapiens
gcctgctcctaggcagagagcctcctgggagagagaagccatatagcattgccgaaggggaaggggttaggaagccctccctcaatcagaaaactcccccaagggcttttaactacaacctcaaaaggaaatcagagactggagatcagagacccacaggatgaaaccttcgagagtccagtagtggtggctgaggttaccatgaggtgaggaaagtaggctgcagctgtggcagctgaggctaagagcaaagagtgggcctgagacagtcctgtggggctgaggagcagagagggcccactgggagttctccaggcccttccagttcccagtcttgttctgccacctccagactctcctcttcccactgggtttcactggagcctctctggctctcagactgcaccccttcttcccaactccccaggcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggtaagggctgcaagtcaagaggacaccatagccttgagttctgctagcaggtgggtaatagagtggagtctgaggcagcaactcatactccagaactgactcaggcttggtctagcaaaaatacttcaggatagcagcgtctctgccaagactccttcctcgagggccacctctcctccccttctttttccccaccaggattcaggaaaatggctcccttatcaccatcctggtcattgctggtgtcttctggatccaccggcttatcaagttcatctataacatttgctgctactgggagatccactccttctacctgcacgctctgcgcatccctatggtaagactgggaagttgggcagttagcccatagtctaagacgtattgggaggtgtgggtgtattcctgggcatcagttatccttatctgtcattgacaaatcaggaactgtctcttaagctcacaacccctgaatctcacttcta

SEQ ID NO: 26942 - DNA, 1055 bp, Homo sapiens
tcctgtgccctcatctcctaaccctgatacagccctccccccgccaaatctgtccaccgtgctcctttcttcctgcaccctggttccgaacttttttggtcaggaccttaggttgggtgttcaggggtgtaggcagggccaagggatgaggattgactgcaacccctgcccagagctggaggcctcatcctccctctctccatctcccccggccagcgaggcagctgagggtgctgcggcctctggaggacgtgaccatcagtgaggggggcagtgccaccttccagctggagctgtcccaggaaggtgtgaccggggagtgggcccggggtggagtacagctgtatccaggacccaagtgtcacatccactcggacggccaccgtcaccgactggtactcaatggcctgggcctggccgactcaggctgtgtctccttcacagcggattccctgcgctgcgcagccagactcattgtgagaggtgtggcctccaggaccacagcctgcctgctgacctgtgtggccctacttaccccaggcatgaatactgacccccaactcgtgtgacccccactgaccatgcctgtctcagtgtggccctcattgacatccctgccagagtgtgatccccctgactcataggccctgtgtggccccagagtcctctgcctgggtgtggcccctgactgcccaaggctcagccaaccactgactctgctaccaagagcatgcctttgccattgtggtcactgctgtctgcccgcctgcacaccaccccactgaccactctaactgtgaccctactggctacactgtctgccgtggctccctctgcccgcctaagtgtgggccccgtgaccactccagtcccttgaatccactgactgcctacgggcgacatcactagcaagtctgcttgagtgtcccccatttttacttccagtcccaggatgttcccactgaccactccactggcatctctgcttgtttccccattgccctctggcccccagcttctcccccactgaccaccttaaagtgtgactcccagtt

SEQ ID NO: 26943 - DNA, 1051 bp, Homo sapiens
aggccagcagatcaccagaggtcgggagttcgagaccagcccaaccaacatggagaaaccctgtgtcttctaaaaatacaaaattagccgggcatggtagtgcatgcctgtaatcccagctattcgggaggctgaggcaggagaatcgcttgaacccgggagacagaggttgctgtgagccgagatcacgccattgcactccagcctgggcaacaggagggaaactcagtccaaaaaacaagctggccgtaaagaacttctctggcctaccttgtctgataggccgtaagaccctcattctggaagagatcctgcctcatacctgggaggaaggaatgctacacagaaagacctcgttgggtttccacctgctgtctgttactattaagtggcacactttttgcccaaccacattactgcaggctgtccatttttcatagaatctaagcattaaaaacaagttttccctggctctttgggtagccatttctgaaggctcccatgtcatgtaaaactttgattaaataaacttcttagtttattttagatttttctcttaacctatcttgttatacgagctctgacccttatgatgaggaagaaaggcatcacaacttttcagcccctacaacagctaactagtatgcaaatataaagtcagagtaagagctcagtatattttgttgaattattaatcccataacctgacgattgtcagtccctgtttattaatcatctggaacttagaagggcagattctcccaaacagtaactgccaactctacccctcttaggcaagaaacagattcttttcaagtcactgacattgcagtgtcttgaaatctgtttcagccgtgccttttcaacccatagttattttctgagaattgctccacccacatgggtagcccctgtagccaggtttgctctatatccctttgcttctcagaaacatggaagtggacaaagggagaagcaaagaaagctgaactacagagggagagaaaaatagatctactaagggaaagcaacaggagactccgtagttctt

SEQ ID NO: 26944 - DNA, 1033 bp, Homo sapiens
agccttccaaggggaagggagctaggatctgttggacgcccacattgtcttgtgtgtgctcacagtcctgtgctaggttggccctctccagactggctgcctcgtctcaggcataataataagaggagctgttatgattcccatttggtcggcagaggacagtggagactcagggaggctcgttacctgccatggtcacagctggaaagcaggctgccgacaggtttgggcatcattatccatgtattgaagtgactctccaagccacaaacaaaatttttaactgaaagagatgaactgtcctcctaagtctcacatggtgagtcccaaggtgggaattcctagggtgggaatcagctatgcctaggcagagcacagctgtgccccaaaactcagaatgggagacccagctgttgggagttgagtagtgtcccccaaaatttatacgttgaagtcctaacccctggtacatcagagtgtgcccttatttggcaataacgttcttgcagatgttaagataagggtggactcatccattatgactggtgttccagtgaaaaggggaaattggccaggtgcggtggctcacacctgtaatcccagcactttgggaggccaaggcgggtggatcacgtgagatcaggagttcgagaccagcctggccaacatggtaaaaccctgtctctactaagaattagctgggcgtggtggcacacgcctgtaatcccagctactcaggaggctgaggcaggagaattgcttgaacccaggaggcagaggttgcagtgagcagggatcgtgccagtgcactccagcctgggtgacagagcaagactccatctcaaaaaaaaaaaatatatgtatatatatatatgggggaaatttggacaaagagacgtgcattcagagaacgctttgtgaagactggagttatgctgccacaagccaaggaactaccaaagctaggagagaggcctggaacagatccttccctagtcccttcagagagagcctagccctgcagacacctcga

SEQ ID NO: 26945 - DNA, 1051 bp, Homo sapiens
aaggccctgtgctacattcaggaattttgagtctaatcattttcatagactttgtttatgtatttctcagagtcctgatcctgggaatatctatattctagcagctccctctcttcaaatccatcaagaaaaagtagccctgagaagggtacttagtctgtatgaagggttttgggcggctgctgggctgtgttgagaaaagcagcagcttgtctccctagaagtgaactgtgcttgagtggcttcactgattcacatcacactgaacttgaatccttgtttttatgggaaataacagtgtaggaaccaaggtttacattgaaaatattattgagaaaaacttattaaggcacctcccttcactgtctgtatgcatggtgtctacatgagataattttttcaaacattcttccgtagagaataatttaggaaatttagaaccatgaataacccaggattgaagctccaaagggctagttaaggtaggaaggatgcgactgtgaaagaaatgagttgagattgactggatataagggacaaagtagagtctgcatgaaggttagttgaagactatttcaagagcctcccaactagttccccttaagttatcctatacagtgctgtcaaattgtccctcttcaagactagttttaaattgtatattataaacttgaaagcctccaatgaataaaatgtaaacactttctgtacaataccccatgcacgttgtcataacagcaatttcctcattttcacctccacacttctgcaaagctcacctcttccccaattttcctgtgttcacttttaggctactgcaaaatccactttaagagaatggaaaacaagggactggatccacagccagatttaatttcttgctggtctctcagcaccatctccctctgtacttttctcctctccaccctctctgccttggcaattttcagaatatatccttgcattaaatcccaaattatacccccttttcattatcattattaattagcccacagacggttcagcccaagaattagatatgcaaatgcca

SEQ ID NO: 26946 - DNA, 1028 bp, Homo sapiens
gttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaatctggttgtctctttcaataacttttgctatatatatggtgtgcctaaatgaattaattatttgttgtcatttaattaaaacaaaaaatcttaaattccaactgagcatacttagaggttaaaaaattattatcttctaaagattcttcacccttcagaacaatgcatttgaaaaatctgacttagaccatcgtaattaag

SEQ ID NO: 26947 - DNA, 1022 bp, Homo sapiens
agaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccag

SEQ ID NO: 26948 - DNA, 1064 bp, Homo sapiens
gatgtaacacgaaagggtaaatctagatttaatagtattttctttttttgctttgagctgcgtaatcatcctactcatttaaaaaaaatctggaatgcctctcattttgattgagtataattttacacagcctctataaagtatctacattcttgcattaaattgcttaatgaaacattttaatacacctgccttgttgtgctgtattaattgtggctgattcaaacgtgtgtctgcatgaagcccaagaaaagagattgtcagtccctgtgacttcttctgtcccttttttgtcgccctatgtacagggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccat

SEQ ID NO: 26949 - DNA, 1008 bp, Homo sapiens
ttgactggttgactaaatttaaagtgcttaagaggggtctacccatgaacaagcattagtgtcagatacctccatcccggtaatcaatgaacccaaattgggcatgtttgataaaaagatgatagatttttgacttcaagaaagaaattttgttcacaaattattaaataagaataaaaggaaaagcagaagagaaagtagagttgaatctgaaggggattgacatcctttgaaattatccagcaagggtacaaggaggaagtggcttttgaactaggcaaaaataggcaggtttttgatagctctcggggaaggaggtacattcaaaactgctgccctttctgaaatgttcaagtgtctttctctctccaagtggcttcagaacactgaaaactgtgacccattcagaagttctacctcctaagactttcccaaaggtgacccttatgcaattgtcattcccagtgccttcccggatcattggagatggggctaactccacagtccttctggtctctgtctcgggcagtgtggtgctggtggtaattctcattgcagcttttgtcatcagccggaggtaagcactgaagccactcactgtgcagcccccgaccttcccagtgtttatgatggtttttttctcttccacacaaagctaaggcttttgattgcgtcataaacttggcatctgcatcccaagtttcctccttgttgctttgatcttcccacacccctaccaaagctgctagctgtaccctggtggcaggctgagaggtccggaaggacccagctaattgtaggaaacaaagctgaagagcaagccagtgggagatttctagatgctttaagctgccaggtgttacgtttatccctctcttaagcctggactcactgccaaaggcaagaaaaagccctataaaacttgggccccaattttgagctctgccatttgccagctactactacataaacctttttgagtctttatttctattctgtaaaatagag

SEQ ID NO: 26950 - DNA, 1050 bp, Homo sapiens
gtcttttatttttctacttccatttgtgattactatgaaatttctgcctaagggctgccaggaattttgtaaaaattaaacaatacaaaattctttgaaagaggattttgagtcccaggcatgctgactttttaagctcaaaaagtacgcgtggcttttgcaagcagaagcaagtcctaatgctttgaagaatgtaaaatataatcagtatttcagaggcattgaggtggttaatctattaatctatactagggtaataaacctaccagtataaacatctgctaactagaatttggagctctcaccttaccttagagagaaagtttaacctaattctgcagtttcaatactaatcatgggttagatttttttcattgtagatctcacttgtccttgctttcttgagtagtcttagagcgtatttgtttgctgcaattaaagcagccgtagtctgattattttcttaacttgattgtaactgggtacacttggctgatcatgtgactctctaaattagctgttataagttaattcccaagcctttgaggtgtcaactctgtcctcagccacttagagctaatatttgaaggacctccagggtacttggagggggaggtggtggtgcttcaagaatcccatttgcccacagcacagtggaggagtacgatctgggctgtgtaggaggtgctgatttttggactgaaaaagcactgaccccctgcagaccacgatgtcctgctgtgattcttcccttgtttgaggcagggctacagatacaccccatggagccagagaacagaattccatgtgtcccccaaacccaaatcatatacccaaagccctcagccctcagatttaagaattcctagcctagtagctttttcgggtggtttctctgctcccaagaaggatgtccaggaggtccatgggcccccagtccccctacttcttgcagggtgctgccctgtggcagagccacctctaccttcatgcctgctgcagggattcacccatccttaagtcctccagcccgttgctggtttgctccat

SEQ ID NO: 26951 - DNA, 1044 bp, Homo sapiens
catatgtatggctcagatgaaatgtaactggcaatttttcattgttgttgttctttatttacctttctcttttaatcatctccctgttccaactaaacaaatcacccccaaaagccagtgattaaacacaagtgagttcaaagagccaaggcaagtctgcccaagagtggccgactccccctacagaaggccaagtctgccaattgcagtcttcactcagagcctggtagtaaaactgctgagaataaggtggtttcagaggcaaacagtcacctggcccagagggcttctgcaatggagccccctcagaagggctaggctatgtgagaagtggtgggtgttggccgtgtcaaacagctccttccagtaggcatccaggaactgagtggtgtgcaccccttaggaggccaagcctaaggcaccagctacagacaaggtgcccaggtggcagaatgcagcccctggcccggccaaggctgtgtggatctataacagacaattttggcatgactgcattgactttcactctggtcttctgggttctaaaatgttggttccttaagtaggaactaaaagttaatatctgcccttgtgatgactaggaatttggttaattcatgtgcctgcttagcaaattaaaatggccagtaatcagaactagaatgttaaatctcaactgatctgagtttttctcatcttttgatagaataaattgaactatctggctgggcacagtggctcacacctgtcatcccagcagtttgggaggctaaggcagtcagattacctgagttcaggagttttagaccagtctggccattatggtgaaaccccgtctctactaaaaatacaaaaattagccacgcatggcagcacgtgcctataatcccagctactctggaggctgaggcaggagaattgcttgaaccctggaggcagagcttgcagtgagccaagatcatgccactgcactccagcctgggcgacagagtgagaccctgtctcaaaaaaaaaaaaaagaataaattgaaatatctgtgtgac

SEQ ID NO: 26952 - DNA, 1045 bp, Homo sapiens
gtgagaaagcagtatttgtcacaatactagaaatgtcataaatttaaagagtaattgagtctgaattttctgcaggtttatttactagatcaaagagtgacttcaactttcagtgcttattttatttgccagcataaacttacaggttcagtcaaatgccaagaaaataagttaataatctaaattatgcagattctggcaaattctctttcttttgggggagaaaaaaagagagagctttgagtttttatctcacttcagcaaatccaactgactataatagtaagaataaaactctagcaattaatctaatagctctaggctgctagtcattccagaaaagtgacattacacagaatatactagttactctcattgcatgtcattgatatataattcaattgattttcacattttttacactccaaaatgaaatacaacttttgtcatgtcaccagattggaattcattgacaatacattaacatgccaaaaataatattacacacaagaataatgtagaaataaattacaggtagagcagtatccctaaggagattttcatttgtgtcctataacagaagacttataaccctactcatacatctgtttcatcccactacgttttagactcttcgttcaattcaataaattactcattttgccacacactcagcactctgtcagttttgctgggcagtatacttacacaaaagagtctgtataattctaaagtataaccccccctttttttttagcaaacaaatacagagactttcatgcaaatgaatccttgaaaaagatagtctggataactgtaaggctgccacaacttttgtggaaatgttttggaactgtcttcttcaaaatgtctgggaccttctttttattgataatctcctcctcctccttcttcgtcatcgtcatctttgtctttcttcttccttctttcttcttcttcttttcgatggaatctcactctattgcctaggctagagtgcaatggcaccatcatagctcattgcagcctccaactcttaggttca

SEQ ID NO: 26953 - DNA, 1049 bp, Homo sapiens
cacagtctaaggtgatgggcagacctagaaaaatgattgtaatatgttataactaagttcaggtaaagccctgggggagggagatgctgagtcctgctggggatgaggtataaaggaaggtttttggaaaattaaacaatgttgaacagcagttgactttcaactataaacctttcctaagcatctgctcagacaatggaaaggcaaaaatgcctgacatggcctttaagtgtagaatcttgtggattaagcaagtgcattccaggtcaacagaagagggacacattgtgtgcgggtggtgtgtgtatgtgaatgtgtgtactgccgggagcccaccaatggatacagtggccattggggtttaggggatgagtgacagggaaagctgtaacttctaagttttaggcttgatctattggtgcatggttattccatccttagtttcagaaaatccttgaggaggaggtaatttttaaggggtaggggtttggcatggcaggatagaaggtcagtttaatttatacttgctgaaagtagaatatataaacggctgagagtactgatccaggaaaggagggtggtcaccttttgttttgttttgttttttgttttttttaagatggagtcttgctctgtcgcccaggctggagtgcagtggtgcagtctcggctcactgcaacctccgcctcctgggttcacaccattctcctgcctcagcctcctgagtagctgggactataggtacctgccaccacgcctggctaattttttgtgtttttagtagagacggagtttcaccatgttagccaggaaggtctcgatctcccgacctcgtgatccgcccacctcgacctcgtgatccgcccacctcggtctcccaaagtgctgggattaaaggcgtgagccaccgcgcccggccatacctttttatttgctttgtaattctgaatttgactttgtagaaaagcaagttttgagaggctttatttagattgatacctttgggagacttatcagtcagttcaggctggcataacaaaaaatacaat

SEQ ID NO: 26954 - DNA, 1050 bp, Homo sapiens
aaacccacgtggagacctaactcttgatccatttgtttctaaaatggcttcttgattttttccacaggtgaatttttttttctaattaatgtctgatggtgtcttctgtctcaacacagtgtcagccctttgtgtaagaacttagagtagggggagactaattttaaagaagaggctataaactacctaataatatttaggatgaggcagataagggggtaaaggaaaagaaagaattcctatctaatgaagtgattgcagtgtgggtataactcattaatctaaagacagcaccaatagagttcaaacttagccacttactagctgtgcattttcacataaactgtttaaactatctcagcttcttctgtaccttcttgttcaacttagacgatactaaaaaaattgtcttgtagacttaggctgaggaacattaagtgatttttgataaagtactaatgctattgcaacagggtttcattattgttgtcttaaaaatatcatgtatggccaagtgtggtggctcacacctataatctcaggactttggcaggctgaggtgggatcgcttgtgtctaggagtttgagaccaacctaggcaacatagtgagacctcgtctctacaaaacatacaaaaattagctgggaatggtggcctgcacctgtactcccaactactcaggaggctgaggtgagaggacagcttaagcccaggagggtgaggttgcagtgagccgtgattgcaccattgcactcagcctaggtgacagagtgagattctgtctcagaaaaaaaaattatgtgaatctctgacaaaaatatacttttgcttgtccatgaaaaataaagcaaacacggaaactgagtgacatcaaaggaaaggcggtatgttggtaaattggagtattttcaagtattctacttagacatttcaaagatctaaggattcatattgatgtccatttagaatgcagtaactctaaggtggctggataagatagtctccagaaatataatgtactaagatcaatttatttgagaaattcaggt

SEQ ID NO: 26955 - DNA, 1025 bp, Homo sapiens
gttgccacagggcatgactagattaactcctatgtacactgacactttcttttgccttagtggaaagagtactggaatgagagttttactttttgagtttaggctccatatattattcatatttgcatccctagtgcaaaggacagtatcagccacatctcaggcatttaataaatgtttctttcatgatgtgtcatttgagataacctcacttgctctctctgggcttcatctgtataatgaagggattggttcagggctcctttcaaggattctgcaattttgtaaatgctttgtcttggcattttcaattctctactcatttgtcttcttacttctttgcataggcttttggcacaaaaagtgtagtatttaactttcttctaaaacctgccttttttttattttccaaacatctcgtgtcatgctaatcttggcaaagtttccttgtggataaagctgtttaggttttgtgtatctttcggtagttttgtcctagtaagggtgacaggagaattcttttgttttctacctgctccaagaggctctctgtataactaacttgttatctcctttacatattgaacctttgtttatttgttgacttttaaacaacatatgcacacaacagcaaaaatatttgatagtggaaaataaggatgaaggcaaagtactttgtctttgtcaattatgtcatgagacttattgaacactcatgtcttattcaaagttctgtaaatatagctaaggtttagatttcataagcagagttctttcttggtaactgtacagaacataatttccacctacaccaaccaccactgaaagtattactcaccttttatgcttatgttttcacaactgatttacagggttgtgatatctgagtcctagctcagtggatcaagaagaaagaagaagtgaagatattggccacagtttttccttcaaccctcatcaatcctatttctcaaatgacaatgctgatatgattttatattagggtaacctctctgagttctcat

SEQ ID NO: 26956 - DNA, 1027 bp, Homo sapiens
cacaaattatatgatttttaaaaaacatattagcaacttcagctactcagtaggatcaaccaataaattatgccttctgcctcgtttaatggtacagcagaacaatgtttgagtggttagggggtgtcactatctcagagacagtcaatagagcagtagctgcttaactaaacaggaatcacgttggtggcattgcaaatttccttaggtgtcttgggaaaaaataccacaaaatgtcccaaataataataaaaatgtaatttacagtaaattataaaataaggggaaactcaagtaatagaataagctaggatacttttaccaatagtaagcagtaactctcttccacttacagaaagaatagatttttttgcaataattttgaaaaagtgttttatttaaaaaaatacatagcatattttgatgccttttgaaagggtgactaaaagtcatatatctggaaagattaggaagtgtccatcatcttataatactgaaaatattgatgtaccttgtagctcacaatcagtgacgtgcaaagggaaatatggagtactttttaattgtattcctcctcatacctccttggtgacttgcagattttcatcaacttttgtccttctagtctcttttttcttactccttttccatgcaactcaaaaatgtgtgctatgaggagtgaaggctggggaacagtggtgagagagaacactttgagttactttttgtctcccattttaacttttcccaccttcttgaactatcagttagaatcatgtgcaatctccgggtaagagtgtggctgtgaataaatttatcaagataaaactggtcacttgttctgtttatgctttggtgaatttggattgaagtggctctatccagcttacagagcagacttacagttattgcacttgtagcgcctgctgtatacaggttcaatgccatgtgatttcataggttgcaaatgcaacaaactgattctgttatttcctaagctgcttcctagaagtacataaggaattcc

SEQ ID NO: 26957 - DNA, 1027 bp, Homo sapiens
ttttattgcacgaatgcaaaattggcaactcacttttggagaccgatggaaacatctgaacaaggacctcccttgtacgtcattgagggtaacataaactctgtttaccaaagcatccagtgaggggagagaagccctgacaatggtctgaatgttatgtctaccaggaggccaacggttcagtttgtagctgagcaccaaggatgctagtcggagcttgagctaagatgataattcaccaggactgaaatccttctttaatcatcaacctctctgcaaggagaatgatgaagaggggaaacagggcttactatttcactctgtaatcatttatgatttgagctgtattttaccttgtgttgacctctggtgctgttggtttgctcattctatagcctcagctacagtgttgcaaggggacaatgcagacagtggccactgcatggtgatttctttgtaagaaatggaaaaatattatctaaatgtgtagatagagagatacagttttactattttaggctcgaactaaattctttctactaaaagaattaagtgtttaagcacaaatgttcatttcaaaagtaattatgtcttgagctcactagcacattttttgtgaaggtggcattttttccttctatgttaaagtcatcacattttccctctgtgctacccatggcacacaatttcaaactgaaaatactttatctcggcatattgttgaactttgcccttggaatttaaatgttgaaatatggtattaaaaatggtgaagggatttgctgattaagtacgacttttttttttttttatggaaaggtgggagagaaatgtgcagcttgagaatttagccttattatttattttatgttgtcgttgtttgtagacttttaaaaaaatttgtttactcttgtttgtttgcactaatcactacttaaggaaaagtaagtcacaggccagcctcctcttcacgaagcctttagccatggtgaccgttcaggcataaaaacgtgcttatctgcaaatg

SEQ ID NO: 26958 - DNA, 1046 bp, Homo sapiens
ctaatggggtgccagtatataccttggtcagataaggagaccaaccatttctttattataaaatacaaatgacacagagagccaattttttttctgaatctttgttggctaactttcataattttattgaattactataatttaatgttactagtttaaactaacattttttcccctgaaatgtatcttttctatttttttgtaacatgaaaacccaagttaaattcattaagtaagacaatgactatctttcacattgaaatttctggtgcttggaaaattcttatggaaaaacttcaggaaaaataaaaagaactgtcactcagactacaatttataggaaaagatgttaccagaacaagtgtaggcttttcacaggcatacttgaaaattctcctaccacctaaccctcctctaccaaaccctttgaaaatgtttttccccactttccttccataaagggccctgtgggctgaccttaggtgaaaagagtgaagtcagtcttgggtgctgttccctctcctttcctgaatccctgtccctgccatttgccttgtacattcctactactattactactacaccacacacacacacacacacacacacacgcacaggcttgcactcagctctacctcattcacatagatactcaactggttggctgggcgtggtggctcatgcctgtaatcccagcactttgggaggcccaggcggtcggatcacttgagatcaggaggtcgagaccagcctagccagcacggtgaaaccgccccgtctctactaaaaatacaaaaattagccaggcttggtggcaggtgcctgtagtcccagctacttgggaagctgaggcaggagaattgtttgaacctgggaagcagaggttgcagtgagccaagatcgcaccactgcactccagcctgggcaacagagtgagactccatctcaaaaacaaacagacaagcaacaacaacaacaaaaacaaaagaaactcaactggttaagcctttaactggttaaatggaaagtatttgctcttttctaaa

SEQ ID NO: 26959 - DNA, 2105 bp, Homo sapiens
agggcagcggctctagggccctggctggtgtttgggggtggggggtccttcccgcacagccctgcttgtctcaaccatgtgcgctcccttgcttccttcctcctcccgcccccagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagagggacactaggaatcaaaacaaacatttctattctgcttagtttttctgttttgtaaatctttctttcttaaccactttcagcccctgggattctagaactgtgaattgtgctctgttgtagggggcaggggaagctctcactctgttgccattaaatgtatgagactgggcatctctgagcaattgtagggccggggatagagggtacttgaatcttcagaagttgaagtagcttttatgccctcaggaaaggccctggtctccggagtttcctcgcattaaaggagagagagagagagtactcttttgggcaacggccctccaaaattgcccccacattggctgccttataaatatgtctgtgtgttgactggtttgatttgtttgaagttgattttcaaatgtgagggggtttaacctgtgtgtgcctgggaattgaaaggaacccaagctctgggttacaaattgaagggatctgggttcttagagtgctggcaccctctgtcttctaggggtacagatccccattccttttcggctgtgcactgtcggcactaagaaaaaaaatctcccccatgggagacagaagtgcagcttgcttccccttcacctgccgcaagccatcctcaaactttaagggtacaaacgcaaaaagaaagaaagaaaggaaaagaaatgctgaaccaggaaaggatcattgcagcaggagacggcaggggggaggggaggattgtgtctcagtggctttggccttgggggtggttgcccctcttcaaatgcacaaatggtcaagagtggccaggggtcccactcatgcctgaagtttcctcacctgggacttggagttcattgggcaaagttagttttggagttgccagagggacaggcggctttccaggtgggctcacagccgttgccgactgtgactagctgggtccgagcccttaccagagtggcatccaagtgggacttcttttatcttcattgcccaactctgtggcagccagtggctctcctgagcagctgctttacaaagcaatgcaaaatctgcacacaacctggaaggaacatttagatttggaagttacagatccaaatggctgatttgagggaaaaacaagtgtagatactctgatgcacacaagaaatcaaagacatgtcaaaccacagcaggttgggcagggagatgcttcctttgctttatgacagaggcctcctatggactcagcctaaatcctctttttggagaggtgcatttttctgccttggtctctgagaagacaccttggcttttatcccaggcctagctgcagaatagaggtgctgagaagggaggaaggcagggagtcagacaaccccaaaccaaatgtgctcctgtgggcagtggggagaagagcccagagcagtcacagaggctggggactcacggctttgctacttgttgctggaggctccggcgctggcagactggctgctctctcgcagtacaggcgactgaggcccaggagacaaaacgtcccaaatgagctggtcaaacatttgtacaacttttccagcttttacaaagaagtccttctctacacaatctacacttggagatgaacttgggagacaaagcctggagagtccattgaaactcacactttagctcagcccagacaaagctccagctcggagcagcttgatgtgaaca

SEQ ID NO: 26960 - DNA, 1050 bp, Homo sapiens
cagtgatttaaagaatagttatttttaaagtagactagtgggcttttagtgttaaatgtctattgatgttttgccagaagaaacattgatttttctcttactttctctttttcagggcctgctttcttccccgggcgatgtgcagagatctttgccaggggtcaaagcgtcgggaagcttggggtccttcatcctgacgttatcaccaaatttgagctgaccatgccctgctcctccctagaaatcaatgttggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccagtgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggtt

SEQ ID NO: 26961 - DNA, 1987 bp, Homo sapiens
agaccaccacataccgaccctcaaaccaagatgttaaaatgattgtcttgatgtttccgaagaggaagaaagtgcaacttcttcagggcatccagaaaaacaatagggagtttctgcaaagtgagatgggcctttggaagaataggtggagacaggggaagcaaggcaaactaatgataggaaacacaggctgtatgtttggaaacacagcagacagtgtagtgtggtttggctatagggtgaggaaggagcttgaaactatatttggagtcttgaatgctagggaaaggctgcagctagttaggagaaaagcattaaagcttcttttttttcttcttttaaagcaggtaggtgatattagatctgtactttaaaaggattaatttagcagcaatatgtaggttgggtgggatggagagcagaggtgaagagaatggtgggaagggattttagcacattgtagaggagtgataatgaggacttggcctggatcgtgctcataggatccaaggaaaggactgatttaagaaaccttaagaagatagaagccacagcattcatcatttggaaaattttgtgatagtgccacttggaactttttgtgatacagctaatttgtgttgatcttctgcttaaaagtcaggtttttctaattctaaacttatgatgttataatttgaattccatataatttagcacccatacagaatataatacttagtatctagtttcctaacatgtagatgtctgctgtttttgtttagaattttttttttttaattaggaaatacacattcctaaactgtcactacttctgatgtggttgtaggtctttatgttcaattttgttaggccaggttgttattttggtttttgatttagcatgaatatttacagactcagacttgtggttccttttgaatctacattggctgtcatagtagaacattgtaatcttttgaagtttttccatgtatgaaatgtccaagatttatgaacatgaaaagctttttacacatgggcagcctgaatcagtatgtatttcagtatatctaacgggctttctttggaaaagggcaggagatttactttcaccccctatcaccatcattggccgcattagtctcttggagtcctgggcacacatctagctctgagtgctttttttctcagggtgctttctgcaagaaccatcaagccacagagaattggtatcattacaaataatggttcctcatttctcatagggatttctgttttgattatctaatggcaagtatgattatccttttttgtttatggttgaagaaaacaatgtataaagaagtggcttgtcaaaataagtcagtaataaagttggtattaagtttttcatctaatatatatgtatgtgtttgtgtgtgtgtatataaaatacacacacacgtacacacatacataccacaactaaggaacaaaattgtttttcagactcctaagcaaatcagtaaacacaggaattttgttactggggcatgtttagctgcatcatttcctccagtttattgttattttacatacagctttttcaactaagaaaaggtcttcagagtattaaaaagtagagtggaagcagattaagaactactgttccctgccattcttgattactgagttgtctgatattactctggcatatggcttactttttaataattaaaaatctctagtggctttgcagttataattgagctaagtctgttctccagagattcctgcatatgtcagttacgtcggcacttatacctatttcttcctgtccttttaatgtacactactaagctttcttttgtactgctttgtttggtggtagggatgaatggaacagaactcgattcacctttgagaaacctggctccgtgcgttataagaaatctggaaattcatctgattgatcttcgcattaacctatggagttttgttgacattggagcgtaaccttgcttgt

SEQ ID NO: 26962 - DNA, 1023 bp, Homo sapiens
acattaacaatttttgaagtaacacatttgcatacatgatggcatcttaactgtgtaaatacatcatttttaatatagaaagttattttagtacatttggttccacatagttaagatctgctaacgtgagtataatgtgtcctgtcatgcattgaatattgtgttttttttttaataggtaaaaaatccattccaggtttacattaactaaataaaagccaacccacaaggacgtactttttccttcatgcgttgagaaggtcatagatttttcctcatatttgtttcttggcttttcagcactattttaaaaaggaagttctgtactttggtgctataatataggagggcattttaaggaaaattgttcttaagctttatttctttttaaaaaaattgaaaatatatttgtgatgttttaagacctttcatgaatatgtatttttaatttaaaagcaattctaatcttttcttatttttttttttttaatatccaacttctccttagtcctactcttagaattagttgccggcccttttctgtgctcatacaagcatatgttatgcttttatttacagccatagataatggataaatactttttaatgtttatacaaatgggatatactttacctgtcttgttctgcaccttgtttctcctctgagcacattctatcaacttcatttctttttaatggctggataatcttccatcatatcaatgtactataatttatttgcttagattgttatgaatgtttagatttttaccaaacttttgctaaactatgtctgttgcaagaaatgtccttgtacctttatacaaataggtatttttagaactagaattgatcattccataggtgtaaacatctaaatgtgtgataatttgttgaattctcttcataaaaggattttttacaaacttagcatcctaccaagagaaaggttcctgtttacccacatttgatatgatttttggaggcattatgtcttcacaagattcttgttgcatttgtgaa

SEQ ID NO: 26963 - DNA, 1027 bp, Homo sapiens
gtggcatgttatacttttgagagtgaatgagtgataagaaatattcataaggacatttccaaaggtgttgaaaagcctgggatttatgtgtgtgtgttctcacctcactaatacggtggagttatatactgtttgaaggagactgagtaccaaattcatcattgcatttctccacctggaaatggtaagaaaggaatatcttcatcatgctcttagacttagtatgatggacactgtgatattggaattactctttcttggtcatatccatctgcttgcataggacgagactgaaaatctttagcaggatttataaacgtctttggaatgatgtagcacaacagtgttttactgtggggaatggggaatgactatctgaaagggaaaattgtttggcattttatattatttccaggcagtgcaaactgtctagcaagtagaatgttcatatatgaatctaatatagcaaatttatccctcataatactgtttttgaaacatcaagtttattctcaatgtgtggctctaatgacaatttcttgggaacgtaatagaactgcaataatgactaatggaaaagactctaaagctgtatctgatgggaaatgatttactttttaaactctttctatttaaggaattagcttaccgaaaggagatggtgagagctgacctaattaacaaaaaagttggaatcaggtatgctctgaaaacttcacttaattcaagaacaaagtacacgtatgactaattttttttttgcgatccttcagagtctgttaaggaatgataaaacatcagttaagatatctggtttctgatagaactcaaaaagaaaggttactgtttcagctagtagcatatgttgaaacacaatgtaaacattaaaaaaataatccaatgaagtttatggtttgttcattcctttttcagagaaactccagaaaatcttgccaaacttctgaccaggatgtatttaaaatcagaagtcataggtgatgggaatcagattgagattgaaatccct

SEQ ID NO: 26964 - DNA, 1078 bp, Homo sapiens
aataataatggctatagagcactcatgttctgtctgtctatccatcccctacctacccacccgtgtgccaggcgctacactatgtgcattacatggatttagtcttcaccataatcctgtgagggtaggtgctcttattaagctttttccagatggagtccctgagaccttgagatgttaaataccttgcttattatttttaagtggtagagctaggatctaaattcagacagtttgacagcagctgtaaacacaacattatacaacaacattgtgtggtcataattcctatgatttattctattaactagttaactgagtagttttttaaaaaatgtttttattctttaattggcacataataattgtacatatttatggggtacagtgtgatgtttctatacatgtatataatatgtaatgatcaaatcatggtagttggcatatccatcatatcagacatttattattttgttgtgttgggaacattcgtagtctgctcctctatatttgaaaatatacaataaattgtcgttaattattttgtagcatcctacagtgctgtagaacaatagaacttattaaataagtaatttatagtctcactccttttaagattactcagccctccgaacatagtctgttcacgcttgaattaacagttgctgaaggcatcactgtaactaataaataatttcaaatgtattattaagactaatttagtagtaaccacatagttattttcaagcgtaagatcttggtaaaaaatctaaaccagtattattcttgggtggttttgtccccaagggacttgacataaagatgactgttctaaaacataacagtatcacagtcacttcgtggttctcattcagtgagagcattctttgatgagcttttccttcccctttgaatctttcactattcccttgccatttatgaagtaaatcacagcctgaaatagtttctgctatttaaatagcttttacagtagatgaaacctgctaagatcaaaacctccccattccggaagacattaacatttagcatcatattttattctagagtgttaattata

SEQ ID NO: 26965 - DNA, 2104 bp, Homo sapiens
aaagacatactttaatttaaaagataattttctgatagttagtattatttttttcctaagccttctatcttcacctattcagtgcttttataacactaccttaggtgtaaagttaaaaaatgttcaggctaaaaaattgtacattatcttaccttatttttcctgctgccttactaatgttacagaaagatcatctttgtactaatctatttgtatacttgagaaattggctgagatttctgtagtttataagttgctattcgtaattttactacacctcagaattatgtttgaaattatgtgatatctaagagtgttggactggatgttagattatttgagttctagttctaacatttactagctgtgtaactatggacaattactttgcctgtctgaactctatagtccagacgagtctctctgggcctccttttcatttgtgaaataaggggtttggattatatgatctttatggttttcttttttgactctgaaatttatgtgattttaaatttctgtaagattattgtcaggtagcactgacaaattcagtctttacatatggtcattgtatgagctgagatgctgaaactgaaagaagatgtaagcttctgtgtctttttttttttttgcaaaggaattagatctttttttacagtagttcctccttatccacagttttttgcctccacagttttggttacctgcagcaaactgtggtttgaaaataggtgagtatagtacaataagaaattctgagacagaaagagactacattcacattactcttattatagtatattattttaattgttctattttattattagttgttaatctcttactgtgcctaatttataaattaaactttttcataggtatgtatgtataggaagaaacatggtatatgtaacatttagtcctatccaatgtttcaggcatccactggggagcttgaaacatatcccctgtggataagggggtgctgctgaaaaatgaatgcagatgccttcatttctccggttattatattatcttctctgtatataggtccctcctgagatctgccatctcctgggaggtgactcagctttcttcactattgaaacagtaattttattaacccctttgattgaacattgtttaaactcgaattcttcctcttctctttttgcctctccccattccccttcttttcttttccccctttttactccttcctcctcctcttcattctcttgtttttcatttttcattttccctaattataaaaatttgcctcctaagtttgagatgcccaaggtagaggttttttggagcccagcaccaccttgtacagccccagcattgcatagactcctgtggttcctcaggtgggactttggcacataatactcgtggccagaagtgaatttctctgcatattgtgcaaatgtggatataattcttaatttggacaaaaatttgaactacttatattgtggcagtgggagggcatcatgtaaaacaaaaatcattacatattttgatagaaatccatcagttattttagcaggttgttggtggtggaaatagtaggaattctggttaagtggagtttccacataattaaagcgtaacattaacagttggaatacaacttgtaatcatttcaagtgaaaatttcttaaatatatttacagttccctgctgtagtaaacataaggaatagagtgtaacttctctgcagtggttatgtttaagaaaatctgttactctgctgtagtgtggtgcttgagatattctaaactctttgccactgcattaaacgtgattctagtggtgtttcttctgtcatctccctcttggctgccttcattctgctgcactatccctttgctatcactagtttgcttcccattgtacctattatcccttctaatttttaccagtgtctgatggtctctgactgtttttagtttttatactacccctctcattctcatgtggacttgggtgcccacaggatttaggttttagagtcatcctataagaagttgtgtttcttttatttagtgaatcatctttcttttacccctttgacacttttgttgttgttact

SEQ ID NO: 26966 - DNA, 1047 bp, Homo sapiens
aagtgctggtattacaggcgtgagcaccacactggccaagcatttctcttatcagacattcactttatgatcaagcttaactttttctcagttgaaagttacttaattccagccccatatggatgtgtatacaaattatactcaaactttgattagaatgcaaagattttatatccatgtatccttttgacaacttgttttcaacaatggcaaataaataaaagaatgcagaagatttcacagtctgcggaaggctgtgacttaaagggaaaattgttctaatttattgttcgctttcagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaa

SEQ ID NO: 26967 - DNA, 1123 bp, Homo sapiens
tctttgctactgtgaacagtgctgcaacaaacatacatgtgcatgtgtctttatagtagaatgatttataatcctttggtatatacccagtaatgggattgccgggtcaaatggtatttctggctctagatccttgaggaatcaccacactgtcttccacaatggttgaactaatttacactcccaccaacagtgtaaaagcattcctatttctccacatcctctccagcatctgttgtttcctgactttttaatgatcgccattctaactggcatgagatggtatctcattgtagtttttgatttgcatttttctaatgactagtgacaaaagctaaaatagacaaatgggatccaattaaactaaagagcttctgcacagcaaaagaaagtatcatcagagtgaacaggcaaccaacagaatgggagaaaacttttgcaatctatccatctgacaaagggctaatatccagaatctacaaagaacttaaacaaatgtacaagaaaaaaaacaaccccatcaaaaagtgggcgaaggatatgaacagacgcttctcaaaagaagacatttatgcagtctggagactcaatgagcagagtttcaggagaacagcttcagttgggtgggtggggtatggtatggaaagagaaggtgtcagtgagtagaggaataagtagggagtaagacagcaaggatggtgtgtgagtacgggaaatgagctttatttggatgatgggagtgatcttgccatacttgctacacttaaataaacaccaaaatctatcagactctgctttgatccgcgccagggattctggatgtgaaatcccgcagtccggcggcctcagcatcacctgggaacctgttaaaagtgcagattctcagttctcatctagacctcctgagtcataaactctgggggtgggctgtagcaccagtgtgttttaatgagcctttggaatgagtttgagaaccactggctgtgacataattttgagaaaaattagcacagttgagctaattttcctctgaagaattagtttctgagagagttctaaagctagaagccaagatttacagagcagagagcaggagaaacaaagctctgccctccttcctgga

SEQ ID NO: 26968 - DNA, 1090 bp, Homo sapiens
agattcctttcaaaatattattgcttgttggccggaaacggtggctgacacctgtaataccagcactttgggaggccgaagcagacagatcacttgaggtcaggagttcgacaccagcctggccaacatggcaaaatcccggctctactaaaaatacaaaaattagccaggcacagttttgcacatctgtaagtccagctgctcaggaggctgaagcatgagaatcgcttgagcctaggaggcagaggtttcagtgagctgagattgtgccactgcactccagcctgggtgatggagtgagactctgtttcaaaaatacacatacacacacacacacacacacacgcacatatttgtatatatatgaaatacacacacatatatatgtaaatgtatgtatatttgcttattgaaaatgcacctagtcacccaagaactctgaggatggagacataccatgagattaatgttgtttttcatgcctgctaatacaacactcattctgtagctcatggatcaaggagtaatttcaactttcaagttttgtgatttaaaaaatacacttttgctgggcatactggctcatgcttgtagtctcagcactttgggaggctgaggtggcaggatcacttgagtgaccagcctgggcagtagaatgagactttataaaagccttaaaaaagttagccaggtgtcgtggtgtgtgcctgtagtcccagttactggggaacctgaggtgggaggatccctggagcctgggaagcataggttgcagtgagccttgattgtgctactgcactccagcctgagtaaccgagggagaccctgtctcaaaagaaaatttttttataaggctataactgccgtagatagtgcctctgatagatctgggcaaagtaagttgaaaaccttctggaaaggattcaccattctagatgtcattgagaacattcatgattcttgagagaaggttaaactgtcagtattaataggaatttggaagaagttgattccagccctcatggataactttgaggggttcaagccttcagtaactgcagatgtggaaatagcaagagaattagaatta

SEQ ID NO: 26969 - DNA, 1047 bp, Homo sapiens
ctgcttcaccctggtcaactgcatgatccttattgtaatagtgaatcagtataacactttagacatgcacacagataacacgctgttgcaagagttcatgatatgtctgctgtccaactagttttatttgcctgatcctactggtttaggcactgcctatagtctcgagttcacagaaatgttgggttttttccctccccaaagtcctcattttttataaactgtagaaaggcaaaatgacaagggaaaaggaattctaagagtgaagggatgattgttatattggggcaagaaccacagagtggctcaggctttggaaaaaatatggtgtggatagtgacaaaaaacataaatataaaaattcaagaaaaactaccagttttgaacaacaaaaacaaagggagagtttatcctttataattttaatatgtaagaaaaaattacataaacttttcccagaggaatattttataaatgtgcattgagtatttttcgtactgtggtataggagtatattttgtactgttgatgtctgctactgacttagaacaaattgattattgggttactatggagaaaggtggtcttaagaacagcaagggctgagcagcagtaggttggggcagagtgtacagtagaaattatttagtgtggggcctttgtcatttaatatctagctgagttacttaggactctctcaaggtcttgcctatagaaagttgaaactgaacttgattcctaaagtttcctttaagttttaaagtccatacacacacacacacacacacaaatgtttaagggatgttatcctgtagtttgtaatttcaaatgtgtaagtttgtttgattttctaaaacctggtttgatttactgaaggttctacttagccaaacacagtggtcgacagctcacactccagcatcatatgggttctgcagatctcaatgccacattttatggaccagttaaaaaggtaaatattgatagtttgaacgtattaagtaacttaaagttagtctattagagctgatgtgtgatttatgttga

SEQ ID NO: 26970 - DNA, 1070 bp, Homo sapiens
ttgatgagtaaagtaaagcaggcataatttatctctagaaagattgtttatatgctggcatttgaaatgccttttatttagagcagcagtaaaaatggaaaaagagaaagtaaatgatgatggaaaactagacccagagaattccttggacttttctgaacacttcagctaactccaattgttggaaatacgtggataccttattcccactagtactcagagtctctgagatggcagttttgatgaggaagaggagcaagatgaaaaaaaaacaagagtgatatgcaagaaaaaaacagagaaagatccaagcaaatattttttttgggctgctgaaaataattggcttatccagtgtggagactgctttgtgaaaagaccactcgtgtgaacactagggatgaagatgagtgtatcacccccttcatcgagcagcctaaggtggacacttagacattgtctgtgagctgattgcacaaggggcagaagtttttgcagtgaccgtagatagctggacacccctgcagggtgcttataagtggaataataccagagtggcttctttatttcttcagcatggtgtagattagttatcagtgaccaaacaaaaggtctcttgacccacttgcatcttgctgctgggatcagagacagcagagctactctagaacatctactggtgaactgttaacctcaaaccagatctgaaaaaacaactgggaagaaactgtatttgatattgccaggaggacaagtatctgtcacgacctctttgaaattgtggaaggcactgtacaaattcttcaccttagtcttaatgattctagtaattgtcttaagtgtccaagtaccagtgccttctttgtgtgagatgtaaaatattcccatagtaaaaggttgacatcaaacatcttactacaaaaaattcattggtacttattaagatgttcttccaggtgaattgcctgaccttgatgtcaaaatgtatttgaaagttgtttgaatatatcttgaatgatttctgtggagtttgtgatttgtatcagaaataatttcgacttgcctacact

SEQ ID NO: 26971 - DNA, 1021 bp, Homo sapiens
actggaagacttaattaaccagcagtatgccagcaaagcttatgataaacatgatgaatctttctggttataattttacattaaaacaaatcaaaaaagaatgtcccactgtatcttggagtcagatgcttctaagcttttgaccctcactggcgtgtatatacttgttctgctattttttggagtacattggcacagtttgaaaaacattgcttacagataatgttttaatttagtattatgtaaataccaaaggctttaaaggatataattcagactatatcagtctttcgtgtaatgagaaattacacaaaatgctaatagtacttattttatttaggctgatttattataaacactgtagaaacccagctaaaagcaaaaacactcttttcttctatgtttaaaaaatatatatatttttaaatggcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaaggtaagtgttaccgattgaaaaataattaaatccttactctgccttatcgatatttttaaaattttcctacaattaaagcagataatatcagctttcaagaagttttggtgtgtattgttaatttgtctccattgttaactttaatgggatttccaagcttgattctgtcttactaacgaagattttagatatttctaatgaattgagcatttcctgtctttaagtctcattttacatttaatccagaagataaaaggtgtaatagtattggtgagcccagtgagctcctcattcattcctgtacttcctgtataccaaagggtgtgggctctctttagtcctacatactctcttggggt

SEQ ID NO: 26972 - DNA, 1003 bp, Homo sapiens
acccaccaaagcccagagagatccttgctgagacgagaaaggaattacattactaatccttctgtgcattacaaaaaacagtagttttatttcagtgtattttgctatcaatatggattttcaaggaatgcacaacacttctggattatctgtgctttataaactgagatatctgtaatcatgttggtaagaacttgaaagtaataatctgtttgaagtgacagtaagtagaggtgttttaattatgtaatacttaatgctgctctattttatgcattaaagccttttaaatatttatcagtaacaatcaatctaagttgtataaatccgtactttattcaactctcagttttacttcaaagaatatgatcttcaactacagtatttaagaacgaaccatgtttgagtatgctgtagctttggggagaaagtgtgctaccttactatttacctttttttactctgtttttttcttcctggctatgatgcttactttttaccctttttctttaggtaaatgggccaccatttatagccattgtcaattgtaaaaacttaactttatataacttgagaggtgctggaaagttgcacattgcttaagatcatttgaagtgtttctcacctgaaaaatgattgcttttggaattttatttcctttatttgttattgtagcacacaataattattatgctcacaagaactgtactcatatttatatgactttaactgtaggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacaggtaaaatttctctctttactcttgtggttttggttttagtgattatatcttgagaacgattcactgtcttagttttattaaaataaataaaagtttgaatgttgagc

SEQ ID NO: 26973 - DNA, 1028 bp, Homo sapiens
ggtttttcccctttggtttttatacttttgatcctgggttgtttttgttttgttttgtgggggaaacgggcaagcatggtgttttaaaatttgaattccagtattgtttgtgaaaaattgtggaggccctgcatgataccttcctccaaagtaaatttaattttgttccggcaggcaggtaaagtacagtcagatcaccgtgatctagttgaggctagcttttagttagtgttggtctgttaacagtttgcctttatttccaggacatacctattcacagagcatagttcctctggggtctgaactgaaagaaagcctgaggtgtttgccaggttgccttctgaattaatgttcctagaattctaacagttgtctcttcagcacagatcttcagcctccctttgatagtttctgtttggattcttggtgtcatcaccccttgcttagggtgctgtatcagtaaacatctcagtgaaaaatttcttgcagaaattgcggctctttgtgtttctctcctcttcagaaccttgacatcttaagtcctagctgcttggtaaccaactccacttttgtctttctggttgggctcttatttccagtcctccaaagacagcaagtgactgaagggaaccagtgaaggctggtatggggctcctctcagtatgtttgccttttctccggaatcttggccctacaagtctaggttgcctttgttactcttgatgcttttaaacactgggggtttttggtttgtttttttaattgtggtcaaatacatataaaatttaccatcttacccttaagtgtgcagttcagagctattaagtgtacgttcacattgttgtacagagctgtcaccaccatcctctccagaattcttttcatcttgcaaaactgaaattctgtactcactaaacagtaactttccattttcccctccaccaagcctctgccagctaccattctaccttctctgtttatgatttgatcactcattacctcatgtaagtggaatcataaggtgtttg

SEQ ID NO: 26974 - DNA, 1042 bp, Homo sapiens
aggttggagaatgataaacttgatcgctgtgccttgtgaactgttttctgggtatatgcagtgatgattttagcagtccatgacattaagtttaggaaggcaagtattcagtgtttacactgcctaacatgaagtagaccctgtggtcagaaatagagcacattatttgtttttcttttcttttttttttttttttttttttttttgagacggagtctccctctgtcgcccaggctggagtgcagtggtgcaatctcagctcactgcagccttcgcctcctgggttcaagcgattcttctgcctcagcctcccgagtagctgggattacaggcgcccaccaccacgtccagctaattttttgtatttttcttaaagacgggattcaccacgttggccagactggtctcgaactttcgacctcaggtgatccacctgccttggccttccaaagtgctggaattacaggcatgagccacagcgcccagcccggaaatacatcacatcttgatagagtaaagggaatgaacttgtatacataaagtggactctgacaatgtatatgggaagtttggagtagtgagaagaatgtttaatgtgaattaagaaactagttcctgctttgtcattaatttgctcaagttatttaccctctcaagactcttgttttcttatctgtaaaattattggacaagagatctgattcttatcttttgggagtcatagatcctttggaaaatggtcatatttcacgaactctctcctggaagaggcaggcatgtgtgcatgcacataccatagaacacatactttgtgcagtttcaaggggtttatgggtgcctgaaacctatctatggaatctgtaaggatatgttgattagattattttaaatgttagagcccttttagctcttaagttttataccatcttaaaactgaaagtgaacagctagatgtagtgtctgaggaattatgataatgaaggaagaaaacagagtagattaagttgatcacagtttctttaggaactcttcaagtaggtta

SEQ ID NO: 26975 - DNA, 1031 bp, Homo sapiens
tctgaaaaaatcaaaaatctgaaacacgagtggcctccaagtgttttggataagtgatattcaaccttagcagatttttattatcttagcttctgggtgaatgttaaaatactatagatttatagaatgacatacctttgagttattgtacctctgtgatactttttaatgtcctggtataattaggatgtgctccatgttattatgtctcattttatgtttttaatacatgattagtatttttttgatggacagtaatgccaagtataaatttctgtactttggggatttgtctatatttggacctaatgttgtcctgaatttggagacttgtttaccaaggaagtcctcaattttcagtattccatatcatcattgattatgtgactctgttttagtttcaatgaactttagaattaaagtttttaatttgttttagctgatgatttctttgttttacctagacatttaattaggattggctggctgggattttgccccaggcattgaaatgtagagtgtgaaaaaattttaattaatgattaaaaacaattatgtgtgttgtggggtatgggagaactgtgcacattatgtccttcagctctccagctagcccaagagctgctggcccagtattgcttccttgtcaatccatggagatatttgggaatgaaaactcaagggcaaagtttggaagcctgtagctcctggtcattcctgctgttgtctcctgtcatcctcctttccagctccttttgtttctctttaccagtaatttgactgacttgaggatgtgtatattgcagcttggacattaatttatcattaagcaggttttattatacagttgaaaaataggccagacacggtgactcatgcgtataatcccaacactttgggaggccaacgtggaaggatcactttgaggccaggacttcgagaccagcttgggcaaaacagtaagaccccttacctacacacgcatgcgcgcgcgcacacacacacacacgcacacgcacacagccagaagt

SEQ ID NO: 26976 - DNA, 1046 bp, Homo sapiens
tgaactcttccaatgcatgtaaaatgtaatttcatttagaaaataaattttattacaatgccttgctttaagattgtcaaataaaatgtgaaataccacacagactgataaaaacttctcatagtctttatgtggtattggggtatttattttttaagttttattttgaaaaaaaagtttcatgaatagcacgatgtgaactcttgtgtacccttcacctagattcaccagttgtttacattttgctacattttttttgccagtttttctattgatatgtgttataattactgttaccaatattattattgctgaaccattagagagtaagttttagatttcatctaccccaaaagactttgcaacatttcttttaagaataaagaaatcttacttaaccaaagaacaatgatcaaaatcaggcagtttaacaatataatactgttgcctaatacattccttattcagatttcaccaattgtcctgtttagtggtgatttcctttatagcaatttgttttctgatccaggatccagtccaggatctcatgttcagttcctcagcctttctttgtctttcagcacattgacatatttgaagagtataggtcagttgttttgtagattatccctcagtttttggtgtgtctgattgtttcctcatgactagtttcaggttatgcatttttggcaggaataatacataagtgatgttgtgtcctcagtgcatcacatcaggaggcacttgatgtcagtttatcccattattggtgatgttaactttgatcattggtgtccgccagatttctccactgtaaaggtaccttttttccctttgtaattcataagtaatctgttcagatatattttgacactgtatgaatatcctgttccctagaaactttcatgtgatggttttagcatccattgatgattcttgcatgaatcattattactatggtggttccagaacagtaattttctatttctgctctttcttctgtaatttctttctcttaaagggaattacatgagccacgcagttag

SEQ ID NO: 26977 - DNA, 1033 bp, Homo sapiens
tacacaatgttgaataaaggaactaacagactctttaagtttgtttcctcctctttaagatgagaactacagcagtctttcacaaattgtgaggattaaatgaaatcatgtcagaaaatgctaatagtggtatcactatgacatttaaaagaatttcccaatcataaaatcaaaattttcaactataattctgtttcatgtagggcagttattttcaaacgtttacagggagcctggagggtgtctaggacccaggaggcctaggaagtgttaagtagaaatctttgaaagctccctctgtggtccttgagagcagctcctgtgttaccatttgtatatggggttctgtaaaagatttcattttaagaaatgctgttaaccattgctttaaaatcactagtaataattattaatgaatcttttttaaaggtgaggagaatactacttgctcaacttgataacggttaataggaaattgagaactgatcctgtagttgccttaactcctaatccaaatctgttgctactagacagcattcttttttttaaattcagttttaaagttgaaaatgtaactaagcaaaacttcctaatttgacctccatttagtacttgtaatcattgagaaaggattggacccaaatttactctttaaatgagaaatgttactgctgagcagatgaataaaacgacttcaaaggggaatttttacctactttaagaaaatataagattccttagagatactttcttataaaagcaagccatcattgctaagaggaattccttcacatatgtgtttgtaagtcattcttacctaaaacagctcttaactgagcaacacttagcctcttctgtttgccctgtcctctccaaagtaatggtgaaaaattcctttttctttttcatctccaattcctttccatttccactagaggttgccttgtaagattagtgacaacttgttgaatgtctgacttgtggtaggctgttttagatacttttaactaattatctgaaatcctgaaaacaa

SEQ ID NO: 26978 - DNA, 1030 bp, Homo sapiens
tgagttgaaattgtcagtgaccctgaattgggagttagaagacttagtctgcggtccagtctttctgtttactagctgtggtctacatttcacttcctccaccatgactgttcttcgcatctcatcccttcctgtcacactgttaaattgtacactctggtcccctatttctcaggcttatctttttgaattgaggtttctattacagtccttgaattattgggcccagatgtggtttattgccacttccatcatcatcttttttggcttgagaattactctcctgctctctccctatgaccatctgacttcctgaactcatgctccctcagtcattgaggagtttaataccttcctcacagatactatgttaatacattcctcacagatattatgtctagcctctattttaattttgttcattgcatgtggaagtcattcatttattcaatttaaaatacgtttattgtgtgttgctgctatgggtcaggtcctggatctacagtggcgatcagacaggcttgtattgcagggatcttcacgcttagagcttgtcatcctactagtttaaaaatcttcaaacttccattttgcattttatcctagctcttctgtttgttagatgtaggactttgagcaaatcacttagtgtcttgtctgttccctcttttgcaaaaaggaaaaaatgatgatacctacctcataaaattgttttaaagatggagttaatacatataaagcttcttagaatagtgcttggcacataataagcattatacataaatgcaaggtgttattatttaattattctatcttgttgcttggttccttctcacgttaatgtgccctttgatctcaggaagacccatttattctcccaagccatggtgctgtcacttccacctatgttaccagttgcccctttcttactacctccccagaacaaggccagaaatagcagcagaaagcatcttggatcgttctacctatttgcccccactgaacatattttctagctactcctggagaa

SEQ ID NO: 26979 - DNA, 1034 bp, Homo sapiens
ggtaattgaacttactggatattttatagatactactccagataaattcccatcagtaatatcagattctttttagtgttttgagtgcattttttttttcttttttgagacagagtcttgctctgtcgcccaggctagagtgcagtggcacgatcttggctcactgcagcctccacctcttgggttcaaccgattcttgtgtctcagtctcccaagtagctgggactaccggtttgcgccaccacgtctggctaatttttgtattttaagtagtgatggggtttcgccatgttggccaggctggtcttgaactcctgatcttaggtgatcagcccaccgctgttacgcaaagtgctgggattatagctgtgagccaccgcgtttcagccttagtgcgtattttaagtataccttcatcattgtctgtagaagttataatacacaacagtttaatgcacaatttgcatttttaaatagaccttttcctagaagttctttttaagatggaagacaataaggacgtttctgtatttgtaagctgttgacaaaggaaaagtttattccagtttataagctttcccgccttgcacaaaatgtatcatttcacatctttttgataatgtttaaattttaatttgtatgcagaggaacaaggaccacaaaactttttaaagaaagcaggctgtaattgtgaaacttctggaaataatgtgggtctggatcaaataattctgccccagggagtctcttccttactcctgggctttgttccactatgtaggattagttgctttcaggtgaaccttttattatctttatctttgaaaaatcatttcttaccatttttactgtctggggttttgcccacatgggtttgatgagcttgattagaattggagaggatacgtttgaatgaaaatgctgtcctttcctgtatcaaacggtaataaagcctttcttggcctagccttcagagtttgggaaacctgttatgaaggtgactgtctccagaatgtaatcaggctcttaagatc

SEQ ID NO: 26980 - DNA, 1026 bp, Homo sapiens
agctaaccgcaacctccgcctcctgggttaaaagcctcctgagtagctgggattacaggcatgcgccaccacaccgggctaatttcgtatttttagtagagacgaggtttctccatgttggtcaggctggtctcgaactcccgacctcaggtgatcaccgacctcggcctcccaaagtgctgggattacaggagtgagccaccgcgccaggcctatatacaacagattttctagcagtgtgtgcagccttacactactcaattcttgaagtctcatgttctaaataagattttttgctaaaatgtggagtaactcaaatttgacatcaactcactcaagttaatggccttctgattgaccagttgtacgttaatgtatgtgtaattaaactctttgacctcttcaggtttccctgctcttacctgttttgccatcatttaatttgttcagcaaatactgaatattatgtgccaggcactgttctgggggtctgtcagtatagctagaaagaccaagatccctgccttttggagctaatattgttggggagaagaggtgggagagaatttcattattcctttagctgaccagtataataacgttgtgtgatacgttaccacatagtactggaactgaatttttttttgttagcttcgttatgattatgagctaatttggatccattctgtctataacttttgcaggtttttctgaaaaccttacatgaagtaagtgactagttttggtattcagtagttaatagctgctgatttctaaaagaatttttcattactgtttaataagtattaataacattcctaagtgattcccattggaaagaactattacagtttatggccctttgttacagatagatgtatatctcagtgttagggtgtttcatagatttatcttactaaccgtgtgcttatagaccttcaaaattcctgtcttccagattggcagtcttgttcataactacagactgcgtgagttgctagtcaaaagtagttaatacctagtgtt

SEQ ID NO: 26981 - DNA, 1047 bp, Homo sapiens
agatctgagcgtcccccgcggcggccgccgggctccccctcccgtcctcccacctccctcccccggcatctctcactctccggctctcctccctccctcctcccccctccaccctctgggccggatctcgtctcgctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgagtctctcctcggcgtccgggaccccggggccgggggccgggccgagagccgcacgcgaggcccgggctgaagtcccccaacaggccgcaggcccggcctcccctcccccacgcccgccggccgcggggcgcgagccttcccggcaaccgggcggcgcggggccccggcgcggccgccctcccgggccgttccccgcgccgggagcccgggcctggcgccgcgcccccgtccgggagctgctccttcagccgctccgcgggcgtcggctgcggccggggcccctcggccgccccacgcctccccacgttgccggggttgtaggcccagtctccggcgctgctagcagccgcggagtcctccctgtgtggggcgtgtgtggaacttttcacgtggggtttcgctacactttgaaaatttacccagcctagcttttagggtgatgaaggggctgccctctct

SEQ ID NO: 26982 - DNA, 1067 bp, Homo sapiens
tattgctaaaaagaaatttgattcaaaagtcagttattgtttgtttgtttgaatggaagacttatgtagggtctttttttaaatggcaattaaaggtgatttggaattactgggaggatagtgaataattctagatgaaataaaacttgactagtatcacagaaaccaagagagaaaggccagaatacgtagatacctgggccattggcaatgggatgcactcaccatgacctaatattttggaatgtagctagtcaaggagagaactatttctgtgtctgtgttgcttttggaaagcagatggcatcttttaaaaaatagccttgaaattcaagctccctggattgctcgtttcattttcacgttggcattcaaagggggtaaccaccaggatctgagatgtggcatgcatgaatggcagtttttgtggattttgttgtagtatttttgtcataaatgtggacagtagtcttccaagacagccttaatgcaggactgtgagaatcttgtgtaattcaagactgtagaaagcacaacatggtataaaaagaaaaaccccaaaaatgtagtaatttgaataaaaagaaaccaaaaataggatggtatgggaagtgtttagggaatggtgaattcaaactaagatgcccctccagcagtacaaggccttcagcaatgcattttcttcagtttcttttttcctgaaaccaacagtcttccctttcttgccgttggaggtactgtatcatcatttttccccctttatctttctattcagaaagttactgtacattctttgttgtaaaagcatttaaaggaagatgatgatataaatgttcccaaatgagttttctcttctggatgatcgcaagagtattatacttttttgtaagaataacaaatgcacgcctgttaacgctctggcagaccacttgttaggtaagagttttacctgattccttccattggaaaggtgttttatatttgtaggcttgtcactttgagctgattttgttcttatgatcagcctcttttggatttttattcctgatttacaatgaaatatgtat

SEQ ID NO: 26983 - DNA, 1026 bp, Homo sapiens
agtgtatcaaccaccctgcctctccttttagttcagaaaatttaccccttcatgaaggatgatggaagcagtaacaccacctgtccttgcttcagttactggttttatggcactccttcctactaaaaattgtgagctatttgagagtaggctcactcttcatttcatgactccattatccaagttggtgctcacaaaacgcttgacacattgaaaacatatttatcaacagttcagggaagagtcttggatcaagggagaggatggctttagaaaagtttcaaacaagaacaataatgtggatattttttgagtatctcaaaccatttcatttgtccaatatttaaaaaattcagatttaacaatatcagatatattaaaaagtccatcaaaattacaagactgtaatctggtatgactgaatataaaaacttggataaaattaattgcaacttcctatgtatcttaaatcttggacacttcctcccttcccccaaaccattcttttgaagattgacaggaactttgctttgttttgacaagatttatttttgtgcttccaacagtagctcatcaacttttattctactagtatagttcttctgatgttaattgtagcttactgatctaggtcatagcatagcatttttactgacgtttcagatatcaaaagcaatgagaaaattatttgaaaaataagcattatatcacagctacctctattttaatttaatttaatttaatttaattaatttgtttatttgacatggaatatcatgctgttgcccaggctggagtacaatggtgtgatcttagctcactgcaacctctgcttcccaggttcaagcgattctcctgcctcagcctcccaagtagctgggattacaggcacctgccaccatgcccagctaattttttgtatttttagtagagatggggtttcaccatgttggccaggctggtcttgaactcctgatctcgtgtttcgcccgcctcggcctcccaaagtgctgggattacaggcat

SEQ ID NO: 26984 - DNA, 1055 bp, Homo sapiens
ccttccttatcttaaactatcttaatagtttctgggagcccttaagggtgatcttatcaagttgttctctgtacttttgttctgtgatttcataatactagggcaacataaacagcagcgggaagcattgatttctattcatcctgccctaaaaagatcaggagtaagagctttttagaaatatgtatttagagagaagtacctatctattttgtgatctctcaagaaagtaattatgggtgacgttctccttttgttcatgtaccaggatttgtgaaatattattcacacaccgacccaccatcccacgggcctggcctctcttgtacaggatatgcaggaaactctgtatgtgtctgggacccattattaagagttatgggagttcatcctaggatgtctgccttatagttatctcttcttgcactgagacattacagatatcatttgggggctactatatatcttctgtaaaattacttttatttgttgagaagaatgcatactaagtcaggaacatgccttaatttgttttgttttgcattgagtagaagggctaaactgtataccctccacttttagggttatttgctgtgtgcctttaagttcaaaagtagacaccacagtaaatgctgaaagttggctttaggtcttctgtggctaatgccgtattaaaaatgaaaaacatttgtaataggaaattagcctgcccttcgttctgttgatcctgttttctggtggtcataattgtgggtagaagagagtacagtttgcaaataatgtgatgagttggcaatgcagaagtttccagcatttggaaacactttactctgacaaactgattatcttgtgaattttatctatgctccacagaatgagcttttaaaagcactgatttttcttaatttgtgtccattcataagaaattaatctgtgccctggtttcctattgacaggtatttatttatcatgtgttcatagtcttcttaattctgtttccaatatttgatccatataattctctattttatagaacaagaaaaaggtatatgaac

SEQ ID NO: 26985 - DNA, 1041 bp, Homo sapiens
tctcttatgttctaactgatgttaaaccatcataaaacctagacaaggccctgcatcctattcagtattttcccaaactgctatacatcatcatcaaagtcttggccatttctgcagttcacttttcaaggtcatgaagggacggtcagcctggtggctgtgggatcacccttaagaggctgtgatgaagacctcagggacggtgtgtgtgttctcaccctctccaagtggccaaatcgcctggtttcctgagttcacttcatcttatcatatagccattagtacactgatgtagaaaacagggctctttcttaaaagaaaaaaaatgggaagtggtgttgggaaaggggacataggactcttcagaatagaagtgtgaaacaatgcaccatgtagctcgttaggcgcatggatccaaagagcctgagacacaatcccatctccagagagtccctggccagggatgcaaactcctgtaccaggttagtagtgagtagaaacgaatgaggagggctgggtgaggtctgtagcaaaatggagctttggctaaaagctgcagcgcagctccagccaattatagtctacagaaatgtgggcctacactctacactctcttcgttcaaaatatcaacttgtaaaatccttacaggtcaaaacacacgagcaggcctgattcagtccacaggctaccactttgtcgtctctggttgacagtgtagatggggagagcctgccagtcttgcagaaccaagggtagaacacaaaaaataccttttggtttcaatgtctaacttcaccttttgctcttggcaattagaaacagctcctggccttctgcaatagttcagccccttagaggtgccgaaggatacagaccctgctcacgttctctagaactgttgatttcccatctgccaacaagaatgctagaacaaggccttccttccatttccctctcttctcgaagaggagagccaaacttgtagatgtggatcccaagcctttggctttctcagaatggaactgataatatgctggaac

SEQ ID NO: 26986 - DNA, 1043 bp, Homo sapiens
gccaaggcggttcacatttaagatatttcgttttaaatgtaatgagaaactgcaaaaatgtctcctaattatactttactgagtctcacaaaaagtaattgttgtcttaattttaaaatgcacataccatttgtttattctcatgtaccattatctttggcaggcccaccaggggacccagggttccctggccgctatggagaaacaggggatgttggaccacctggtcccccaggtctcttgggcagaccaggggaagcctgtgcaggtacggatgccctgatgtgccctggcttttacaggtcagatttcctgcatcatcatcagcaccagtagctttcaactgtagctgatattggaatcaccttaggattgtgtaaaataataccgatgcctgtgcacaccccagaccaagaatgttagactcttgggagatgggcctggggatctgatactgtagaagcgctcctgtgtctgtaacatatagccaaggttaagaaccactgaactcaaaccaattaatcacttacttgggaggaatacaggtttctcagctgcaccccagaacattcaatcaatatcataggggtgttgtaaggaatatgtatgtataacaacaggcctcccacaaagttatcgcatgcagataaggcttggaaaccactgctaggattagtgtttccccatgttttcccaccctgctggaaggctctccctgttgacatctacttgtaaaatttagtacattcacctaatcccttgcttaaatctcctgcatgaaaggtggaagtaaaaattatgattaaaaaaactttcattcataattactttaaaaaagtcttcttccctcgcgtcaaaaacaaaaataagaaaatgatgggccacagtggcatttggtaaaaagcctgggaaagagtcctgttggcataaggactttgaactccttcaggtgctgcgctggttaatattcctagtaagattaggaattgaagtttagagggtatttgcagtctgtgaacccaggagaactgattaaacctgtg

SEQ ID NO: 26987 - DNA, 1104 bp, Homo sapiens
atattcttctaaaaattccacctatcaaaagcattagtagttttagtaatgatatattggggaatttactttgttaccctcaatacgggaagcattttatgtatattatctattcaatggaagaatagtttgaggtaggtaatattacaatctccatttcacagagaagaaaaatgaggtttcaaggaagtaaggaaatgaggactgagagaggttttaaggaacttgccccaagtgacagagccagtaagggcctggtttgcaaacatgggtgacctatgtatagcctgttcttaactatgacaaaaagaaagatcatactaagtgtagaataatagtaatacccagaaaagcacaaaatatttattttctaattaatggtgagaatttatgattgtggcaaaattcattcaagaaacattcttttcttcagtagaaaaacatctatcatggcataaataaaaattttggctattattttacagttttaaaatattattgaaaataaatagaaataatctaatctaaccagagtgagatggcttaatacatcacagtacattcttgtgatagattatttattggcactaaaaatcaggattgttacgtgaggccaggagtttgagaccagcctggccaacatggcgaaatcccatctctactgaaaatacaaaaattagctgggcacgatggtgcattatctgtaatcccaggtactcaggaggctgaggcacaagaatcacttgagcccgggaggcagaggttgcagtcagctgagattgcgccattgtgccccagcctgagtgacagagaacactctgtctcaaaaaaaaaaaaaaaaaaaaatcaggatcctgaagagattttagtataatagaaaaaggctcacaaaatattgtaagaaaaatataaaattatttaaaaatttaataaaatatgctgtatattttaaatcatgtttatatatttattatagtattctgattatattttcataaacataaaacaaattgtttattcacctatatacacatatatgtacatatatacacatatgtacacacaccaccaaaaattatatcaaagttttaataggccgggtgc

SEQ ID NO: 26988 - DNA, 1076 bp, Homo sapiens
aacctattcctggattgcgtttaaaaatcttgttttattttctaaatgctcaatttgtttttaatttttgcatgcccctgagatggtgaagtggcaatagttgaaatagttctatagtatggtgggtttgtttcagtgcggggtcttccagaacatgttgcaaatgattgctatttacaaaaatctcgtgtatgtctttgaagaacctagactgaaatcctggaaggtaaacactgagtgattttttttctgatgggactggttaaagaatgtctcctccaggctatgatatctcagaatggccccattaaacaagcaagacaggtggccatggagcctatgttttttgagcaatgcccttcatggaatcaataacaaatataaaggcttccaaagtaaaaatataggtgcctgttataaagagatgaattcaagtgagaattgtaacctaactcctctgactgaaatggcagttctctcaggtcaaacttttcccaatttcagtttatctgttgtccttgaatatacatttaaaaagaagaaacaaagaaaaagaaaaaaaaaacagccagcatgtatttcaacagtgcccttttcctcactgagtaaaattaagttgaatcctaagtgcacatgtggttatttattgcaggaagcatttgctagttttttttttcagactaccaagtgtgacatgctaagtaattgtctctgataatattggcataagtttttgcttgggatgattggtagcaatttaaagatagacacacaatgatgttttccaattagctgatgaagtcttttgggatggccaatcctaattcctctctgaagggtgactcagctttgcattattattttttgatgctttgtatacccactttctgtactgtattttctatgctagtgatcacaaagtactttcatgtacattactcagatgctcctgaaaagaacctcataggtgagcatagcagttatttcagagacgaggaaactcatcctgagagaggttacatcacttggccatggtagcacagctagggcatgattgatgagactagaagcctctg

SEQ ID NO: 26989 - DNA, 1030 bp, Homo sapiens
gagccactgcacccattggtcaatattttttgagccccagttccacttgaaagaaaatgatctttaagtgatttttatttctcgtcttactacaaaatgttttgctgtgggaaatactgaaaaaataacaagaagaaaaaattaaattccacaaatgtagcacctagaaatgtagcgccttaattgaaaatgtaaaaaatgaaatagagtatagaatagaaaaatatcagcgtatattggaggtactatgggtaagtattactttgtggaacttttatttcagttacaaatatacgtatatatttgcttccatagagttgagctaaaaatacaaataaaatatatgtgtatgtataattaattagttacagtgtcaactgtacttctgactatatgttgtggtaaaacccacttttggccaggcatgggggctcacacctgtaatcctagcactttgggaggctgtggcaggcggatcacctgaggtcagaagtttgagaccagcctggccaacacagtgaaatcccgtctctactaaaagtacaaaaattagcctggcatggtggtgggtgcctgtaatcccagctactcacgaggctgaggcaggagaatcacttaaacccaggaggcagaggttgcagtgagccaagatggtgccactgcacttcagcctgggtgacagagcaaggctccatctcaaaaataaaataatccccccaacttttttttttttttttttttttgatacagagtcttgctctgttgccaggctggagtacagtggtgcgatctcactgcaacctccgcctcccaggttaaagcgattctcctgcctcagcctcctaagtagctgggcctacaggtgtgcaccaccacgcccagctaatttttgtatttttagtagagctggggttcaccatgttggccaggatggtcttgatctcttgatctcatgatccactcccctcgccctcccacagtgctgggattacaggcgtgagccaccgccccagggcctaaaacccccttt

SEQ ID NO: 26990 - DNA, 1055 bp, Homo sapiens
aagattatgagtagagaatgtgatacttttttttttttttttcaaagtccatttagaacagacagcccaggaaagatgagcaactttttacattgccaatactttcacaggctccggctctaatttaaattatgtttttaggttttttatgatgatttaaaaaaaaaaaactcagtagtactgcttatttcaattctgaattttgtacacattggtaaaaactgacatttcaatactaaactctttcctgctacttataaagtttttttatgaaggtttctattttactgctatgttgtgtttcagaaagatggctgggctctgaattcagacaactgaggctcttatttgaatttgaccttgggtaagtcaagtaactttcactgggtattttttatctgtaaaattatggaagcagaccgattaagtcccctttgggttctaaaattctaagtttctaacctctattgcagttcttagattatctttttcagatcaactcgattgaagagtgtgcattagatcctattctaatcaagttgaacaaaataaagtaattgttaactacacagttttaatgccaaaataaaagtgcaggtttcttttgaaatatatattgagttgcatacttgtgtcactattaataccagatattaaaacaactcaggaaataaatgttatttttgttttatttcttgatcttttaaatccatcttaatgttaagtactagtgggttttcttggtttccaccaacttgttcaatgaccatttgtcaagttaggatgtgagactgggtaggactgggatgttactaaccactgccattggtcagattctttataccccaaaacgtagaggtgtacagattcttggagctggaaggacgtccattaaaaaggcaatacagccatctatttaaaaaataatacagttgatatatttcacctaaaattacatagtttgttatgctaacaatggagtgagatatataaccttaagtaatcctaatgctggaaagatatttaaggtactgcttatcagaccccttcatacc

SEQ ID NO: 26991 - DNA, 1067 bp, Homo sapiens
aaatataaatgtacccagggaaatttcatgaaactgcagccctgagaattgcactgatatttggcaaagacgatttttttcttccccaacttgaattttctgaacttgccatggccacaagataaattagtaattactcttgcatctgatttccttaatgtatgccagggtgctgttgatatttgtagcaatacagctacctcttaaccttttctgagttacctgtttaaggaaataagtgttaacaattgagttgatcttgttcttttgcatttcaagaaatgccacctgtttattaaagtgtaatatgggtagagcatagtttcctgacagttgtactttctttgtagcgtactgtgaaccgagaggagctgctgaaacaggcggagtctgtgatgcaggacctcggcagctcacgggccatgttagaaatccagtatgaaaatgaggtgagcttggagtctggtgatggttatttagcttgacttgtgctcttaattaaatgttatttgagtttcttggtactatgaaattctgaaagacagttgggagactttgctctcttttctcttgaatgatttgttctaagttctccatttttcaaaggttcaactaaataataaaaggcagtttttttcctggcgtaagaacacatttgtgttgttagtctttaagttgataaattgaaaggatattttaaacagctgataactttcaaaatgtttgaattgccttttttaaaaaatcaggtttactgagatataaataataactgcatacttcaaaaatgtagttttgtagttttaagggttgacagatgcaatttgttaccactttcacgtcaagataaagaatactctgatcaccacaaaaagtgcccccatttcactttgcaaaatcagtcattctatcccctaccccatcctcagcccttgataaacattgatgtgttttctgtccctgtaattttgtcttttttacaatatcataaatggagtcatgcagtatgtagcctttgtcattcttctttcacttagcataatgcttttgagattcatccatgttgc

SEQ ID NO: 26992 - DNA, 1035 bp, Homo sapiens
agaccaagaaagaatcttgtcttctctcactgaaacttttttcattctaaattaggagttcaaactatctcctgcctttaaaaattgatcccttatgtaatagttggaattaatcagatccatttcattcccttaacaagtcactccaattagaagagcctgaaacaaaatcctttatatgttttgagtctcttataccagttagctccagtattgctaacttaatctgtgtttctaatcttggctccacatttgtggctctgaaccacggggccctgagccatttccagtggagaccgattctacagttctcaccagcactgtttttacttaggtcttttctgttcatttacctgtttttttccgctagggatttaagtttcttttcctaaagcctttatctccaaaagtttcataagagacattagtaataaaataaaggagttagatggatggcagggagtgaagtgtatactgaaaagcaaaacaaaacataaagcaaacattgtagttaaaaaaatcttcttgggcccggtgtgtggtggctcctgcctgtaatcccagcactttgggaggccgaggcgggcggatcatgaggtcaggagatcgagaccatcctggccaacatggtgaaaccccatctctactaaaaatacaaaaaaaaaaaaaaaaaaaaaaaaaattatctgggcgtggtggcgcatgcctgtaatcccagctacttgggaggctgaggcaagagaatcacttaaaccagggagttggaggttgcggtgagctgagattgcgccactgcattccagcctggcaacagagcgagacgccacctaaaaaaaaaaaaaaaaaaaaagtcatcctattcgtatctttattaggattccataagcactgatattggcataaattagaaatctagcaggaccttttaaaatctcatttgcaggtgtttgtagtagtgcttgtaggatcttggcagatcagagccagtaggtttccagctcacctgtttgacctgtcacctccatatctatttct

SEQ ID NO: 26993 - DNA, 1027 bp, Homo sapiens
aatattttgaccggaggcctagaaaataggaaatttgtttggtttttatttatttatttatttatttatttattttgggacagagtcttactttgttgcccaagccaaattacactagtgtgaacatggctcactgcagccttgacctcctggctgaagagatctttctgcctcagcctgccacgtagctggggccacaggcatgtgccaccatgttccattaatttttttattttttgtagagacggggtctcactttgttgcccaggctggtctcaaactcttgggcccaagtgatcctcctgccttggcctcccaaagtgctgggatttctgagccaccacactcagcctagtttggtttttaaatccacattttgacgttttaaaaacatttaaaaaactttgtttgaattaaaaaccatatgcatttttgagtgataaagcaatcacatcatggactagggtttcttttctgctttgaaatttaatgtagtgtgtggtattcagttttgatcgttatgatttcctggaggagttcatgaaataagggggcattttgacctgtgcttgagaaaatcatgaagctttttgtgtccaaatttatataaaatatgtttgcatatgtatatattcataaaatggaatattctccacatccctatttgtgtgctttatgtgcaggagggtccaatcttttggcttccctgggctatattggaagatgaattgtcttgggccacataaaatacaccaacactaatgttagttgatgagcttaaaaaaaaaaaacactcattgtattttaagaaagtttacgaatttatgttggcctatatacaaagccatctgggctgcatgtggcctgtgggccgcaggttggacaagcttgctttgtggaatcatacagataatcacagtttaagtttgtatctgactcctgccagagcttttctgaaatgagcaattaaacatcatgaccaggtttcaactgcagtagctattaaaccgcttcgttcaaaactatt

SEQ ID NO: 26994 - DNA, 1027 bp, Homo sapiens
gtatttttagtagagatggggtttcaccatgttagccaggatggtcttgatctcctgacctcgtgatctgcccgcctcggcctcccaaagtgctgggattacaggcgtgagccaccgcgcccggcctgacagtattttattactccctgtttctgccattttagtttgctttttcagtgagtgaagatataaaacagtggtaattgctaaacttatctcatattttcccatggacagtcgattaagtgatgttctaaagagaaaacgactgccaaaacgagggccaagaaggccaaagtactcacctccaagagatgatgacaaagtagacaatcaaggtaacccctttgatgaaactatggggaggtaaaggggagggtggtagcaggtgcagaaatgtactttattaaaactgccagtagctcttgaagtatgcctaagtttcctgaggactaagtgttcttagttctttcagttaattaatctgttaagactgtgaatcttaaaaatcagttgtttttcatcacttaaactaaaatgacttaactgtagttcttttttcttttcatagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataataggtgaagtggggggagttttatgtttcttctattcccatatcagaaaaacttaaacattatttcagccagtacgtttattgtgtggagacgatacatagacacagcactttaatttgttcttaaaagcatagttcaagaattaggtagtttctcagtttatgaaccctgcatctggctttgtcctaagttccagtcatgtgctttgaaactccttccagcatacctagctgaaagtcttatacgttcaaaaccacattgtattccttggggaacctcttcct

SEQ ID NO: 26995 - DNA, 1048 bp, Homo sapiens
aacacggtgaaaccctatctctactaaaaatacaaaaaactagccgagcgtggtggtgggcgcctgtagtcccagctactcaggaggctgaggcagaggaatggcgtgaacccgggaagcggagcttgcagtgagctgagatcctgccaccacactccagcctgggtgacagagtgagactctgtctgaataaataaataaattaattaaataaaataaagggccagatagtaaataatataagtgttgcaggttatatatagtctatactcaccaccattgccattgtagccctcaattagccatatacaatatgtgaacaaatgtacatggctgcgttctaataaaattatatttacaaaaaccggtggtggactggattcggcttacagaccgtactttgtcaaccccttgtatataacttactgcttatcagttatcttttccttacactttatgtcactaagcaaagtggtagaattaccttctttatccattttacaaagcttttagtgaaatatggtgcatttctagaactcagtttcttaccactggtttggttggttaggattggatttccctattgtttcattgaatgtatatcagtaaaataaagaggtacagtgcggtgatgaattgttactttcagctggccccaatgggtcactagttttctagacagctgaattttgtctgtcttaatgttgcctttagcatctttgtaaatcctagttgatcatatcatagaagttcatgtgttctataatgaaaaagttttcatagcatttcaagaattacactggcttgagtattttatattgtttattgtgtttctgaagtctgtcacttcaggattgcacatatatttttttttaatgtaataggtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattctt

SEQ ID NO: 26996 - DNA, 1052 bp, Homo sapiens
aatcccaggcattatatacagtcatgtgctgcatgatgatgtttcattcaacaacagttcacacacactacattagtcccacaagattataatggagctgaaaaatgctcatcatctagctaatatacagtacagatttttaaaccatacttttatcatttagagccaggggagtccagtctttttgcttccctgggccacattggaagaagaagaattgtcttgggccacacataaaatacggtaaccctaactataataacactaatgatagctgttgagcttaaaaaaaaatcttacaatattttaagaaactttacgaatttttgttgggctgcattcaaagccatcctgggccatgcattgaacaagcttgatttagaatgtattccttctatatactaaagaagaacattaactgtaaccctcagtagtaggtattccagaagaaggcattgttgtcataggagatgacagcttcatgcctgtcatcacccctgaagaccttccagtgggacataagatgtggaggtagaacgtaatgataccgatgatcttcatcccgtgcaggcctaggttaatgttcgtgtttgtgtctgagtgttttaaaagacagtttaataaccaaaaaaataataataataataattttcaaaataggaaaaagcttatactctatggatataaagaaagaaaatgtttttgtacagctgttcattgtgtttgtgttttaagctagttaatactacaaaatagttaacaaaagtttatgaagtaaaaaagttacaggaaactaaagttaatttcttttttctttttcttttttttttttgagacggagttttgctctgtctcccaggctggagtgcagtggcgcagtctcagctcactgcaacctactcctcccaggttcaagcgattctcctgcttcagcctccccagtagctgggactacaggcacgtgccaccacgtctggctaattttttgtatttttagtagagacagggtttcactgtgttagctaggatgttctcgatctcctgaccttgtg

SEQ ID NO: 26997 - DNA, 1046 bp, Homo sapiens
aagtgctgggattacaggcgtgagcctctgcacctggtctgctatgcattcgtagatttggacataatcagaactgtacagacctttatagtgttgataaagtcttgcaaatgctagtggtactaaagtaaggaatgaactatttttctttatgcttgtaaaataatgtcagcttcattttgcattgggtagctttatagtttcggaagaaatgatcagggttagatcacataaagaaagtggtccaattttgttaactttgcatcaattggttaaagtataaaaatttgtcactccatgtagaatgtttgcattctgatttagacaacatctctccagtattttcacttgtgtgtattggaaactgtcttacacagtactgtgaagataggctaagactaaacgggaaatatctgttgaaaatctggcattggattttatctactgatagtcacatttttatatttgactctgggaacaaatctggcctatgcctaaggaggtttgaagccttgacgaaagaactgtagctgactgctgttgattaattacattttcgtatctgcatgaccttacagaacagctatctctatactactacttaaattagccagaggcttggctggtttaagtcttctaattttgtaaaacatacaaaactagtagtttttttgttttttttttgttttgttttggtaaaaccaaactaattttgtaaaacatatacaaaaatagtttttatatatgttttacaaaattagataactcataactcatatctaaactcccactttagataacctaaactacttcataaaagggaacaaaagcttaatacttgctatcagaggtatggcaaaagaatccttttcttcacaattagtttccaatttctgtcaaaaccagcaccctaccctctactgataatcagacttctggcagtagctcacacctgtaactccaacattcagaggccgaggcaggtggatcacttgagttcaggagtctgagatcagcctgggcaacatggtgaaaccctgtctcta

SEQ ID NO: 26998 - DNA, 1046 bp, Homo sapiens
gtacactacattgcagtccagccatagtattaagcactttacatatattcttatttaatattccaaacaacctgctgaggtatgagtgttattattaccattttttaagtgaggaaaaacggagacaaacattgcttatgcttgctcagggttacaagctgtgatgtgtgacttcccaaagccaggcatatttgtaacagcattgttgtctaatgcagttacaagagtttatataatttatacgaatatataattgaaggctggaatgggaacggggttcaaaattttgttcccctatttatttacctaagaggataaaagcatacaggaatcaggctcatccgactgcctttctaaacagttccaggcattacactgtcatttatgtttcaaattacagtgtggtacaggtgtttcccaagctgtgtattgtagctggtgataaaaaatacatgtggcatgtgcacttgtattagaaaactgacttcattacattttggaggatagatctcttatgaattataggaatttctctgctgactcatgaaagtatttatggggaaataagctaattatttagcagctttacgttaagttcttcatgataatgtgctttagtttctgcatgtgtaaaatgggaatgtagaagaaaatacctaaattagtatggtgtataggtttgtggacttagagctctttttgacaagtaaacgttttcggatagtacttgtatagtcgatataagactccattggaaacatttatttggaaataatgttgttattattttaaaaagcccaaccacattagctcttcatgtaagaaatgctagcctttgaagttgaaagtgtagtgtttgccacgctttcccacgagtcagaggcagactcctgtgcattctttttttttttcttctttgaggaaaagtttctctctgttgcccaggttggagtgctgtgttgcaatctcagctcactgcagcctctgcctcctgggttcaagtgattctcttgcctcagcctcctaagtagttgggactacaagtg

SEQ ID NO: 26999 - DNA, 1031 bp, Homo sapiens
taagtcatgccacttttttcttttttttttttttgagatggagtctcactctgtcgcccaggctggagtgcaatggcacaatctcggctcactgcaaactctgcctcccgggttcacgccattctcctgcctcggcctcccgagtagctgggactataggcgcccgccaccatgcccagctaattttttttgtatttttagtagagatgggttttcaccatgttaaccgggatggtctcggtctcctgacctcgtgatccacctgcctcggcctcccaaagtgctgggattacaagcgtgagccaccgtgcccggccagtcatgccacttttaatgaggaggacacgttctgagatatgtgtcattaggtgattttgccatgcaaacatcatggagaacacttaaaacaaacctagatagtatagcttactacacatctaggccgtgtggtagcctgttgctcctagccacaaacctgtaaaacacgttaccttacagaatactgtagacagttgtaacaccatggcaagcatttatgcatctaaacatatctaaacatagaaaaggtacagtaaaaatagggtattaataatcttgcaggaccacggtcatatacgtggttcgtccttgacagaaacaacattatgcagcacatgactgtagcttgttccctctagtaaatgcatcaacactagtaatgcaggggggaatgattttagcttacgttttcccactcaggttagcagaaaggtctttccacttcttttggttcttatctctactcttggcggtgttacaatagcgacataagtaaacagtacaacttggtgcctataagtcataagaaatatagctttgccaccttaaatcttttcaacctgtttttaaattttttagattgtttaaaatatctggatttagtacacctgtttgcttttgaggttgcatagcaacttttctgaggatttctgaagaaacttcttagttttccagagtttttgtcctattttgggccaaattttgaatcttaa

SEQ ID NO: 27000 - DNA, 1048 bp, Homo sapiens
tctgaaaatgtttgctcttttacattcaggttattctttggagcagccacactcaacttcatgtgactgattttaaaatattattcctcctgtaataaaagtgttacatgttcattttagattattttgaatatatagaaaactaaaaagaaaaacataattccacacttataacgtgtgctgttgacattggttactattgacatttcttctgtcttttaaaaaactgcgtgtagatgtacattatgtatgtgcatgtaagtaacttgtacctttagaacaactgcggttttatgcatattaatcctcaggttgcattgggactcttgcatgtgaactgacaatcattgtgggctatcaacagcgcattgcttctaaaatccacagtgtttcagcatggtcattttttctatatatcagtgttatgtagattaaaaaattttttttaatttattttttgagacggagtcttactctgtcactcaggccggagtgcagtgctgtgatctctgctcactgcagcctctgccctctgggttcaagtgattctcctgcctcagcctcccaagtagtagctgggattacaggcgcctgccaccttgcccggctaatttttgtgtttttagtagagacgaggtttcaccatcttggccaggctggtcttgaactcctgatccaaccgccttggcctcccaaagtgctgggattacaggcatgagccacagcgcccagcctaaaaaattttgtaaattgtattatgtttttattttatttttagagacagagtctaactctatttttctggctgtagtgcagtgatggaatcatagctcactgcatcgcaagtagttgagaagacaggcgcctgccagtatgcccagctgtgtatttaacttgatgcaaaagtaattgtgatttttgcagttttttttaatagcaaaaatcacaattacttttgcaccaacctagtatcatgtattttaaaaaaatgagtaaggccgagcatggtggctcatgactataatctcagtacttgaggtggctgagg

SEQ ID NO: 27001 - DNA, 1054 bp, Homo sapiens
catttttggcatgtggactaaaagttgctgtctgtgtgcttttgagacctgaagaatatcctctgttacatgaatgcagttagtattctaatggattatacaagccatctgagctaagacaggatttatattagggaatgagtggctctgtattttagaaatagcttagcaatagctattcaggataattgatcatcttacagtgttctacaaaatagatttttggtctattttggacctccttgtgaagggttacctcctttcttctttgcttttctcacacctgttaatcacagattcaacaagttaggcacgtacttccttacttggagttgtcatcttctcatgcctcagagattgatatgctcttctgatccaaagcttatgctcttaatttttttccccctgcgggatcctgttagtagactgtcctttattcccaaccttttctttcagtaattcttttctttacctaaatacatatgctcaaaatttatttttttaaaaacgacaaacagggaaattacatatatccatgcaaacacagcctttgtctctctgccttcccttctctcctggctattgtctcttctctttataaagtctagcacttccagaagagagttggtatttattatcttaccttataccctctccttccccaccatttctagaaatagctctcaacattttcttttgttttttttttggaggcaaagtctcgctctgtcccccaggctggagagcagtggcgcaatcttggctcgctgcaacctccgcatcctgggctcaagcagtccttccacctcagcctcctgagcagctgggactacaggcgcgctaccacgccctcgctaatttttgtattttgtgtagagatggggttttgccatgttgcccaggctgctctcgccattttctaaatctgatggacatttttgagttttttgaactctgcctatctgtcttcctcttggtgtctgccaacaccactatcctgatttattttcccagtgcttgtggtaagttcttgattttccttgactggattctt

SEQ ID NO: 27002 - DNA, 1068 bp, Homo sapiens
gtggccatcattagtgaacattggtttattatacttagccttaaggccctcattggctattggatactcctaaatggcctgctttttatagaacttaattgctttgtgcagtgcatgtgttctctccttgctctgattggtgggcgtcttggtgtttaggcactgtgagctacaccctcctcccccagcttttaatatgcattgagttgcaaaactactttctagacttgtgtaccttaagttcagggtaaaggcttgcattatgtggctttaagacagtgataattttggtagctcaaaggtatttttaaaagtatattcgttattctcagcactttgttacctgaagggatcaataatgcttttgttatttttgaagatggtttaaaccttttgtgtctgaaaactgttttaagagactgcagagaagacagtataataactgagggccttattctacaagtgagggtctgtggtgtgctgggtattcattattgtgtataacgttttgcccttgactctttcaaaatatatcttctctcttcctaaatgactttgtctttttgcctgctataacttagtaatgactcctattatctgcacttgcccacttgaagagtctttttaaatacactttttttttttttttttgagacggagttttgctcttgttgcccaggctggagtgcaatggcgcgatctcggctcaccgcaacgtctgcctcccaggttcaggcgattctcctgcctcaccctccctagcagctgggattataggcatgtgccaccacgctcagctaattttgtatttttagtagagacggggtttctccatgttggtcaggcaggtctcgaactccccacctcaggtgatccgcctgcctcagcttcctgaagtgctgggattacaggcatcagccagcgcacccggcctaaacacactttttattttaggtcagtttcagattcacagaaaagcttcagagatagagttctcctatactccacatccagtttctgtttgtgaaaattttaacattagtatggtacatttgacacaactaatga

SEQ ID NO: 27003 - DNA, 1046 bp, Homo sapiens
cttttaaaaagtacaaattaatattacatagtttaatcaaattaaatattctaataaaatattcgctttgcactctgcatagtagagttgttacccctttaattgtttttaaaattttattttgacacataatatgtatgtatttatggggcacttagtaatgtgtcaatacatacaatgtatagtagtcagaccagggtaattagcataccatcatcacagacacttattatttctttgtgttgggacattcaatatcttccctctagctatttgaaactgtatattaaactatagtcaccctgcagtggaatagaacaggagaacatactcttcctatctagcacagttttatatcctttaacagataccattacttttatacaagtatgtatacaggattttaaaaatgagaagttaggttgtatggtggctgaagagaaactaaaaacaatttttttcagtgttctgatagctatgatatttagctttctttagcagcttttatttctggtgtgttcttacagactttcctaattgcagtttggattaatttgattcttatgtagaaagcagagatgctagctatgcagatttatgactcagaattgtacctgtttgtagagtaaggaaggctgtattgtccaacattttgtggactttagaataaaaatattcgtgaagtctatctgttttactgctgtagcacaagagtgcctgtttttctgtaaaacagccacccagcttcatatattttttcctttatatgaagcatgtattttcatttcttcccacctagggaaagcagcttagtctcaagggaatttgaccctgctctctacccttccaccccaggtccaaatgcatttgtgcccttcccccagtagatggcaacaagtaggctgatgtttaagaagattcagtagtcttaactttgtgatcagacctatttactaattatttctcaactgtcattagtaatgttagtgttgattttcacattctggcctcaaaatcctttcagaaaactagactgttaattgcag

SEQ ID NO: 27004 - DNA, 1021 bp, Homo sapiens
tacgtggtgaggagataacggaaggggcagcttccaaacccttaagacaaatgttgtgtttttttgataatgctgttttactttgggggaggtttagcctaagcatcgagtctggtggtgggcatagtttaattgcttctttagttaattgggggagggaatgtgtttgtgtgtaaaggttgggccggtgcggggggaggcgggtacggttaatagcgcagtgaatccgttctaagtggacgtctaactgctctcctgctgtctcctttcctagtcgcggtcctcgatcttgcctgggctgccagatcacccgatctccgggctttactccgttttgtaggccctttagtgatgtgtttaactttatgttcctctcgagagtctcattaggtatttttggcatttcattttttaaagacctagcaagttgagtctcagagtctcctctttaaaaacaaaacaaaaaatacggggtagaaagttgaaagagctattgagtggggtaaaacgacgctcagaacaaaggtcctagttgtgttagaaaaaaaggcaagaggcctgtatatgaggcctgtgtgtgtcgcatttacaccccgggggggttgaggaatggaattagcagaggtttagagacaataaattgtagaggattttattgaggctgattttcatatttaccacatgcaaagtgatcaatattaagtgtaagttttaaagtatacagaatttctaattctttcttttgacacttcctgctgtgtgttcagccccagaaatgttgaactgctgtgactatctttgtgagattgagggagttttattttaagcttaagagtacataatatgattggggtttgtgggctttgtacatgtctgcctttctatgaatgtgccaatatccataagaattggaaaactgtaattaagattatcattgtttccattcaatccccagtttttctggagtgtgagcagtttttaagtctgttcagctgacatttatactacttagtttgagtct

SEQ ID NO: 27005 - DNA, 1033 bp, Homo sapiens
aaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcaggtaaactctctgaggttttaagagctcagagtgcatgtacatatggtgcgttatgttataaagtcccagataaagaagaaggtttccatttgtgtacattttccttttatcttcccattcctgccctttactttctcatttatacattttagcaagttaaagcctattctttctttttttttttcaagacggagtctcgctctatcgccccagctggagtgcagtggtgcgctct

SEQ ID NO: 27006 - DNA, 1043 bp, Homo sapiens
gatcctacaacactggaggccagaccattgtctgtatcttacagaggaagaatatgcaacactcagagacattaagtaacttactgaaggttgaacagccagtaagtgtagaactggctttaaacctggtccatgggactccaaaattgtgtctactatgacactgcctgccattacatcaaatgagaactgaaaacatacttgaaatgaataatacaaatggtttttacgttctaatcattgtaagcacatttgggctacctgttaaatttagaaaggtccgtggttttttctttttttcttcttcttttttttttttttctgagatggagtctcgctctgtcgcccaggctggagtgcagtggcacgatctcggctcactgcaacctctgcctcctgggttccagcgattctcctgcctcagccccatgagtagcatgaattcatcaccatcctgcagaaggtcccaacttttaataaaacgtaatcacctcatttgtattgtaaaccacaaaatatctgagactggtctcaatcaatccggaagttaatttagccaagggtagggaggtgcccagaagaaataaacacagaatcacagaaacagtctgttacctgtgcctttctccaaagatgattttgaggacttcaacatttaaaggggaaaagggggctggaggagaaagggagggtacagtcatccacgtgttgcaagagaaaaggtgcagataggggaatcatcaattttgtattcatctcacactcagtaaatcagcacttttacataaaataaggtgaacatagagtagctacctgtggagctatataaccctttctctgtgactaactgcttaggaataaaaggaaaggcagttgcttgcatgactcagctttcagcttaatttttttcttttggcagagtgaattggggtgccaagtctgtattttcttttcacagtatctacagcagcctttgtgaggctagctctgaatcattcttgggggatgccctattgttgggggaatccacaggctacacaaga

SEQ ID NO: 27007 - DNA, 1013 bp, Homo sapiens
tgtgatggctgtaagatgaaacaggtttcatagaagcacttgctcctgggaaacagtaaggagtgttttcaaatctgtatggtgacaaagattaacctgaagatcagatgtgatactggagccactttgaccctgatggggaggtagagctgcacaaagaagatgaagatatttttccttttgatgttccatgaaattatttgttatatgtatttcagaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggtatgttcatgtgtgacctgtcgtaaaactgaatcgttatcaaatgacaattccccactgtaagtgatgttttatattgttgtaacattcgatattggatgttactagctactatttttcaattgtgataaaatatgcataacataaaatttaccattttaggccaggcacggtgactcacacctgtaatcccagcactttgggaggccaagttgggtggatcagttgaggtcggatgttcgagatcagcctggccaacatggcaaaaccctgtctctactaaaaatataaaaattagccaggtatggtggcatgtgcctgtaatcccagctactcgggaggctgaagcaggagaattgcttgaacctgggaggtggaggttgcagtgagctgagattgtgccattgcataccagcctgagagacaaagtgagactccctttcaaaaaaaaaaaataattttaccattttaagcattttgagtcccattaagtacgctcatattttttcacaaccatcacca

SEQ ID NO: 27008 - DNA, 1091 bp, Homo sapiens
tcactagaagggaggaaaatacccgtgtgtgtaattgatcaggaaatggaccctgctagctagactgcagaagaaacgcttcttaggaaggaatttccaaactcttccacatcatggtatttctggcaatcagaccctccactcccacctggaagtcacccatgggccctgctgtactgacagccatgtccttgctgcatgtaggcactacacgaatgcacattctgtcccacccctcaccactcagtcaggctttagggctggcttcagtccaagagaagaggcccgcagactcccctgctactccttccacctcacagaggaagtctctcttgacctggaaaggtagaaggccacaattaggatgaagaggttcagggtgaattcacagaggatgggggtagatccaagaatgggctttttcttacaggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaaggtattataatgacgggacagataggtgacaggtttaaatccttgaaggagaagtggagctttaagagcagaaatgtgaagagctcccgttaggattcaacagcatgatttataaggagttaaatgttcatagaaaaaaaactgtgggtgacaaagttaggagcacatattgttcctgatggtggagaactttaaatgcaagtaaaggagtacaggaactttaaatgccggcaaagggctttgaggtgaagagagatgtaagaacctaaaaagaaactagctgaagacagatgcctgcaaccactcccctgcatcctctacctgacatctactcaaggcccagctcatctggcccccctgcagcatttccaggctgcccagtccgtggtctgtctctccgctgcatgtccacagcacactattcctgtcctgagaacaactagtgtctatgatgacaggacccaacacaaggcctctctcagcaacactcaagaaattatcactaggatgaaatcctaa

SEQ ID NO: 27009 - DNA, 3636 bp, Homo sapiens
gtatgttctgtctattgaaatgtaagggttttattaacattaatgcactttcctgctttataaaagaaatattggtttgatttccttaggcgtgtaatcttggacagtttaacctgtaagtttgtgcctcagtaacccatctgtaccatggggataatgtactcatagggtgattttaaaagacaagctaatacttacaaagaagcaagaaatgtgcctatcttacaataaatactttgtaagtagtagcagttctttcagtgaggtgaggttactatgaaaaaattccaagtatttgtaaaactagtgggaagtaagagggaagctcgagttttgattgaaaagtggcataaaactaagggcatttattgtactcagatctgaagcaagttctgtgttgctgaggtaaaagcatttgtgttaatatggttttaaaaaccatgagttcttctccctccattgcaggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtaagaaattaggcttgttacaaggtttcagaattggtggagggaactcctttgtgtctttgtatttcataagtttataaatactttttaatcaaagttactcaaatgtaggtgaagatcaaggacatgataccccaagtcatactcttatttggaatagtaatttccaatcttgaatgagagctctaaaatcattttgcattggaatacagtaggcaaatcaagcttcctttgtaggcatgttttatactttaaatgacttgaccatgtgcgttttgaactcagatgattctaggaaaacagaccagtcatcagcctatgtaagaacaaccagcaggacattgcaacacgtactaggtacttaatatgttgagtaacagaaatggatttagcttacgtcatgagtatttgtatattaactcaagcactgaaattcttaggaataagatattactgttgtgaccgaagctgggaaccactgtttcagagtcttaggaatgtggcatctctatttgcaggtgaatcaaaaactctggttttaagcaacctctcctacagtgcaacagaagaaactcttcaggaagtatttgagaaagcaacttttatcaaagtaccccagaaccaaaatggcaaatctaaagggtaagataatacctttgtatcatcagttataggctatatatgtcttagaggtctaaaggaacgtaaggtcatgtgatcctgtcagaaaagccaaataattttagctacgtaaatgagtgtaaaataaagatcatcatttaggtaccaacttgagagaaggggcttggcagcatcatgtgacagtgaaggagcatgtgcctggtaacttactctaagcattaactgttcatcctcaggtatgcatttatagagtttgcttcattcgaagacgctaaagaagctttaaattcctgtaataaaagggaaattgagggcagagcaatcaggctggagttgcaaggacccaggggatcacctaatgccagaagccgtaagttcacctggttagggtgctgtggttgggggtagcactctcggtgctttgtttattttttgcacaaattctgtgtttcctgttgctactgagtgaacaataactggatatgatgactgattacctgagaaataattgatgaaatctcaagaaaattcctctagatagtcaagttctgatccagctgtgtcaactcagagtagcaagtttgcccatgatttcctgccccatccactgggccccacctgcttgggttgcttctcccactttccatagaagatctggggcaggatatcaactatgcaatggcaattaaaaaatgtaaacccagaatagcctttactttaattaaggactagttggcttagttgcttttaactgctttttcactataacaagtattcttggctagtagtcatactaggcattgtgcaaattcagtgttacgaactgtgacttcacataaagtcacatttttttttccttcccagagccatccaaaactctgtttgtcaaaggcctgtctgaggataccactgaagagacattaaaggagtcatttgacggctccgttcgggcaaggatagttactgaccgggaaactgggtcctccaaagggtaagggaaggaagcgtgagtgctgcttccacttgaaggggtttttgttctgtgcagaccttgagtctaatgtgtcttctcattgagctcctttctgtctatcagtggcagtttatggattcgcacgagaagaagagagaattcacagaactagcattattttaccttctgtctttacagaggtatatttagctgtattgtgagacattctggggttcaagctgtcacaccagttagttttccatagagagctactctgtcactggtatcttttcccaaataaacaaggctactttctgtgggatggctccccagcatgtacagttaacttgggacatgtgtagtaggtgctttttataatgggcaatttcatttggtgttctaggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggaggtaaggcacgcagagataatgacaccacatagcatgtgctcttcagaccctgtgccctgtcacggttcctaatcactggggaggaggagctttgtacccattcttttaacagtgtcttgccttcctcctgtagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagacgtgttacttcctaaagagtgtttcccctggaatgtcactggagagcatggcaaagccagctctgccacttgcttcacccatcccaatggaaatggcttagtgcgtgtttccagtatc

SEQ ID NO: 27010 - DNA, 1324 bp, Homo sapiens
ttctcctgcctaagcctcccaagtagctgggattacgggtgcacttcaccatgcctggctaatttttgtatttttagttgagatggcatttcaccatgttggtcaggctggttttgaactcctgacctcaagtgatccacccacctcggcctctcgaagtgctgggattacaggcgtgagccaccctgccagtaagttttaataatttggtgttaggtgggagaatcgcttgaacctgggaggcagaggttgcagtgagccaagttcgcgccactgtactccagcctgggcaacagattgagacaccgtctcaatttaaaataatgtttattttcttggaagtacctgaaactattagacctgtctagtcatcatagtgaatacttttatccagacaggattctcctgtattagtgcttataggtgttcttttgtcagctgctactgtgaattcttataagcaatttagctccatgatgaagacctcaaacgtgaatgtgcatgtcatatcttcatgctgagaccttgttctgtagctgcagtttgcagagccttgactttgttttgctaatactaggggtgctttttaaaatgtgatctttgtttgcaccatcacatttgtctagaatacatattgtggattttgatttgtgttttcacctgttgtaattttgccctcctctccaccttgaaggaaatttggttatgtggattttgaatctgctgaagacctggagaaagcgttggaactcactggtttgaaagtctttggcaatgaaattaaactagagaaaccaaaaggaaaagacagtaagaaaggtatgtaaggctttatgagattatgcaatgaactcaggagctagactgctagggaaaatgctttgtaacccatttcccttggtttcctcttatttttttaaatcatttttttcctttggtttcctcttaatgtgggaattaaatgagctacagtgtttacaagagtacttggcactgcttgtcagtgttatagtgtaaattcctgagttaggcaagcaagagcacttttatacagaacaagaattattagatgcacctaaattaacgtaaagggatctttcttcactgaaactagattaggtccctaattactccctatatacagttgtaatgttttgaattggtacattcactttttttgttatgcgcgtctactctaggttgaactccagtgtacctaacagagagtttgacatcagctgtgacaacatggagggaccacttgtgtgttgacactgctatatctccatatttagcaccgagccttgtacattataggatctca

SEQ ID NO: 27011 - DNA, 2281 bp, Homo sapiens
taacatgctaatgtgtctagtgcatgtggtcttgaaccagaggcattgccagagtctaacatctcattgggaccatggttatctttttgggtgtggggctggacttactggtttggttttcatttattctcaaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatggtaaggagttgtcttggtagttactgggcttctgattacaaggtatcttgagattctgggatcaacatattccttccacgacaacctggagatgagattagaatccttgtgggaattctctgggttgttgtggtgtgctagacttaattacccatgaatgatttttgtgcctcttgagaaaatttcaatagcacattctattagtgttttttataatgtaggattttgtttctaagtgattttttttttttttaaatttttttgagatggagcttttgctgtttcccaggctggagtgcaatggcgcgctatctcggctcactgcagcctccatctcctgggttcaagcagttctgcctcagcctcccgagtagctgggattacaggtgcccaccaccacaccctactaatttttgtatttttagtagagacgacatttcaccatgttggccaggctggtctcgaacttttgacctcaggtgatccacccaccttggtctcccaaagtgctaggattacaggcgtgagccactgcgcccggccccaagtgatctattcttgccatgactgttaactaaacatggtgacaggattgcattttctttacattagatttgaaaaccgatgttggttttgggagattgctgcaatttttaggtgacttctctttcagactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaaggtacttaaattagattctgacatacgacatgagttatgtttaaaggaggcacttaagtgtttgtggctactgatgtgtgatacattgtttgacatcttgtccagagcctgtcaaagaagcacctggaaaacgaaagaaggaaatggccaaacagaaagcagctcctgaagccaagaaacagaaagtggaaggtaacttgcagaattaggggatatgggggagataaacagcacaaatgatgaataacaaagggacttaatactgaaacctgatgttacattgtagtgtgctgatgtgctgtgtatagaaattttgctttggaaactaactttttaccacactacaagtagactgagttgagctttttttgtgcaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggtaagtgcttcactgcacgttacatacacgtgggtctgttaatgcttttccttcccctgttagcacagttactttagcctgctactgttaaacatgaatactgtaaacatcttcaaggattagcattagtgaactaagttagaattaaactgtagatcccctaagttgcaatttccataatcagtcgtaacttggtatagcacagaataatttttagtaagtttttttgttgtttttgttatgtattgagacggacgctggcttttgctcaggctggagta

SEQ ID NO: 27012 - DNA, 1023 bp, Homo sapiens
accccatcgctactaaaaatacaaaattagccgggcatggtggcgcatgcctgtaatcccaaatactcaggaggctgaggcaggagaatcacttgaacccgggaggcggaggttgtggtgagccgagatcgtgccattcactccagtcggggcaacaagagcgaaactctgtctccaaaaaaaaaaaaaaaagaaaagcaattaagtccttaacctggttatttacagagaaaagacattcatgttgtggaaatcaaccatgtatttttagctacttctctcccttgaaataaggggagcttaaatttactattcactaaatgccagatagaagactaatttaaaacatctttcttttttatcatttaatacatagattgaagagtaagtcctggccccaggctttgcttttctgacctctgccagtcacagtagtgctttttctggaagttcagtctgctccaactgcagctttgtgcagggaccctccgggacttttctagttttgctagaatgcctcatctgcctgtgagcctggaactgtagaagtcattttagttttgtttagtcttattgtttaatttaagaaagtctgatgtccatgttgccgtagtgggtacataggacactatcggctgtgaaagaatgaaaagcttgttcagagaaggtcgaatgaggactatgtcttcagaaaaccttgggcttagctgcctgggacagtttagatctgagctcagaggggattgatagagcagtagtatctgttgttttccttctgccgttgggaagctttctcttaacatatagagaccctgggatgtgtgagcatatttatagtaattataattgtgagacatgacctaaggaagtatgtgaacttgcttttgaatttagttgtttaaaaaaaaaaagtggagtttgaaaatatgaaccagaggaaggcagatcacacgggtggagaggaacggcactgtctggagatgtattgagcatagaaggagagtttgttaggaattgcacacc

SEQ ID NO: 27013 - DNA, 1027 bp, Homo sapiens
tgagttattcatcttatatccctcagtctctccctggtacaaactgggtatgcaggatagctgggggtgtcatataaagttaaaaatcacagatgttagaatcaggcagtcaaaaaccaacttgaccacttaactggctttgtgaccttttagcaatgaaatgaagcaaaaacttaccatcctcaaacctgtacagattcctcatccatgtaagagctataataataatgcctatttcatagggttatgtggattaatttatacatgaataatatctaaattattagcatactatctagtactcagtacatcttagccatcatcattatatagtaaatagatactgaatgtgaagactgtatacatttctgccaaagtttcatatacctaagcgatgtgtaacacaaatcatgtgacaacagaattctttccatatcttggtaaagtcttccccttactttcttctattgatttaaacagaaatttacttggatgtgacccatttgataaggaccagctgataaagtataccagctgattcaaataattgctccagctaatttacatgaaggttttcctattttattgtttttagaaattattttggaggtataaaagtctggtagtgacttatgaatatctttacattaaatgtttaccttattgttctaaaaaatactaaacatttctcatttctatgggaaagccctcaggagaaaaacacttttttccctgttttgggggctatgtctctagcctgcctggaagtttagaaattcccagaaggatattgccaagaagccgcaaagggatgccatgtttgagtttcttgccattcttactgcttataaagagaagcatttgggcagtagttcactgtttgttgttagttcctaaagcactgccacgggagacttatactcctggggtctcttcatgtccccaagagggagttgatggaagatggttattaatctataccaacttcagtttattagcttttctgcttcccaaacatgtttttggc

SEQ ID NO: 27014 - DNA, 1044 bp, Homo sapiens
tgggtcgtaatgccactctgttccccaggcagggcccaccccggcctcccaggtgtcccctgtgctactggatggctccttcccataggctccaggtacccttggcaggaaggaagtggatgaggatggcgacagaggagatgagcacacagggggcgatgatgttgatgacgtagaagaggggcttgcgctggatgagcaggtagaacaccaccttctggtggcctgcttcctgggctggcgccgctgggtccaggagcatcttggctggtcggtgctggatggcccactccccattctctgcgggcaggcaggcaggcaggagtgggcacaagaagcgtgagctaggcagatccctgcagccgagtgacccagctgcaagggcagcatgtgccctaaggagcaccagcaggggaggcacccttgagggacagaagtggggtgggagattggatgctcgagcctcttctaaaattggagacattatcatgaggaaagtcagagctttgttggacgttttaaaaagcatattttatggtttgctgtagttttcattttgagttacatgggagggatttgaccttggtccagccttgaccacagctgggtccagcaggagccctggatgaggctgcctggggagcccttgggtgggggttacctgtgaaggcctcagggtcaatgaaaatccactcgatggtctggccatcttcctgactcagctgcagatcaatctcattggtgctgtaagtctgggacctgggagtcaccgaggaaagaggctaaatgtgagcgggtggacctgccacgactgcatggggatgaccttctggggacaagtgtgggcagcttttcttcaacaaaatgcagccccacgcttctgagttctctataaaaccccactggcgagatatggagagcaggaggacctagggctctttggggtcaggaagatggagttgaaggcccaggaggctgcagggccctcacctggctgatgggcccagggtcactctgcatttgtctctcccactgctgtctggc

SEQ ID NO: 27015 - DNA, 1030 bp, Homo sapiens
cactagggcagcaggccgagcttcagagcagaagccagaggttggcgtgaagggcttgtgctgctagggaccatggaggcagcataccggggcagtgacgtggccttggtaaagctttctatactggacacgagcctgggtccccaaacttcagtgcacatcagaatcaccagggcacttgttataaacacagattcctgcccccagccctcatgctattctggcctagaatgcctgggacaggcctgggaatctgcatgtgcaacaagggcccaagctgaaggctgcaggtgggctacagatcacacagactggaatcagactgccctggcagactcctgctttttcgactttgtagtgcacttccttgggcaggttacttaacctctctgcgcctcaacgtcctcatctgtaattggaggtgatatgggttttatgaagatgaaatacattaacatttgtaatatcccgggcacctaggaagcaatttcattcctgtattactgtaatcgattttggtccatgcgtccagatacgcccaggatgggtgtgctgtggaatgccacaggtgagtactgccggggcgtgcgagagggaggcgtaggggagtgggcagcgggatgttgaagtgggcagggagggtccttgccttgcggacccctcgggccatggagtgtgtgtgtggagaccgcaaggagacattgagcacaaccacagcattcacgacaatgaggatggtcaccaccaggaggaaggtcaggtacctgtcagggtggggtgggcaggagctggcagcccataccatgatgccacccccacgcttagtggctgccccccctcaggcctcctgaattgaggatggggggggtggatggagggcaagagggcaatgcaggaggccatcatgctcccaagaagggagagtggcataggcgggtggacatgaagaccagccttacttgctgatgagtggcaccgcctgggaggtttcaggcaccttcttggccacaaggaagaggaagacagtctg

SEQ ID NO: 27016 - DNA, 1067 bp, Homo sapiens
aggtccttgtgacccgcccgctctcctaagggagcgtgtcctggccccctcccgcagcggctcggaaaaaaggcagcaccgcgtcgttgacggcgcgggctctggactcgctgcttggtaaaaaccttcctcttcctccagtgcgggacgcactctctggtatctcttttgacctcccggaggctttcctttgtcggtcgcggcgccactgtactatggcatacctcgttttattacgcttcgcagatagggcattctgaaaacaaatggagggtttgtggcagccctgagtccagcaattgtatcagcgccatttttccaacagcatgtgctcacttggtgtctctgtgttacattttggtaattctcaaaatatttaaaactttttcatgatttctgtgtctgttatggtgatctatgatcagtgatctttgatgttgctattgtcattgttttggggtgccacatacagcgtcttttataagacgtggaacttaatgttgtgtgtgttctgaccgctccacccacagaccgttccccatctctctccctcttcttgggcctccctattccctgagacacaacaatattgagattaggcgaattaatgactctgcaatggcctctaagtgctcaagtgaaaggaagagtcgcacatctctcactttaaatcaaaaactagaaatgattaaactgagtgaggaaggtatgtcaaaagccgagataggccgaaggctaggcctcctgcggcaaacagttagccaagttgtaaatgcaaaggaaaagttcttgaaggaagttaaaagtgctactccaatgaacacacgaatgataagaaagcgaaacagccttattgctgatatggagaaggttttagtggtctggatagaagatcagaccagccgcaacattcccttaagccaaagcctaatccagaacaaagccctaactctcttcaactctatgaaagctgagagaggtgtggaagctgcagaagaaaagtttgaagctagcagaggttggttcatgaggtttaaggaaagaagccatttccataacataaaagc

SEQ ID NO: 27017 - DNA, 1101 bp, Homo sapiens
ttttattattttgcggtgactttgaaatgtgctgtcactcaaacaaccatgtttttattggcttctgcacttggaggactcctccatgaagcccgcggacaggacagatggctccgtgcaagctgcagcctggggtcctgagcttccctcgcaccgcacagtcctgggagccggtgagtgttgccttcgtcagagaactgaagtcaggagggaccaggtctgacgcacctgttacaacagcttaaagcctagattcctcagtagtgaagtttttattttttctaaggtatatcttaaaaactaaaatcatgttaaagtaccctgttgattccttctgagctctgccttgcccacagttacatccggtgcctgacatatgaatggtactcaggtgttttttgagtaaataaacatgcccctccatgtgaaaagttaatatccagatttagtaagacttaagatttgcccctacagggtggtgttgtgaaccctcacttctatagggcagcttcccacttcgtcctcctaggaggctccttccttttccccaggccagtctcactgcccacccccatcctgtcctcttttctagggaatctgtccctcaccccttccttctgtcttcagtctctgtcccctggatccatccgtcggtatttagatgcgctcagactcacgttagatacatcagacccttcgtggctctcccctgtcctgggccccttccttgccacatccctttgcccagttccctttaccaccagagtgaaataacctgctccgtttggtgccatggattccctaccccaccaaccccgtgtgttcctcctctcccgactcctttcggctccatctctaaagcccaactctgggtgaggtttctcacaaccccattgctaaatcctgttagcattctttgggttttattctttgggttttgcgctctccattgcatttaaaccttccagaagttctggcctgggcctctgtggccccctgctcctcggccccatgctcctccagttttcctccttctgtcttcgtccttccaagcctgcagtctgctcgcctcccgtccctgctggatgccctttctagagg

SEQ ID NO: 27018 - DNA, 1082 bp, Homo sapiens
gaaagaaagaaaagaaagaaaggaagaaagaaagagaaagagaaagagaaaccacctagagaatttaaaagtcaaaatacctggacaagaaaggtaagagagcagctgaatattagaaatgtagaggaaaaaagctctttatttcttcatgtgtgcaaattccaaagcacctcttaccaatacaaatattagtcaaaaaaaaaagataaacatcagaagagaggactatgtagcaaactggagaaaacagtatttcagtgccagacagcagagaaagggagggcaataattttcctttaaagcaattcagagaagttctcttattttctcaacatcccggaagcatgcttgcctgtatgttgtaagcaatggcagatattgacgagccgaattttctcatcctgtccagaaattgtctgaggaagtgctccaaggcatctccccctgtcaaacattctgggacacacaggtattgcaggggcagcatctgcacttttgcttggagggacgctcagacctcatgattcagcagatgcagtgcttaattgggaagccaccgtcttgtcggagagcagtgaaagaagcccatttgccccacctagctagcaactgtgttccatcatggggcaagctcaacagtcatgcccagcctgcagcgagtatgtgatggctgagaagggtgttttcagaacccaccccagcactgctcacaagccctctttgtgcatctccttccccaattccagaggtgcagcctgcacccgaaaagctgttttgctcaatgttatctgtacattcattgtgttttccaacctctcgcctccgtacttttatttccacatctgtaatccacttcatcctctcaatttaatgcaccaattatttttcactttttttgttaatttttagggatggggtctcactctgtcacccaggctgtagtgcagtggtgtgatcatagcttgctgcagcctcaaactcttgggctcaagtgatctttctaccttgtagctggaacaagaggtgcacatcaacacatccagctgatttttaaattttatgtagagacgagatctggctat

SEQ ID NO: 27019 - DNA, 1034 bp, Homo sapiens
gactgaggatcacgtgatacaaaatatggccacccctgcatgaacctggagcaactgccctgggtaggtacccgtacaaggaaaggcaatccttcaagcaataatcttttggcagtctccctcacctctgttcacccctgggtatttttggcattgctgtttttaatgatggggtgtgatgtttcctcagcctgttaaacttcattgtgttattttttaactgcttctgagaaactactaaaatgctgttacctccctttttattggcctaagccacacttttcacatactgggcttttcattcattagaaagtaaccacttattttgagtaaaggcaaaaatggaaatggtttcaaggtatttaagcatttcaagtgaagctcagcacagtgaattatttcaacaacaaaatttccatgcagtctcttagaagaaaaatgtatcttaactaaattttaggacttcacattttgttttgttttgtcttggcttatttgttatttaaatgtgcggatctgtgaaataacatcatttctttttaaaagacagcaggttctaactttagtacttcctgagcaaaaagaactaaggttgcagaaagcttctctttcaggctgtctttctggcattgctgcaggcagtgctgcccttgctgggaggtctccaccatccacattagcctgcatgtctctgtccctttgcttcgtttcccacctctacccacctgcccaccacactctcacacttcccctgcccaaccagaattgccatcaggggctattggtccaatcccaaatgctagtaacagaactgaaaagcccaagtttgaagggaatttcttcttccgtgaagtcccctgggagaaaattttctggaagactcaccatcccagaggctacacagctcaggacaacccctgttcttttaagggaaaagtgaaagcctggacttgtaggttttccccaccagttttcacatggagctgatatcggcatctctgcaaggccaggaggagattgagtgacctctctgg

SEQ ID NO: 27020 - DNA, 1049 bp, Homo sapiens
ctgatgatagtatagtttttgaaactctctgaattcccccataagaatagacagaaaactagatagagaatcagaaagccatggatgacataaacaataaagctaggtcacaaggcattcttaggaacatcaaaatataagcagatgggaataaaccattaacagcctgaagacttgtaagtttgtgtgtttgtgcaagaaataacataagaaagcaacaggactgagaaggggagaaccccaaggtagccaaaaggttttcaccataaagcatagaaagatgatttgagcacagccgctgaagctgagaggggcattgccaactttagtagcaatgattgcagttgtcgctgctaaagtttgaagggaccagagctgtctagaccctgttgaccctcaaaattacttacaagggctttcttccaggacagggccccatgcccagaagaaacatctaggggtggaataaacagtttgaagaaaaggggcagttgagaaacaggaaagagaaggttcagatacggctggaagaaggaaacagccaggaaatttctaaagccaagctgcatgtttttaaaacacaccacaaaaatacacagcagagggagctctgtggagtcagaaaagctggtgagccatgattctttctaaatgatcaaggaaacaacatcacataaaaatgaacaacagaaagagattaatagaaaatcccatacagattctatataaaaaattgaggaaaatagaccaaaaacccacaagaaagatgggcaaacacatgaacagattatcccccaccagtgtacaaatgaatacataagaaaaaatgttcatctttatccataacataaaataaaagactgagatattggttttcacacatcagattggcaaaaattcaaaagcttgaccacaagttgcattactgtggctatggggacaaagctgctccctttcatccttgggggagagcaacatggtactattccatgaaggggaacttgacaccatataaccaccatatgcatgcctttcctgtaagaggttga

SEQ ID NO: 27021 - DNA, 1032 bp, Homo sapiens
agtgtaaaacttaaactctgaaaactactcaacaatgttgaagaaaattaaagacctaggtaaatggaagacatcccttgttcatggattgggagactttatattatgattgcaatactaaaattcacaagctgatcctaaaattcatatacaaacttaaggaatgcagaataccccaaaacagtcttgaaaacaaagaactatgaggattcatactttctgatatcaaaacctactgttaagctacaataataaacattagatagacatttcggtaaatggataataagagtagacataaagatcaattaaatagaattgaggatgcagaaatgagcccttgcattgatagtcaattgattttcaaccagggtatcaagaccattcagtgggggaaagaacagtcttctcaacaaatgatggttgaacaactgtatagctacatgcagaaaaatgaagttggacctctatctcagaccacctacaaaaattaactcaaaatagatctaagacgtaagtgtgagagctaaaactatagaaaaaaataggataaatctttatgtccaggcattgggcactgatttcttagatatgacaccaaaagcacaaggaacaaaagaaaaaaatcgataaattggacattatcataattaaacttttgttcttcgaaagacaccatcaaaaagtgaaaagaaccaagaattgaagaatatttttacaagtcacatgccagataaaagacttgaatttaaaatatattgataattcttaaaactcaaaaataaaaaggcaaataacctgatgttaagatggagtaaggatttgctcagatgtctctccaaagaagacagatgttcaaaacacacgtgaaaagatgttctacgtcattagtcatcaggcaaatgcaaatcaaaatcacagtgtgatagcacttcacacctacttgggtggttataataaaaaggcagcagcaagtgttggtgaggatttggagaaactagagcccttatgccctgctgaaggactatacca

SEQ ID NO: 27022 - DNA, 1177 bp, Homo sapiens
cctgtgtcaagaccttggcactcacactttcatacacgcacacccacacacgcacacacttacacatgtgcacacacacctctacacgcccacatgcatttacacacatgcacaccccccacattcactctcacttgcacccacacacatttacaagtgaacacacacacacgcacacacacacagctttccacctgagtttctcttttagtcaaagatttccggtctttcctgaaaaactcaggcccagtgcaatggcagttcaagcccagtggccggcagagggaagggcagggcggcagctgcagggtgggctcggcttgaacgagaaaagtgatctagttcctcagcagggctcccttccctactctgttcccagaaggggcttctgtgcaaatgtagcctccttcactcgagttttgtcagtcctccttacaggcagaggcagcggtcacccaggtgtcgctgttgtttctcttccacggcatcccacctcccccaccacatttaggacgaagaccgtgtaaacagctgcagacaagtggctgatggggagaccccacacacactagaggctggcgcaggggaagacccaactcagggcttagaccgacgggcgcgcctcccaaagagaaaaggccccagcttcaatggaggctgtggagagatggagaagtggggtgaagattttggagaatctcgggggagagcaaggggagcaaagggagacagcgtcagtctgagccctcgttgcaagttggggtgggggagagaggatcctggcagcagagctgtgccctctgagagtgactacatgggctgtgtgcttgggcaggcacaaaaacatgggcacgaggttactcaaggcttggaggggcagtgggcggccagggtgggtttggagcgtctgtctggggagctggctggggagctcagtggggacaaatgcagggccggccgagggatctccgggccaggacaggaggagtgcactcacgatggtggatggtgcgagagctgggggcatggccggccacacctgctgccagctccatgtctggctggacagtcaggagcctgagctgtgccctctgggatccaccacaggctcctcttcctgggagagtcccggaggccaggggaggggcctgcacaggaaggcccccattcctcggcc

SEQ ID NO: 27023 - DNA, 1090 bp, Homo sapiens
ggtcaagggttcgagaccagcctggccaacatggcaaaactccgtctctactaaaaatacaaaaagtagccgactgtggtggtgcatgcttgtaatcccagctactggggaggctgaggcaagagaatcacttgaacctgggaggtggaggttacacagtgaagctgaaaccatgccactgcactccagcctgggagtcagagtgagactccgtctcaaaaaaaaaaaaaaaaaaaaagattaagagcaaatagagactgaacatgttcataggctaaagggagttagccaacaggacgtgcaaggaagaggagccaaagtcctggaggagacgataggggatgaagttaagagtaaaggtggctagggaagttgataggcatggggagaattcattctctaaatctgtttggaaggctgtaaggataggagcccaaggacaatggacaaagtgacgattcatcccaagcactccttgggccagttaggcagcaataaggtttgtgtttccaggtgaacatagtgagtgtagtggtggagtcagacaagatagtgtccaacatggctggtgataccccgaaagaattgagtacaaacatacagaagcccaggtgctgaggtagcccagctgaaaacagtttagggtacaacacgcagcagcagctaccaccattccaagtatactggtcacacatgcaacagatgacctaccaagatgtctctaatacaaacacaagtgccccatagtggccagacatttgaggaatggcatctccatgaagatagtgagaggtgacagcgtgctggcagccctggcagccctcgctcgctctcggcgcctcctctgcctgggctcccactttggtggcacttgaggagcccttcagcccaccgctgcactgtgggagcccctttctgggctggccaaggctggagccggctccctcagcttgcagcgaggtgtggagggagaggcgcgagcgggaaccagggctgcgcggggcgcttctgggccagctggagttccgggtgggcgtgggcttggcgggccccgcactcggagcggcctgccagccggccccgccggccc

SEQ ID NO: 27024 - DNA, 1048 bp, Homo sapiens
ccccgcgaaccctcgaggggaagtgccggggccgcggcagcagggccagggccccgggggtctcccgcaggccaccctggacagtgatgagcaggtccgctggacctgcgcgtccgttagtcggagcggctccataggggacctggatggcgtgaagttaagagtcacgcatcgaggatggacttgaggggatctggagtagaggatgggagggcattgagaaaatagggccagagatgagggactctaagtgggcgtggaaacgcaggaaagattaattcaagatctgtttaggccgttaaataggaattggggcatgagggacaggaaggaagcaaggattagacaagtgactgggaagatgttagtgcctttatctgggtaagagggaagacgggagggggaaagatgatgggtttagctttggacatgttgagttgtctgtgagacagtcacaagtgtaaacatccaccaatggttggtgtcccgccaaccattaagaaaagtcagttgagaaagtggtagaaatgagcaaaaatcctcacgaagccatcctaccgtcactttttttgttgttttttgtttttttggcataatagtgtctacctttaattgagccttgaactatgccaggcagtgttctaggtatttttcgtgtgttcactaatttaatcttgatgattaacccagtctggtaggtatttatgtatgaggaatccaagatacagaaaggcatcttgcccaagttcacacgagtagtggctggagccaaaattcggtttcaagcatgctttgccaagaggttgaattttaattggcttttcatgggctttctctattttgtgtcctgttggggtccagaataacttggcttttccagcacagcaaatctgcaaatttctggactcattctctctcattcttccctataaacgcagctcatttcttgccaaatgcagccaatagcaaagggcccaccaacatttaagaagcaaatggatgcacaggagcatgagaacagtcaaaagaggaggaaaggaaagggaat

SEQ ID NO: 27025 - DNA, 1072 bp, Homo sapiens
gtatggttctctgccttgcctttacaaacaagggcctgaaggggagagagcttgcagctgcctaaggtgacagtgctgcagcctagaccagaattgttctttggggcagtaggcttccccaaatggtttttccttggcaataggactgtcccttagatgtctcttcccatttgtagatcactgccccatctcctccatatcccctcacctaaaatagaatgggtgaaactatgatgctatgcaggatactgtcatttacattaacattaaaccgtacctgtacttgatgcaaaggacatgtgctccacaatccaggaatagccactttcagggattttccaaatctaattagattgaaatgcaaaatatccctctgttctagctattgttaaccctggctgcatgtgggaaacactcaaggagctttaagatacaaaacactgccaggctcccttacccagtcagtcaaatccgattctggagttgggacctaggtgtgtgatgagaactgctgagtcctgtcgaaggttaagctgggcagcactgcttggcagccactggaggtgctgttcccacccatgtgcagctgggcagggtccctaccccagggcagcagttaatggcctagacacccctgcatatttgagatcaagaaatgtcagtagtggttaataatgtgaattccacagtctgtatctttcacacttccattctctgcttttaaggtgagattctaagtactgtggacccataatctgtcaggtagagtctgaaatgtttttcctctcattttagggatgggcgtgttttgggcgtgctagaggtgtcacgctccattggggacgggcagtacaagcgctgcggtgtcacctctgtgcccgacatcagacgctgccagctgacccccaatgacaggtaaaaggccctataagaggcacaggtgtgtgtgcatgtgggtttatttctcttcctcacttccagtttctatcaagcctttgttggagggaaggtgtgcatggtgctaggccctgggggtgcagagataaacaaaatgtggtttctgctctggtgg

SEQ ID NO: 27026 - DNA, 1028 bp, Homo sapiens
gtgttacatctcttttagaatattagacctttagcaggtcttgcagtcttcaccagaaacactcccacacctacacacacacagtgtttttgttttttttttttttagacagaatctcgctctgtcaccccggctgaagtgcagtggtgcgatctcagttcactgcaagctccgcctcctgggttcacgccattctcctgcctcagcctcccgagtagctgggactgtaggtgcctgccaccacgcccggctaatttttttgtattgttagtagagatggggtttcaccgtgttagccaggatggtcttgatctcctgatctcgtgatccgcctgcctcggcctcccaaagcgctgggattacaggcatgagccaccacacctggcccacacacaagtattttttttttaaaaaaagataaaatgctgtgaaagttacttaaatatttgtctcagttaaagccttttttttcccatttgtaacagtgtgactggtgtcttaaccagtgtgacttcctctgacttattaatgttcactctttgagacgaaatttaaaagctttaatggaaaagtgtggtttttgctgtgagaatttgattaactctcaattcgttctttcagtactcgggtttcatattttgctgtttttgatggacatggaggaattcgagcctcaaaatttgctgcacagaatttgcatcaaaacttaatcagaaaatttcctaaaggtgagactgagaactaaatcagttgatactcaaattggttattgctgtttggttggctgtgtgaagcagtcagatgtgttattttggctttagcagagaatcattgatgagtcttaaaagagtggtgctgaggagtggatgccaaggcttccaggagtagcggccatgcaggtgtgacttagaatggcacttctcatgattctaagtgataggcaccttttgtcaatcgtctttgggttcagttagtgtcttgcctttactggaaaactagtaaaccaacttcaaatagcactgtgttat

SEQ ID NO: 27027 - DNA, 1030 bp, Homo sapiens
ccttttcgagtacttgttactttttggaacgtgattaggatatgttagtttgcttacagattttgtaagtgtttgtttaacactaagagcctgtggatataaaaacatgtatatgctacaggccaaaaaaaaccatgtatttttaccactgggaaaagtcttttacaaaccccttcagcagggtcagtttgactcagggcctggatcttaactttatgttctctcactgtgggacccccctccccctccccgccaaccatgaagacacaactcctgggtctgcctgtgtctgccagtccttgcttcaaatgaccttgtctttgagtgctaggatgaagcccagtctactagtgactttttccaacagtctacagctgtgtttctgtctggcttttactttatttccaggttctcttgccacatcaatatcccagatggtaaagactgaagggaaaggagcaaagagaaaaacctccgaggaagagaagaatggcagtgaagagcttgtggaaaagaaagtttgtaaaggttttcagacaatttgaaaacaaatgtattagacttcatattttaaaacaacccagagcaaaaccagtttcagctttctaataatactttctttttatgtctgtatttaagaaataagtagggttccctttttgcaaatgaatttccaagtttctctgtgctttctcctacttttcatgtacatctatctctgatcctacctttgatcagataggaaacctacatttgttcctcaagagttaaaaaatacaggtggtttttttcttagccttctgcagtgaatggttagttttttgaccacctagtctctctctgacttccaatctttgtttgcagtttgtcaattagtgctttgaattacgtgatttagcttagtaggcagcttccctaagcctggaaaaagccgttgaaatttgtagtcagttgtgtaacttgtcaaagttagtgaggaagaaaacgaaaagtattaactaaagagaatacttcagttgtggtactaaag

SEQ ID NO: 27028 - DNA, 1061 bp, Homo sapiens
ggtggctttacctgttcccccaccctcctcatcctcctcactgtggctcggggctatatttgcagagtcaccacctccagcaggcgtggataccacgtgagtcagcatgagtgggcacctgcgtcctcgtgggctccaggaggacgcgggcagcaagcagaccgtggaggaggctttgctggggatggctccgttgaggggctgcttggggaaaacatcccttaacctcccctccagggcccccaccatgtcccttccttctgacctgtatgcgctgcgcatataggttggggcgaggttctgagcacccagagtcgttgctgaacagcagacgcctagagttctcgaggcaaatgggtcacattgtgttttctttggaaagctttaaccagatgatgccattgttaaaatgccgttaaactaaacatatgacaagccaaacaaatccttgtgtgaatatcgagagcctcagcggcctcccacggtggatgtgtgtgcccaaaatagcagcagaccccttcagaggtgaagggatctttggattggacgtggccccttttggaagtcacattcagtcagagcggaacctggtctcattaaccagggtcaagccgcaccgatggttaaagatcctctaagactgtccgagcgtgtgttttccagtagcacggatagatctcaggagacactggctatattttcccctggatgcttgctgctatgtagggaaaatgagaggattcagctcagagtgaacactaatagtaggttgctttattttgaactaagctttttatagtgagcacaggaaagctgaccttttgcttttcaaagtcacttagcttctgcattttctggtcttctgttgttaggtcactaataagtgtttaaggatttatctttttggtgtttaaaattgtcttgaaaatcaaacgaggtataaaattggtaacgtacatgtcctagaaaaagtgaagtcagtggcaaaactggaaaatcagaaatcagcatcatactttcttttttgaaaccatggccatgttctttttgttgggacttct

SEQ ID NO: 27029 - DNA, 1049 bp, Homo sapiens
atagtaggataagtgtttgtcccagctgcatttgtggaacaccctgttttttccacagtaatctgcaaaggacctgcatctaccctctttgggaccacctcaactgcttctcagttcttcttccatgtagttttatattcagcttttaagatcatgaactaccttgcactggacctgtagttccgtttggagagaatcactatctttagaatagtaagtcttcctatccttgaatacgagctatcttgccatttatttagaccatttaaaaatgtctttcagggccaggcacagtggcctgatcacacctgtaatcctagcactttgggaggctggggcaaatgaattgcttgagctcaggagttcaagaccagcctgagcaacatggcgaaaccccctctttaaaaaataataatacgtaaactagccatgcgtgatggcgcgcctctgtagtctcagctacttgaggggctaaggtgggaggatcgcccaggaggtggagactgcgatgagccatgatcgtgccactgcactccagcctgggtgacagagtgagaacctgtctcaaacaaagaaaaaaagtctttcaatatattttataatttttatccataaaggtcgttctcattttttgttagaaatacttctaggtgccttgtattttttttgtttcttatgttaggttttctgcttgttgcagtatgttgaagtggaattggatttctatgttgatcttatctaacaccgtattacatttccttattagctctattgacttccctgtcattcttctctttgcaggtggtgggggtgggaggagctcagtatctgtagccttggagtctggatcaggagttgtgttccctccctttgtgcctgtatcattacatcagctttttcaggattcaccattaaaagcaatatttgctgggaccttttaatagataactcttttttggttaaagaagcgctcttttatttctagtttgctaacagcttttataatgaatagctggattttaacatatacttactttcattctgaagat

SEQ ID NO: 27030 - DNA, 1029 bp, Homo sapiens
accagatgctcttagctttgttggttggagctgtgatttttttttccagagggtttcccagaatgctcccatctcctcccctgatgtggtgtcaggtggcaccatggtgtcccccgctcctgtgcacagaccttggctttcctcagcggtttatgtcagagaacgggccgatgtccgctccatccccttcgcttctcttttattcttctaaatggtattcgcaagaacactaataccatctgacagggttctccttcatgtagaggaatcatttaaggcgcctgtaaacggggaaggtaaagagagacagggcggtgaggcctctgtgcctcactcagcgggtcacacgccaccgcccgcagaatgagctgagtccaagggctggtgggagggaggtcttcgtggtgagggagtacctcgccttggtcatgatgacaacacggtaccaaggtcggtccctggctttttttggctacagaaggtggaaccagtgggggaaacctggcggaagggtacctgcaacctctctggactttcttggcaacttcctgtgaatctataattatcttttaaattcacaatattagtgtgagaaacctttaataaaatatatggctcgtttcccatctgttatccatttaaagttgagatgtgtcattccatgggattagaaataaagaaaaaaagatggatgttcgtagatgaagctgaatgactaaggttgatcattgtggtagccggatacgtgggtgtttattatattcctctcgctaactctgtgtgtcgttgaagattttcatgatgaaaggccgctgaccagttcctaagagtcttctggcaccatcttctccgaggtcactgtcttcccctaccaagcacaaactgtccccaccataggctttatcgcttctgcctagatccgcaatctgtcagatttctttcatctttattatcttcttcctctttttcagtgcacagtgtatgctttaattttctagttatttttctaactttttgagtctaatgttt

SEQ ID NO: 27031 - DNA, 1059 bp, Homo sapiens
ctgggttctcagcacctaaggtgatgtctggaccacacgtgtctcctgatagtgcttgtcagagtcatggaataaaagcagggtgctttgtttaaccagaggacatccacgcatcctcataggagatgtggagcggggtattccctgcaattccgatgggagaggccgcggtggccatcacggaggatgctgcgctgggcctccttccagaggcgggagggctgtgcacggcctccttccagaggcgggaggcccggaagcagagcttccccttggatgacgcgtcacagcaggaaggagcacagctgtcgcggggtgagagacggcagaaccagtgtggagcagccagctgacacattaaacgagtcttcactgcttatgtatattttgtgcacattctttcctgacacaagagttttgagtgcagtgtgtgtcacttaatattcagctccttgttttttttttttctttaatagctcagctaaaggaatgaataaatattttagaagattagagcccctcccaggatggcgtggtatttggatagtgagatttcgggtagagtaaaggatgctgctgaaatacatgttgttgtagaatatggagaacttgaattttgaaccattgacacaaattctgaacattttggattttttttttcctgagaaagtcacaaagtaatgattcaaaggaggtttagacgtactgtttgctcttcaaaatggtgattggctctcttaaaatcagcaggttccatcaaatctgcattttggatttccggcttgcttctccccactcaagtctctctgtcttccctacctgggtgagtgtggcacacccacgccaagtccatcgcagagtcctgatggatccctttccccatctctcccagctctctctccgcctcccccgccttccgcagcccctccccgccctgggcgacactccgcatggtggctgaagtcggaatggaaggtccttaccatggccttcggacctgcagccgtgtctcctctgtctgccccgtgggaacccccaggcttgttcccctcccaggcc

SEQ ID NO: 27032 - DNA, 1034 bp, Homo sapiens
taatcctgtggccaggggcacatattcgcagctctgggaatgtttatggttggaagcccctccgctgatctgttcttccctctcacacaaaatcactccaggacagggctctttgcaaagattacttgtaagaaagccttaattaaaaagagatgtcaccatgcccctcccctccttcaaaccaagaggagcagcagaagggggagtggcccagggtcagaaggacagctgggaggagcgtgggggccaggccaggcctagggaagggccatccacctgggacttctgagccttttcttttctggagcagctttggggatgaggcttgccctccgttgagtcacggtgacagctctgcactgtgctgggctgagagagccccgccgtggagggccatctgggaaagtagggttcccagggccccccagcttcactggcttgctttgctttggttattttcgaggtaggcaaatgaggttctcgtttttaccgtgaaggttacttgtattgttgttgaattagctgttgaatggtagctgttgtcctagtttcctagttagtcatggctgtggctcgtggcttagagaccagcggcgccctggctcattcccatctcttgcgggggcccatacatgattcgtccttaaaactgggaggggacgccggggtgcactgggcttgtcctgtcgtttggtaatgatcacaagtgtgtttatatgtgactcttccagggaatcgtggaaacttagtggccatgaggtcccctggctctgaaatttctctctgaatgagctgggagggtgtaaccttccacaattgtgagcccaggtttatgtttgcaacaaataataaacagcaaaacagaacagagtgatacccccgtccaaatctagcaccttcactggctatctttcattttttattacggaaaatttcaaacatttacgaaagtgaaaagacaataaggagcggactaggctgctgtccccatcttcagcgatggctgagcagggccaggcctgcctcactgtatt

SEQ ID NO: 27033 - DNA, 1063 bp, Homo sapiens
ccacgcccggttaatttttgtatttttagtagagatggggttttgccatgttgaccaggctggtctcgaactcctgaccacaggtgatccacccgtctcggcctcccaaagtgctgggattacaggcgtgagccaccacgcccagccctgtgtttaagtttttagaaaccaccaaagtgttttccacaacactgcaccattttatgttcctgcccaccacgtatgagggttccaatttcttcacatccgcaccaatattttttattttccaattttgaaataatagtcatcctagtgagtgtgaatggtatcttattgtggttgtgatttgtatttgcctaataattagtgatgttgaacatcttttcatgtacctattggccgttggcatattttctttggataaatgtctcttcacgtcttttgcccatatttgaattgggttgtttgtttttttgttgttgtgttgtaggggtacttcatatgttatagatatataatctgcaaatatctccttctattctgtaggttgtcatttcactctctggatggtgtcctgtggtgcacagaagtttttcattttgatgaagtgcagttaatctgttttttgttgcttggcctttgatgtcatatctaagaagccactgccaaatccaaggtcatgaagactaaccccctgtgttttcttctatgagttttatggttttagttcttatatttagatcattggtgtattctgccttaagttttgcatatggtatgaggtaggggttcaacttcattcctttgcctgtggcaatttgatggtccagcaccatttgttgaagaggatgttgcttgcctttagctgctgtaagagagcatgtgtcttagaggaaagatcttgctcatttctgaagttgtgctttggaagtgtctgagctgcagttgttcttccttcccaggtcggtgtagactctgctcttcctaagccagggcgctgcagccatattcagtctcttgttctttggctcccgtccctgtcgctgcgtccctacagcagcacctcgcccacgcccccttc

SEQ ID NO: 27034 - DNA, 1154 bp, Homo sapiens
atcaattcatatgatgagaatggcactttcccccgtggtcttcctctcagtaacccatagccccagtccaaccatgggaaaaacatcagacaaattccagtagacacccttcctacagtctactcttgccaggcccactcgatatgccaaggtcatcagaaacaagcatcctttgagaaactgtcaccaccaggagggatctcaggacatgcgacacctaagtgtgatgtggaattcctggatgggatcctggatggatcttggaatacagtaaaagacattagtgggaaacttcaggaaatcctaaactctagaattttagttaatgacagtaatgtcagtattggttcccaattgtgactaacataccgtagtaaggtaggatgctaataatcgcggggaatgtgcaggtggtattggtagggtatatggcagctctctctactgtctactcaagttttaataaaatatgtcaagaattttgagttcacaaaatgaagtacatttatagatactctcttttgcttaatgtttgttcatgaatggctgtatactgtagttactttagcacctagcttttacagtttttcctttggggactcttttttttatggttgtgcatggatgtggtagagtaacttaacaagtcattgttggtggacagggagtttgttttcagcctttccattgttgttattataaacatgtagccttgaagaccgccaatgtctaagtgaactttttaactgaagtatcacaggcatccaggaaagtgcaagaatcatgactgcttagcttgatgaactctcccaaaaggaagatgcctgtaactgctacccagattgtgaaatgggacatcccaacacccagaagccccgtatatgtcctctctcagttactgtaccctcactctcacaccctctagataccacttctctagcttctaacatgagtttctcctggttttgaacgtcatataaatcacgtaatacttattcttattgtctggattatttcacttgacaatatgttagatttattgatattgtggcttatagtagtagtttcttcatttaatgggtatataatatttcattgtatgaacatatcacaaattatttattggttcaattgctgatgacattttggtggtt

SEQ ID NO: 27035 - DNA, 1079 bp, Homo sapiens
gctgatggaaactggcagagcaaaggacttcactgggacagtgagcagtggggcagccctgtgtttacaggcaaccccagaccctcttatgacagaaggggagggcagggcagccggccttcacctggataggaacagcaggtggctgatgtatctgagttggtatattcattcagagacattggttaaaattacttgtcaatataacatctttaccattgttttcttcaaagccagattctgtattttctgattttatgtaaactaaatacatagttttcttaaatacagatgacctctgccttcacagtttctttggatacctttcaagtcagtttaacacacatgctctccggaaacaaaactcagccactggggaaccgaacctacgcttttggtagaatctcagccttggggggagcctggaggccctgagccctggatgacacctgctctggaatcctccaccagtggcttttgaaatgtggttggtggctgaatctcacttctgccttggatgcttatggaatcttctggatggactgagctcagaatctcattgaatactgtggtcctctcagtctgaactttgtacctaaaaatccacgggaatctcatagcagctgctgaggatttggagaactcccttagaaaaataaaaggaatttattttttcctattttatgtagtggctatttaaattttgaacatcaaatggtagttttggattttaaaagctcagtgtgaataaactttgagctcagatgcagccgttcttttagtgtgtcaattttaataggtgtcatttgatgtttgcactagggggttggacgaaggtcggtgtgagaatctcagggataactgggctgctgcaggggtcagacaaggcctcctgtaatagggattttggggcactgatggaatgaagggaagcgggaggagagggtaacgagtagaggctgccgctgccccagttgtattagagggtggtgagggacgtggtggataggaagctgcatgggcctccaggaactcactgcactggctttgagtcgcgagagaggtgccacgggaggtct

SEQ ID NO: 27036 - DNA, 1036 bp, Homo sapiens
gacgtgtctgtggtcaccgggatgatgctctcgataggaagcagtgcatttgctgggacgtggatttgctgggacgtgtctatggtcaccgggatgatgctctcgataggaagctggttgagcaggcagtggtcggtaacttgagcatcctctcgctcctggaatcttggtgcgaggtacggataatgtttagttcaaaacaaaataagtggccgggtgcggtggctcaaacctgtaatcctcgtgctttgagaggccgaggtgggcagatcatttgaggtcaggagttcgcgatcagcctggtcagcatggtcaaaccccgtctctactaaaaacacaaaaattagccaggcgtggtggcacgcgcctgtagtcccagctactcgggaggctgaggcaggagaatcgcttgaatccgggaggtgaggttgcagtgagccgagatggtgccactgcactgtagcctggccgacagagcaagactgttgtctcaaaacaaaaaaaaaggattttgtgggaaacgtgtgtaacttaagatcagtgtgttcatttgggccattctatgatttcttaatattctgttcagtctgagctacccccatccacataaaagcagctaaaaagtctctgtccacaatgacttggtgatgagtgagttcatggtaatacagttgcttcagaccactgttgagtgttaaccctgtgagtccagggagaaggctctcctctgggattgcttccagtcctcatgttctgctctaactttatttgatcttgaatctgtttattttaactattgtggccgccaagattattatattttaatatagaaatgatccataaagatgcatttttatggcatttaaataatgctctgcagtggttgaatgtctcaggaataccacaaagtgtctgtgtgtatgtgtgtgttagagtgtgtgttagggtgtgtgttttagacaggttgtatgtgtgtgaatcagggtgtatgtgtgttagggtgtgtgcgtgtgatggggtgtgtgttttagacagg

SEQ ID NO: 27037 - DNA, 1034 bp, Homo sapiens
gttgccgcgctttctcccaccaggtacagagagggaataaatggtaatggattgatcgggcgctctttgagcgtattgggtttgcaaaactaactgcttccttgttgcttcattgtggcccagactgcgcttgccgtgggtttctctgtggcgctcagaggagccagttgaggaggcacctgttccggctgagtgcttaagaagccgacctctgccacccctgcccctgcctgcccacatgtcatcagatctgtttccaagccctgctccatctcccgagaggcagctttatccttctttcagattctgaactcacagacactgacgtttgtccagcctccaagcgaggatctgctcagtggttatgcactttacgggaaggtgcagggctcagagcagtgccagggcctcctgcttgtgaggggcatcatggtggaggattccccctgtgggctggagccagggtcaggggtggccacgggaaacaagcacatcttcctcgacaaggggagcctttgggtgagcggggtgagatccgtgaactggactgtgagaccgtgttggagaacactgggtattaagccaaccatgcctgtaacgtgggcagttacacagtgaaatgaacacttcacttgagttgttagaaagtgtaagctgttgctcacgcctgtaatcccagtactttgggaggccgaggtgggtggatcacctgaggtcaggagttcacgaccagcctggtcaacatggtgaaaccccatctctactaaaaaaaatacaaaaaagttagccagtcgtggtggctcatgcctgtaactccagctactcaggaggctgaggcaagagaattgcttgaacctggatggctgaggttgcagtgagccgggaccgcaacattgcactccagcctgggcaacaagaaccaaactgcgtctaaaaaaaaaaaaagaaaaagaaagtgtaagctgttaaagaaagctcccatcacggtgggctggcttttcctggcctggccccacccacaggacccctgggct

SEQ ID NO: 27038 - DNA, 1041 bp, Homo sapiens
tgtgattttgccactgcacttcagcctgagtgacacagcgagaccctgggctgtcccccccaaaaaagtttatatatgtaatgtataaacataaaatagtgattaccgaattgctctctagaaaagtcttaagtgtcaaaatcttaaatgccattctccttgtccccacagttctacattttgaaatctattctaaggaaagaagataagtgtgtagatatccagacgtgtgtggaggtcggggctgcattatttataaaaggagtacttgttaaacctgctggcatttctgcactgtggcatcctccatgtgtagacaggcagaagtgtgcagtgtaagagggaaaggcggggtctggagcagtccccgggccactcctggttttaagtacatgggtctctaaggtaaccatcagaggtgaggagacggggtacacttttcttttatacatggtggtattgtagagattcttttggtaagcgtgtattacttttttacagtagtaatttgaaaacatttagatatcttcattggaaagaaaagtactctttaagtccttggcaagttgataaatatgctttgcaatagaagaatttaggggcatttgtttttctaactcacatgtaagctcttcaaggtggggactgaccctcggggtctgagcgggctctgctacagcccatcctacaaacagtctcccaggtttccaccagaagcaggtttgtacctctcattcccttgcttgaaaccctggcatgactttcctgtattcttaggatcctaaggtctcagggccctggaaggcctgcctgatcctggcctctgttttaccagcctcatctgatagcacttgctgtgtttgtggagtttcagctgccacctgctttactttctagctctctctaagtcccctttgacctcggggcctttgcacacactgttccccttccttggaatggcctccctttaccttcctcttctccagcccctcagttcatgctcatcctctcatcctttgatcccctgttaaacttagccta

SEQ ID NO: 27039 - DNA, 1046 bp, Homo sapiens
tagtggtgatttgtgagattgtggtgcacctatcacctgagtgataccatgaaccaaatttgtagtcatgtatccctcacccccttcccatccttttccccttagtccctaaagcccactgtatcattcttatgtctttgcatcctcatggtttagctcccacttatgagtgagaacatatgatgcttggctttctgttcctgattcacttcacttagaataatagtctcctgggctgggtgtggtggcttgtgcctgtaatccaagcattttgggaggccaaggtggatggatcacctaaggtcaggagttcgagaccaacctggccaatatggtgaaaccctgtctctactgaaaatacaaaattagccaggtatggtggtgcatgcctgtaatcctcactacttgggaggctgaggcaggagaattgcttgaacctaggaggtaaaggttgtagtgagtcaagatcgtaccattacactccagcctgggcaacaagagtgaaactctgtctcaaaaaaaagaataatagtctccagtcccatcaagattgctgcaaatgccattaattcatttctttctatggctgagtagtattccattgtgtatatgtaccaccacagtttctttatccactcattgattgatgggcatttggggtggttccacattttttgcaattgcaaattgtgctgctataaacatgcatgtgcatgtatctttttcttataatgacttcttttcttctaggtagatagtagtggaatggctggatcaaatggtaggtctacttttagttctttagggaatctcaacattgttttccatagtagttgtacttgtttacattccaaccagcagtgtagaagtgttttcttttcactacattcacaccaacatctgttatttttttattatgggtgttcttgcagaagtaaggtggtatcacattgtggttttaatttgcatttttctgatcattagtgatgttgagcattttttcatatgtttgttggccatttgtatatatccttttgggaattgtc

SEQ ID NO: 27040 - DNA, 1028 bp, Homo sapiens
aggaaaaaataactttttctgaacagaatgttcttggttgacagggatgcctataagtgagaccagcctggaaggcaaggttgtgtcatgcctggaagccaaagtccctgggtagtccctgcgccctttttaaccgctgggcaacatggggaaggcacgtggcttccccgggtctcccttcccttccctgtgtgctggtggactggagcgggagggcctctgatctgcaggtgccgaggtcccagactctccccaggtggagccaggctccgcctgatcaggggaggaggctgcaggattctcatcctcatactgagctggaaggagctgggtcagcaaggaatggcctgttcctcagccggatggtgaagaaagtaaggcagcatgagaggcctgcttgacacttttatccattttgctactgggattcccaatcagattttatttttcaaaagtgtttgtgctaattgtttgacaaatatgaaattaatcagagttcagcggtgtagctgacatgagctctctgtgtgaaaatccaaatcttgcctatgcaccagtagacatcaattaaaaaattatagtacaaaaacagattgtgtttcaaatccctacaaaaatatgtccttagaaacatgcctgagaattgttttatggagaaagtcatacagatttcctgacagacaagaggacaagaaaaaatcgagaaggatgccatgtcataggagggaaagactccttgttgtaaacgtatcagttcaccccaaattaacttataaaatcaatgcaaatctaatcaaaatcgcaaaaatgtaatagaaaaaaaagagttttcagaggatgtcagcaagatggctgatcagagttacctgcagcatcccctgccccacaacacacacaaaaagtaccaaaacaacaaataagcaactgtatttcaaccagcatgactgaggatgtacactggagagcaccagggccgtggcacagtctgtggagcacagaagcccaggatagcaccgtaaagacgagag

SEQ ID NO: 27041 - DNA, 1050 bp, Homo sapiens
gtcctccaaatatgtcgtatgtttaattttctctcccccactacgtatcacagaattatggagctacaattgacatgaataaactgcatgttttagcattgtacagtttggtaaatgtgctgtgtgtttacacccacgcagccttcactgcacaggatgacgaccatgtccaccaccccaggaagtctcctcacactgctctgaagtctctttctcccaccctgtccatctttctgtcactatccattaggtcgcacatccaagaattgtgtatcagtgcagtcacacagcatgcacgcctttctttatttgttagtcttaaaaatctttgtgtttcattgtggatggtttctattgctgcctttaggtgcagtaatcttttcacctgcaaccttaaatcttctgtggatcccgttctgtgtacttttcatatcagacattgcagttttcatctctagaattttgattttgggcctttttggtgtctttaatgctctatttaatggaaccatctttcccctcaccccttggacatatggagctgtaaacaaaatataaaattctaagccccccacctgacgaatggaccctccctccccttggccagtggaattcccaagttaacctgaaaaattagttcaggctgtggtgggaaggtgggggtcaggcatgcctccttctaccctcctcccgttttaattcaggcacagctgaccagcattaacattaaaacagagaccttcagatttcagatctgaagacgaaacagacgctgtagcagtaagataccaaattccagcccgactctagtatagcatcacttgacagattgcaggccctggaagaaatggaagtattttaccccaaaatatatttctttgacatattttgaaacggccctgcaaagctgtctctcgtggggaaagtctacattctgtagagaatcctcattcttttctaggtcttttccctgatcggggagaaaaccaacaggctggcaccgttttaggtctgctaagagctctgaagcctgctacctggaggcttcat

SEQ ID NO: 27042 - DNA, 1012 bp, Homo sapiens
ggctgagcacccgcctctgtgccagctgctgctgctccttttgtttttggttgtttttgtttgtttgctgtggcttgcctggctgtttagggagactattggcattcgctccaggaaatcctctctgggatggaagtacttattcacgcaggcggctggatcgagggaagcacagtttccagcaactccgcttggttatgattaatggagataaatctgcccaagagaagctaaatttagccaaaagttgagccccctgcttccgcactccgccctcaggcaccggcagagtgtgtgttgctgttggccagagcccagataacatcaagaggtggaaaacaatccccagaaatctgaaaaatgtagaacaaggaaagaaaatgttcaatccatcaaaacaaacagagatacaatctcaccccccttggtttttgtaccactgggtttaggggaaaagaaaacaagagactgaatgagagagatatgcattaaaaacacaaaaagattgaagacaggaacagagtgctcccgcacagggtcacagggcttgagagaccccggaccctcaagtgcaaggccctggtggggcagggcagtgggcaggagggaggccgggttccccagggtccacgccaggtgtccctcagccctggcttccctccctccatgcgttgcgtgctcacctttttctcttcccgaccctggctgtttcgataatcttcaggctttgagagtgaatgcattactcctgtcatttatcccacaaagatgtactgtgctgggcacaggcaggtcctgggcctgcaaagaggaataagatggtccctgatccccaggactcgagattgctgggagggcggcccagatggaggtgggaaagctggaggtggcgtctgggctgccctctgggtctccaagcaggttctggggttgcagggctctgtgagctaggggaaccctgctggcatgctgcttgttaagatcatgcttctggtggcttctgtgtctggtt

SEQ ID NO: 27043 - DNA, 1028 bp, Homo sapiens
gggagtgggtttttacggcctggtggggcagctggtgggcgatcgtcctagagatcttattgtaaaatcatcttcacgccagcacgacctccctgcttagctttgatgactgcacaaggggctttcctcacttccagcatgtgctgctgtgaacctgcctggtcctctgtgtggctgccaccctcagtggggttggggtcctgggttggggctgtgtgtccagctctggggaggctcccaaagcagggatggactcccaggcaaacagcttgccctggcaaattggacagtaaatgtgaccgggtactgggtgtccatcctacttcagatgcccccgatccagggctgctgaccagggaggaactggactatcagggaacagacacagtggcaggagcccctctgtcggttgccacaccttgctggccccacaatccatggagcaccgagcatctgcttgtcccctgggctctgtcccacccaggtcctgagcctctttgttcctggctgcacacggaagggcattgccaggaagccctgggatgcccgagaggtaggtttgtgtgccatatggagggggcagcagtgtcaggcctgtcatgcgtctgtcatacatgtgtgttactcatggagtcacagagctggggaggagggccctagagttcttcttgtctatctgccccttctgcagctgaggatactgaggctcagcacagggacgtgcacctcagagtgactcaggtgagaggacgttgatcccgggtaccaggtatgttggtgggctccaggcatcaccagcagcacctgctcctcagataaggccccagcctgagggcagagttgacctcccccagtcccaccagcacttagtgggcctcctgccagcccttgtcacaatctgctcatccagtggtcctccatagagtatgagaaacagagcttggctcgatgccatctttcctggacctcagaggacccagtggtccagactggatattgtgggctcccaggatagcagagccacctcc

SEQ ID NO: 27044 - DNA, 1050 bp, Homo sapiens
tgacaagaatatgttctgcaaaatgcattgttaggcaatttcataattatacaaacatcatagagtgtgcctgcagctcccctaggtggtatagcctattacacaccaaggctgcatgctggatggagcctattgctcctaagctgcagacctgtacagcatgtgactgtgctgaatactgcaggcaactgtgacacaatgctaagtatttgtgtatctaaacatatctcaacatagaaaaggtgtagtaaaaatgtaatatgacaatcttatatggaactgccaccgtatatgtggttctcgttgcctaaaatgtcatcctgcagcacaggactgtacttctgtgggtcagctttactctgaaatgtctgtgtcttaacctgtaatattcaacctggacagtgaagaacttagtacaagatatggtgcatgtagttttgtcctggccaaactttgtttttcaggtacacagaggccattgagaatgttgaataataactgaagttatgcttcctgcggagatggtactaagaaatgctgtattccaacactaatatttgtgtatcattgcaagggggtcctggaccctaagccaaggaccctgttttgatcagtttcttcatgtgagggctgactgtggggccacacattgtgatggatcaggaatatcttttttttttttttcttttgagacagtttcactcattcaggctggagtgcaatggcgggatctcgactcacggcaacctccgcctcccgggttcaagcaattctcctgcctcagtctccccagtagctgggattacaggcacccaccaccacgcctggttaatttttgtatttttagtagagatgggatttcaccacgttggccaggccgatctcaaactcctgacctcaggtgatccacctgccttggcctctcaaagtgctgggattacaggcatgagccaccatgcctggccaggaactctactaaaaatacaaaaaattagccaggcgtggtggcaggtgcctgtggtcccagctactcaggaggctgaggcagga

SEQ ID NO: 27045 - DNA, 1035 bp, Homo sapiens
acaccaacaaccaaagaccctattgtactttttcttacttattctactttcgtgtattagccaagcacttacactgaaaacaatgcatggacggaaagaagacgggaaaagccacagttccttctttcagttcttccattttcaccagtaagctgcaggcagtgtcaagaaggcagtagcacggccagtatcgagaagtgaaatcaaaacccttggtttagttttgcacagcacttccactgttaaggtaaaaattaaatatacatacatatgtgagctacaaaataggaatcgtgtaatctctgtgtttctgcatggggatctaatgcttttatatttgtatttaaaactgacattgcacaatataaaatgaacagtaacattcagctaaaacataaaaattgaaattttctttacttaggatgaccttaagtagcaaataacaatggtaaattattagagagaacagaggaaaaggaaaagttttgttttttaacactgttaagagcagttttccctgttttgtgaacaagggactgtgtgttttcattttatagtttctcccctaacctatcacttttgaagttgctgccctggcttcagaacctatgagtgtggagtaaagccccacctacacctgcacagagctcgggctcccctcctcactcatatgctctgtggtcactgtcctcttcgtctctaggtcccagcagaccaggagcacagatgggtcagcctactcagttctccactgggctccctgttctcagaatggtctgtgtgtggagaagactcctaagtgcctgggaataggtaagtgagttggggcagaggcctggcaggcatcctggagagggaggatgtgacgtggactgggtcagtgatggatggtggggataaggaagagagggtgaaggcaagattcttctctacagggcactgaaagccagtgcccggctaagatagatgtgggggtgaaggagagactgggaaactgggttctgggtttctggtttgggcgactgggtggatggg

SEQ ID NO: 27046 - DNA, 1045 bp, Homo sapiens
gcgatagtttgctcagaatgatggtttctagcttcatccatgtccctacaaaggacatgaactcatccttttttgtggctgcatagtattccatggtgtatatgtaccacattttcttaatccagtctatcattgatggacatctgggttggttccaagtctttgctattgtgaatagtgccgcaataaacatacatgtgcatgtgtctttatagcagcacgatttatattcctttgggtatatgcccagtaatgggatggctgggtcaaatggtatttctagttctagatccttgaggaattgccacactgtcttccacaatggttgaactagtttacactcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcatttttcacgtgtctgttggctgcataaatgtcttcttttgagaagtgtctgtttatatccttcgcccactttttgatggggttgtttgattttttcttgtaaatttgtttaagttctttgtagattctggatattagccctttgttagatgggtagatcataaaaactttctcccattttgtaggttgcctgttcactctgatggtagtttcttttgctgtacagaagctctttagtttaattagatcccatttgtcaattttggcttttgttgccattgcttttggtgttttagtcatgaagtccttgcccatgcctatggcctgaatgatattgtctaggttttcttcggttttaggtctaacatttaagtctttaatccatcttgaattaatttttgtataaggtgtaaggaagagatccagtttcagctttctacatatggctagccagttttcccagcaccatttattaaatagggaatcctttccccatttcttgtttttgtcaggtttgtcacagatcggatggttgtagatgtgtggtatt

SEQ ID NO: 27047 - DNA, 1885 bp, Homo sapiens
gtgtatgtttgtgtatctgtgtctgtgtgtgtctgtatatttgtatctgtgtatgtgtgtgtgttctgtgtgtgtgtgtatctctgtgtgtctgtctgtgtgtatctgtatatttgtgtgtgtatgtatgtgtgtgttctgtgtgtatgtttgtgtgagtatctctgtgtgtctctctgtgtgtgtctgtatatttgtgtgtgtctatgtatgtgtgtgttctctgtgtctctctgtgtgtatctgtatctttgtgtctgagtatgtatgtgtgtgtgtatgtttgtgtgagtatctctgtgtgtctctctatgtatctgtatatttgtgtgtatctgtgtatgggtgtgtgtgtgtgtgtatgtccatgtatctctgtgtgtctctctgtgtctgtctgtgtatgtgtgtgtgctgtgtgtgtatgtgtatctctgtgtgtctctctgtgtgtgtctgtatatttgtgtgtgcctgtgtatgtgtgtgttctgtgtgtgtgtttgtgtatctctgtgtgtctctctgtctgtatttatatatttctatgtgtctgagtatatatttgtgtgttctgtgtgtgtatgtgtatctctgtgtgtctctgtatatttgtgtatgtctgtgtatgtatgtgtgtgttctgtgtgtgtatatgtttgtgtgtgcatctctgtgtgtctctgtgtgtctgtatatttgtgtgtgtctgtgtatgtgtgtgtgtgtgtatgtgtatctctgtgtgtgtgtctgtatatttgtgtctgtgtatgtgtgtgttctctgtgtatgtttgtgtatctgtctgtgtgtgtctgtatatttgtgtgtgtctgtgtgtgtgttctgtgtgtgtgtatgtatgtgtatctctgtctctctgtgtgtgtgtctgtatatttgtgtctgtgtatgtgtgtgttctgtgtgtatgtatgtgtatctctgtctctgtgtgtgtctgtatatttgtgtgtgtctgagtatgtcttcgttctctgtgtgtgtgtgtatgtttatctctgtctctctgtctgtgtctgtatatttgtgtgtgtctgtatgtgtgtgtgttgtgtgtgtatgtttgtgtatctgtgtctctctgtgtctgtgtatttgtgtgtctgtatacgtgtgtgttctgtgtgtgtatgtttgtgtatctctgtgtgtctgtatatttgtgtgtgtctgtgtatgtgtgtgttctgtgtgtgtgtatgtttgtgtatctctgtctctgtgtgtgtctgtatatttgtgtgtgtctgtgtatgtgtgtgttctgtgtgtgtatgtgtatctctgtgtgtctctctgtgtgtgtctatatatttgtgtgtgtctgtgtgtgtgttctgtgtgtatgtttatatatctctgtgtctctctctgtatctgtatatttgtgtgtgtctgagtatgtatgtgtgtgtatgtttgtgtgagtatctctgtatgtctctctgtgtgtgtctgtatatttgtgtgtgtgtatgtatgtgtgtgttctgtgtgtgtatgtgtatctgtgtgtctgtatatttgtgtgtctgtgtatgtatgtgtgtgttctgtgtgtgtatgtgtatctctgtatatttgtgtgtgtctatgtatgtgttctctgtgtgtgtgtgtatctctgtgtctgtatatttgtgtgtgtctgtgtatgtatgtgtgtgttctgtgtgtgtatgtgtatctctgtatatttgtgtgtgtctatgtatgtatgtgttctctgtgtgtgtgtgtatctctgtgtctgtatatttgtgtgtctgtgtatgtatgtgtgtgttctgtgtgtatgtttgtgtatctctgtgtgtgtctatatttgtgtgtgtctgtgtgtgtatgtttgtgtgtg

SEQ ID NO: 27048 - DNA, 1044 bp, Homo sapiens
tgatttgggactcttcctcttttctaatgtaagcatttaatacgcaccccacaaattttgatgtgtgtgtttttatttctattttttctgtattatttacttttcttctaggatatttcttgaacccatgtattatttataaatctgttgtttaattttcaagtgctttgagatactcctgttatctttttgttattgatttcttctttggtttccttatggtcagagaacatattttgtatggtttcagttttttttatgaaccaggatatggtctatttggggaatttttcataggtatagaatgtatattatgcagtttgaagtgcagcagtctagaatattagatacttttgtttgatagtgctcagtttttatgcatctttgctgattttgtgtctagcagttgtattgctgagagaagggtattgaagtctacaagtttatttgtggatttgtctatttctactttcagtttttgtgttatgtattatgaagctgtgttgctcagtggctatgtattttggattgctgtgtcttcttgcatattgaccctttcatcatgatgtatgtaatggcctcttttgtccctggtaattttctttgctctgacacctactttatctgataacatatatagctactcatacttctcttcttttaagccaacatctgcctccatcctttacttctaatttaccagactttgatgttcttgagccctggcaatgccagttgctccttggtttgcagcctcatggtaatcattgtcctttctacttcgcaaaggtgtggtatccgtaccctaccatcttacctgctggcacactgcacacctgtgatggggccggggattcttagggtgcttacagctccaggatgacacctggggtggaaacccacttcactctccctcacagtctgcctcatcaattttaaaccaggtgtccctggaatcatagctgtcatatcatgttggtacaggggctgggatgagcccaaggaccaaggcattgtggcgtagaaaagtcaacctgacggacg

SEQ ID NO: 27049 - DNA, 1050 bp, Homo sapiens
tgtaagtaggtgtgcatgtgcgtctgtactcacttggcctgaggttcataacactctttgagcctttggctggtgttcattgtctgtagcacttttttttttttttttttttttgagacagaatctcactcttgtcacccaggctggagtgcagtggtgtgatctcagctcattgcaacctctgcctcccaggttcaagcgattctgctgcctcagcctcccgagtagttgggactacaggcatgcgccaccatgcccagctaattttttgtatttttagtagagacaagttttcaccatgttggccaggctagtctcaaactcctgatctcaggtgatctgcctgccttggcctcccaaagtgtgtctgtatcgctcttgccacattttctgtctgccttggcgtcccacagtgtgtctgtattactcttgccatattttctctctgctctctttcggttccagttggtcatatgttggaccttttcaccatgcaccatattcttcgtgtgtctgctcctttctgtatatcttgtcttttttttttttttgagtgtgcatcagcctagatgtgttcttctaaactgcctttcaagttactaatcatcctttcagctcgttctaatctgttgttagacctgtatttcttatatttgagttttgaattttcatcctggtttgtttttgattctagagttttcattgttataatttcaagtttactgctgatattattttgtcatctaatttcttaaacatattcatcacaaagttacacagaattatctgataattgcagtatctgtgtcttttgtaggcctgtgtgagtggtctggtccctaacgtttggtttggggttgtttaatcttggcgtttggtggcctcatcattggtgttttgttgttttccaatggcagtcattttttgtggagactttgcctggagtcatctcaccctggagaggatgcgctttaccgtcttctggcaggcatggaggtcagggcaggtcccctgagagcgctcaggaagcaagctggtgacgctgggctt

SEQ ID NO: 27050 - DNA, 1042 bp, Homo sapiens
gataggagaacactctgttcatcagctgttatgtcagtttctttactgtcagatgttacttctggtattttcttactctttgtctgtaaataatgagggttccatttctgcagaaggcccttaggccatatgggaggacatagggagggcaggcagagcttgggacagacagcgagggtggaagttggtaggggcaactgtgtcattgatcttcttatccaattgccataccttcttagtgagttatttgttctggcaagattccattaggttcgaggcgtgtgtaagtttcgctgggaaccagcgggtgagttgcagcctgcactgcaaatcccaatgtcagtggactgggaagagcacgatccatatccgcggcagtggtggctgtggtttgttatgggtaaaagtgaaatagttgtattaaatcagaactccaagctatgccttcaacatgtagatgagttgaaatctaaatctttttgcattactataattgtctgagttgatatgagcaaattgcctgaagcacccactgaaagtctgagtagatccccttgcttgctttcttactctacttggcattttcttttaagtaaattttttggattgttttggaagtggttttattcagtgtgaggatttggggaaaacacataaaaccataaagatatctctcagaggcacctgcggttaataatctgtgttcacctccttctgtctttgtacacgtgtgtgagtgtgtgtgctgtttctccctttgtccttgtatacttgtgtgagtgcgcgtgctgtttctcccttatctgtccttgtacacgtgtgtgagtgtgtgctgtttctccctttctgtccttgtacacttgtgtgtgtgtgctgtttctccctttctgtccttgtacacgtgtgtgagtgtgtgtgctgtgtctccctttctgtccttgtacacgtgtgtgagtgtgtgtgctgtgtctccctttctgtccttgtacacgtgtgtgagtgcatgtgctgtttctccctctttgagtggggctctgcggat

SEQ ID NO: 27051 - DNA, 1038 bp, Homo sapiens
cttcagctaatgtctgttcagttatgtgtgttgaacgaaactgtcacatcgtcctgatctctcatgaccactcttgtgcaaatatgtcaaatagtttgtgacctttcatattgctgtgtgagaacaaataatgtttctgtgccagccctgttcatcagggatgtttaagacctctgtctcctatacacttcagttgaatattcacttaggtgacttgcagagggaattattctcctttgtcactttgtgcctttctcttcgtattaacaatgggtagctgtagaggttcaggaagcaatacagcaagtcctgtaattagtgtggccttttccttgccagccctaatggcaaatgcagtaagttactttcctcactatggatttattgttcattctgcttgcagtttctgaccatttatgttgatcttaagggtgctgtgaggagtgcagtgatctcgttgcagtaagaatctgttatccagttgtatgactctgaattgtgagttatagacttgtgtggaacagatgtgttactgagtgattgtagagcttgaagacttttttctttttcctacactttggaagtgatgtgagtcagtaatgatgagacttaataaaatacaagcactttacctgtactacgtaatttaatcaaccagtggtctgttgaagatggtcagcagagttggtgaagtttgtttggtaccattgtaggggtcagatgctgatttcagtatgagaataaatagcttgtacattcttggagtatttacttaccctgtatgtttacatcctaaatgtgtggagggtgctctggtgtaaagatgccctctgtgcctgtgctcatttaggccctgctgtggagggtgctgtggtgtaaagatgccctctgcctgtgctcggttaggccctgggctgtggagggtgctctggtgtaaagatgccttctgcctgtgctcggttaggccctgggcttcgttgtccttccgtgcagcgggcactgcctttggcgatggtatgtgcagctgctgacatggct

SEQ ID NO: 27052 - DNA, 1051 bp, Homo sapiens
tgttattttttcctggaggagaatatggtctcctttttgatactgtgatgaaaatgcagggctacctgcctgttcctcactctgatgcccatcctcagtgccggaattcttgtaggtgctcaggaaatacctctctggatggtgggttcttgtcagggcaacagtaaagctctggttattttttgctgctcctgaaagatccatgggactaactttccttctctgttgcaatagtagaaacagcgagatgtctatgtatgcctttctattgccactctggaacttttattgtttaagcatatgcttgtaagtatgttgtatagctagacttctaagaaccttccatcaagtggcaaaaggagggaactgcaagttcaaaatgtttgtttctcagtggactaactggacacctttgcttattatgctgacatttattgagaaaaacaaagtcatacatttaacattctctagataattcttttgttatctgggaaaacagtatttcaaaaataattctgaggtctaaagtagagctgtcaacttcttaatttttccaagtaaagtcttcaatactgtcatcaggtaaaattaccccattttataaaagacatcacattatcagtaagtctgtgttcttattttgatttttatttcaatgcagtctgtgtctcagtattgcaccttttgggaataactgataggaatatccgaaaaccatttctagattctaagaaaacagtcaaagtgatcaataactacatattttatcaagtaacttcaggtcagatttctgagatggttgtgttatgttgcatgttatgggcttatattacactagagtttcttttataatcagttaacatttaatcttattctacttggcacatagctaatgatagagatttagaatcatatcacctcttttatacttttgttgatttcactcactcctctaatacagagcacctcctatatgcaaggcgcctgtgccaggcacctaggaggctgcaaagatgaacaaagatggtctctgcccagacaccaagtcctt

SEQ ID NO: 27053 - DNA, 1035 bp, Homo sapiens
tctccccggccccggcagcgagggcagcatcttgggtgcccgtgcactcgtgggtgcagacacggcactggcgtgtcctgagtgctgagttgtggctgtgcggtggtgtccgtgggactcagaacagccctgcatgcattttcttaggattgtcttttaaatgaaagctagaaagcactctagccaacactctccccttggactacatgtacgagccctggttggctgaaactgaaagtctgttacgggaaaagtcttttatttcattggatcattgacgattatctctgtattttggactactatataattcattctgaagtgatttcttcagcccttacccttgtaggtgtaactacgtggttttgcttatttccctagattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcacatgtggagtgatctctttcttgcacttatgagtgaatgttgcagtccctaaacgtctctgtgtgtttgtgtgtgcatgcatgtgcgtgcatctgtcagcacgctgagagaaccacatttgtctggtagcagataccttgtgttaaggtgctgtatgtgctggagcaggaggcagcgcggcccgtgcacagctgggcctgctgacagcacttggaggaccttgccacggggccgcccctctgctgtgtgggcaggttcccactgtgtgtgtctgtcagcacagtcgtccttatgctgtcctctggcctccacgtcagggcagctgcccctaggcttaagaactaggacgacaggatgcgactgcaggagacgccttctacgtggaaatgcaca

SEQ ID NO: 27054 - DNA, 1052 bp, Homo sapiens
tggaaaagagcaagtcaaattatccctctttgctgatgatattattctatatctagaaaaacctaaagactccaccaaaacactcttagatttgataaatgaattcagtaaaattgcaggatacaaaactaaaatacaagaaaatcagtagcatttatatacaacaataatgacttagccaagaccgaaatcaggaaggcaatcacatttacaatggctacaaaaaaatacttaggaataaatttaaccaaggagttgaaggatctccataaggaaaactataaaacactgatgaaagaaatggaagaggacacacaaaaaaatggaaagacatcccatgttcatgggttggaagaattaatattgtgaaaatggccataccaccaaaagcaatatacagagtcaatacaatccctatcaaaataccaatgccattcttcacgaaaacagaaaaaacaatcctaaaattcatatagaaccaaaaaaatcccaaatagccaaagcagtctggaacaaaaagaacaaagctagagacatcacattacctggattcaaaatatactacaaagctatagtaaccaaaacagcatgtactgatgtacaaatagacacatagaccaatgaaacagaataaagaacccagaaataacaccaaatatttacagccaactgatctctgtcaaagctgataagaacatacactggggaaaggacactttcttcagtaaatggtgctgggaaaattggatagccacatgcagaagaatgaaagtggacctttatctctcaccatatataaaaatagactctacatggactaaagacttaaacacaagacttgagactataaaaatattcaaaatttagggcaaattctcctggacattgatctaggcaaagaaggtatgactaagacttcaaatacacaggcaacaaaaccaaaaatagacaaatgggatttaataaaactaaagagtttctgcataatgaaagaaataatcaacatagtgaagagaacctggtgaatggagaaaacatttgcaaactattta

SEQ ID NO: 27055 - DNA, 1180 bp, Homo sapiens
tgtatttttagtagagatgggatttcaccatattggtcaggctggtctcgtactcctgacctgatgatccacccacctcagcctcccaaagtgttgggattacaggtgtgagccaccacacccagtcaccaaaaagaaacttttgagatctcagataaagaatttgaaatactgatttttaggccaggtgaggtggctcacgcctgtaatcccaacattgggaggctgaggcaggcagatcacttgaggtcaggagttccagaccagcctggccaacgtggtgaaaccttgtctctactaaagtacaaaaatgagctgggtgtggtggtgcatgcttgtaatctcagccactagcgaggctgaggcaggagaattgcttgaacccgggaggcggaggttgcagtgagccgagatcgtgccactgcactccagtctgggcgacacagtgagactctgtctcaaatttaaaaaaaaattcaaaataattgattttaaaaggacctgaaatagaagagaatactgaacaaacaatacaaataaattagaaaaacaattcaggatatgaatgagaaatttatcaaagagacattttaaaaaataaccaaacagaaattctggaactgaagaattcatggaaggaaatacaaaatacatttgaaagcatcaacgatagactagatgagacagaggaaatctcaaaacttgaagacaggtcttttgaaataatccaatcagacaaaggtaaagaaaaaagaataaaaacaaataagcaaaggcttcatgatatttacgacaacataaagcaactaaatttgcaaattattggtatccttaagggcaaagaaacaaaggattagaaaatgtattaatgaagtagggccaggtgtggtagcttatgcctataataccagtgctttgggaggccaagtgggaagattgcttgaggccaggaatttgagaccaccctgggcaacatagcaagaccctatctctacaaaaaagaaaaaaattagctgggtgtcatggcatgcacctgtagtactagctgcttgggaggctgggcccaggagttttaggttactgtgagctaggattgtgccactgcactccagcctgggtgacagagcaagaccctatctctaaaaataaatcagtttttttttttaaaagaaaactaatt

SEQ ID NO: 27056 - DNA, 1031 bp, Homo sapiens
agagccctgggcggtgcccctttggccctgtggccgctgcctcctgcctgcctcgagggttaattcctaccaaattgggtgtgggaaccactccgaggatgcccagcggctggggtggatgcggggaaactgaggccaagtctcagctttgccgtgtggcagcagatgcagcccaagccagttggccacggagcacatggcacaccgagcctcagtttacccacttacaaatgaaattaatgatcctgggccttcagcaaggtggtaacttgtgtggtcctgacatgagcgtgaggatgagtgtgcaggagtgccatgtgtgctagtgggcatgcgggtgacactgggatggggatgggcagacagggaggtggggaggtgggggcactgacaggcctccctgcttcagaacatccctgtctggtcagagcctccttggagggtagggagaaggagcaggtctgttgggtcttcttggggccaggcgctctgccctgagtagaccacctgaagggtggcaggaactcacgttaggaatgaacagtgaggctccaggaaggcggctggtcaaggctcccaccgtgaaggacgaggcctgggcagtgaacacagggctttctgttcgcacacttgtgtcctgatgacagattgggaaagttgtggggaaataaaaggagacactgaatgtgacactatcattgggtacaggacagactggcaggtggaacttcagtgctgcaggcgtgacggctgcagcagtccagccatcacatctgtatcccagaagggaggggaaaggggtccctttcccaggagcccctcagcagacttctgtgggcacctccttggcctggccagcaagactgcgggaaaggggagtgtgcatggtggttgggccagccagacacagggtctgccgcatctgaggggcacagtcccagcagagcactgggatagggagctgggccagagaagagtccctgcagtgggggaggaggagtcgcagaggtcaggtcctagtgaacacttct

SEQ ID NO: 27057 - DNA, 1050 bp, Homo sapiens
acagggcattttgctctggaataaattagcctgctagttcttcgaagaaagtttagtgtttctgctgagtttcactggggactcagggctttatgggcttagctcgttcaaacaactctccttttcccacctgtccccctgggcagtgtgtacccccgtgcttggccccagattcctgcagcccttcccacagcacagctgctggaagggcttccttcccgaatttccactgctctggaatggaatcggtcgctgcccatgactgctcctcctctcagaggcgtctggggtgaggccaggcttctctcgcagctccgtcagtccatgagggcctcgttaggttcacaggggatggggcgagatggaagtatgacagcaagcgtgggctcactgcggcgtttcctgttcactttaacgtgacgttatctgttgtatttcatccctttgcctgaacccttgttgtcattctttctctttgtattttgaaggaccctacaatcatttctctaatttaacatctagaccaaccccatcacaattttccgttcagtgcatccacccatccacactcaagaaaccactgctgtccacagtggctgtgaagattccagatgggtgacgaactggcaccagggccacctttgggtgcccccagaacagggggcccattatgcagacccatgatgggcttctgtccacttggctgtgaaatttatttgtagattttgtttttcttctccggttgtgtaaacactcgtccatcgtttcagcactttaccttcttcacagggtgttgatggggtgagagctgatggctctctctgggcaccagccttgccagttgtcactcaggcggcattgagtgtttgagggcaggcgggtctcactgtccaggccccttagtgcacagcctttcagcttggaaattaaacttttcttccaagtgtaagattacacagaaaacagaatttttggtttaagactcaggataatttcatacctttttaggtttactgattggactccgtctttgaaactgattaaggtcac

SEQ ID NO: 27058 - DNA, 1052 bp, Homo sapiens
cttgcactgtggcctccactgcctacaggcaaaggcgtgggagctgctgggttcctggaagcaaggattggctccccttcttcctctgtccccctctttctccttccctttgctcctcccctcctccctttggcctcctctcctgctcttccctccttcctcttcctcctcctcctcttcctttcctctatctcctcctccttctcctgccccttgttgggtcatacctgacctgctgcctgcatacttcctccccacccactgctgccccagcctgttggggtgtttgggctgggttccctaattgaacccagacctggtacctctgacacgctttcaccatgagacttccatcatgtcctcacctcagaggccactgagacctccctggctgcccccttgcccctccatgcactctctggagtgccctccttcctgttcctcgggagagctggtccgcctcggtccctgggcggcacagcctaagcctccagagatgtttactggctgaatgcatgcatttcttgggaaagttttcttttttgggatttcttttgacgttacaaacatgatcacatgtgcagctgggtcgcgttatctctcctcggtctattgcgcttccttggcaggggctatacaaagcggaccagcggtttgggccaggtgtcgagacctaccccgatggcagccaggacgtggggctgtggttccgagagcagctcatcaagctgtgcacccagatccccagtggcttctccctcctcagataccctgagttctccagcttcatcacccacagccctgccaggatcagcctctcagaagaggagaaaacggagtggggactgcaggagggacaggatccctttttctatgactataagcggtttcttctgaatgacaacctaacgctgcctccagaaatgtatgtctactcgaccaacagtgaccacctgcccatgacaagctctttccgcaaagagctggacgcccgcatcttcctcaatgaaattcctccgttcgttgaggatggagaaccatggttcataatc

SEQ ID NO: 27059 - DNA, 1026 bp, Homo sapiens
ctttgacacagggtcttgctgtgttgcccaggctggggtgcagtggtgtgaccacggctcgctgcagcattgacctcctgggctcaggtgatcctcccacctcagcctccctaggagctgggactacaggcatgcatcaccatgctgggttaattcttttatgttttgtagagttctcactatgttgcccaggctggtctcaaactcccgggctcaagtgttcctcctgcctcagcctcccaaaggtttaggattgcaggcatgagccactaaaaaaatctcttgtcatgctttatgacccaaagtctaatttgtagatattaacaaggctacattagctttctgggattacaggagtcaagtcctgccttctaggcgaggatgcatgtcaagagccccagtggatgccccaaactgtggataagctccagtggatgcctgaaactgtggatagcatcaagccttatatatactaggtttaagtgacgagtgggtggacagtgtgtggagtatggagaagctggataaaggcacaattcacatctcaggcaggactaggcaggatgctgtgagatttcatctcaatacgcagaatggcatgtaatttaaaacttatgaattgttcatttctggaattttccatttattatttttggagtatggttgaccatgagtaactgaaactgtggaaagcaaaactgcagatacggaaggactccagtatttttcctgtgatgcgtctttctctgtaactttactttcaacctttctgtttcattatgttttagatatttcttcattttacattttttgtatttttttcatgacgcatcactctacctaaaaaaagtgtgtgtgtgtgtgtgtgtgtgtgtgtgtgtgtgtgtttattgaaatccagcccaataattgtcactggtcatttagacctgcattgtccaacgtggtggccactagccatgcatgtctcctgagcacttgaaatgtggctgggccaagttcaggggtgctgtgaatgtgaaccac

SEQ ID NO: 27060 - DNA, 1050 bp, Homo sapiens
ttgctgggattacaggcatgagccactgtgcccagcctattttacctataatttcaaagccagtttgtttagtgaagatttacttaaatctcgtgaaaactgcttggacttatttaatactaattattacttaactaattattaattatatttttattaagtaattataagtaattacttattacttaatgaaaattaagtaaataatttacttaagtaattaaataatttacttaatttcaattcataaatttaccttaatttatgagttgaaaattgcttggacttatttacttaatttataagtgctcttttatttataaaccaacttggtagactcaacctataacataataaatttatacatatatatatatatatatagatataaacatatctagacatgtatacacacacacagatacaaagattcaatagctcttaccttggaactccgtgagatagcaatacaaactcaccagtctacgaatttgtttacatgtctgaactctattagcctcaataggtaatccagtgaaggctgtggaccaaaattttaggtaaagcagtttccatggcagtttgatttttttttttttttgagacggagtctcggtctgttgcccaggctggcgtgcagtggcgcggtatcagctcactgcaacctccacctcccaggttcaagtgattctctgcctcggcctccagagtagctgggattacaggcgcctgccaccacacccggctaatttttgtatttttagtagagatggggttttgccatcttggccaggctagtcttgaactctgaccttgtaacccacctgccctgacttcccaaagtgctgagattacaggcatgagccactatgcctggccctttttttttttttttttctgagatggagtcttgctgtcacccaggctagagtgcagtggtacaatcttggctcactgcagcctctgccccctgggttccagcaattctcctgcctcagcctcctgagtagctgggattacaggcgaacgccactacgcccagctaatttt

SEQ ID NO: 27061 - DNA, 1057 bp, Homo sapiens
gctgtcttcgccacaaggtgcgggggaccctccagcggggaggtccgaccctgacctggggcccagggttagccgggattctccttaaggcaagcagtaaaaatccctgaactgtgttactccctgagaaactagtttctggagaaatctgaaagcctcaacactgtgtcagcaacctactgaggaaaacgacaatagatggtaattggaaccttctcatgtcccttcctgcctgcacactctgccacccgtgtcgccgcctagtggagggagggaacgtttccctcacgagatggggctcccaagctgtctccatcttcacagctctgttgttcacagccaggggctgccctggagtctcactgcagcatctcacgaggtccccctgtcaccccatcgtgcttgtccctgtttgtgggcctccaaaactcagtcccagccctggcccagtgtgatgggtgttggggaccagcctcaacaccacccgtagagtgcccaaagtctagtggggacaaaggattgagaagagacaggttaagaattgaaaggtggggagccagggggccagttgcaaaatggaggctgcaaagggctcagagttctggtctccacactgtttattgagcacacttagatctgagaagcagatgttcagggcgaaacagtgaaagggtggcagtgtgtcataggtgtaatctatagcaatattggtttcagtgaatctcctttgtgctcaaacagcatatcttttaacttatcggagagtaactggtgggagcgggcttagctaggagcctgcatgtctgtccacagtccagggcttcaaaggagagtctttctccttgaacacagtgtttacagataagagagcggatctcgctctgggcatgggaacatgatggcaattaggaggctttcctcctcagaggcctcttgtggctttccacaacttattgtcccatattttcatggcctgtttatgcaggcaccccacaagcccttttcccacaagcccttttcccaacaatgggctttgggaggtggctgggtttagatg

SEQ ID NO: 27062 - DNA, 1096 bp, Homo sapiens
tgggtctgagaaaggaggaaggcgcgttgcgtgggcgcggcctccccgaagcggctttggccctcgcttggctcctgcccgtgctggcagctcccacccctagccctgccctggagcagtcttggggactgtcctctgctggcacccccaggcaggcaccgtcctgtggcttggctgaccaggccagtgggccttcctgtgccatggacggtgctggcgtcctcagccccatgatgggccgggctgctccaaggccgctctccctgacgtgcggaggctcaggatccccggcttctggctccagcctggggccttggccttccatgcgcttttccatggccttgcctcctgcccgctcccaggccccacgctttgcagcctccctggctcagagtgggcctgtggccacaggccgcttccctctgcctgtcccccaccccgctcccgctgcgctgcccggccctcactaaccgtgtgattgtttgtgttttgcaggcagtttcttgattcggacatacctaggtatcatctgtgacccttggtttacccttggtttcatttcagcctcttctttcctccctgctcctcccctgaccgccccccatgcccctgagaagttaacttccagcttcctggactcctcacacacgtgctcacctgtcctcctgttcctcccgtcttctttctttttattctcttggaatcttggtttgatttctttattgctttcccaccctgtcctcttggctgagtcccttcttcccccactcctgattttggctgctttgtagtttcctgctccctagtagacactggctggcctcctgctcctcctgccccagccttgcctgccccgcgccacaccctgccctgtggatgggctcggtgtcccgcacgctgctggctggcccgctgcccttggctgcaccaccctgtgaggaccagccccgctcccctctccctgcaaggggctgtagcaggcagagccatgagcacaggggttggggaagggcagacaggatccagcccaggagaccctcacactccggcacattccacagcctctcgtgagtccctcacctggccaggccaggag

SEQ ID NO: 27063 - DNA, 1438 bp, Homo sapiens
gccccccacttggcttctaccacgtccagaacgtacgttcctgggcacttctccccatccctgccactgactgaccctcccagggcctctctgagcatggctcattctccctcttctgaacaccagttgtgggccaggactgccttgtgcaccgggaactccagtgccaggcagggtgtaggagcgatttctgggcagtgggagacccttgatggatttacagctggggcatgggggccgctcagagcccctgggagctgctcatagtgagcatagagccgatggggagccggatgcaggtgcagtggggcctgggatttgtactgagggccgggggtgctcagccagggcagccctggcttgggtgttgggaatgggaaggaggcagggccacaggggctacagggtgccggcaacgtcccgagaggtctggaaaactccaggcaggagagtgatggcagctgggctgctaggatgatggagaggaggggcctttaaggcggagcagctccttctccaggcgggagaactgggctcctggggcagcaggggaaagagtgcctaacggtgataaggaaagctaccagggagccaggccttgagtgccaggccacgggtgtggatttggcaggggtgataacctggagactcagtgggttagttggctgggacttctgtcacaaagcaccacaggtgggggcatctaaaaacaacagaaatgtggcctcccatcgctctggaggctggaagcccgggatgagggtgtgggcaggattgcccccttcttaggcctctatccttggcttatagaacagccgcctcttccttgtgtctgttcacatggccctccccctctgcgtgtgcctgggcccaaacttccgcttttcatagggacagcagccatgttggattgggacctactctgatgacctctcgttaactccgttttctctgtaaaggccctatcccaggatatactctcattctgaagtcctggggttgggacttcaacatacgaatttggtgaggggacatggtccaacccataactcttgctgagtggggcaggacctaagaaggggagtcctgaagagaccagcgctgccctttgtcacctttcccagctccgtgttctgaaagggcagctgagccacgcggcccctgttcgtcctggagagagagcccgagggacacactccagagtctgtctggggcacgtggtgggaggaggggctgggctgaagggcctagaggaggctgctgcccctgggcagacgtgggcccagctaggggtcccagatctgggcctgaagcgcttagctcactgatgtgactctccttcccccttgaatgtgacctggccgtgccctcctgtcctcccacctgcctgcccaccagatcgcagtggaggtgaccaagtccttcattgagtacatca

SEQ ID NO: 27064 - DNA, 1057 bp, Homo sapiens
gcggcttgtgccgtgagggaaggtcccactcccttccctgcctgccccgggctcctccaccaaggtctcccctcaccaaggagcactctttttcctctcaaaggccttggctgcctgggcaccctagggagggagtagtacagacagacagacacacagacaggcagatggatgcagagaggacgtgcatccatggctgcaggggggctcctggctgccgggctggggctgcttagaggagcgacctggagcaggctgagatggccatacccctccccagatggcaagtcccccaactccgagatggctcatattctccaccctgagttacctcatatcccctgcaagatgcaagatgtctggttctcccggctctgctatcctggctgccttgggtgattttaatcccacctaattaatgaagttaatttgactctaatgttaaattctccttagcccataatttctttcttttctttttttttttttggacaaagtcttgctctgtcgccaggctggagtgcagtggctggatctcggctcactgtgcaacctctgcctcccagttcaagcgattctcctgcctcagcctgccgagtagagtagctgggactacaggggtgcgtcatcacgcccagctaatttttttatttttagtagagacggggtttcaccatgttggccaggctgctctcgaactcctgacctcaagtaatctgcccatctcggcctcccaaagtgctggaatttcaggcgtgagccaccacgcctggccagccaccctgcccagcctagcccataatttctaaatgctgtttatagcacctcccactggccatgtcattgcttgtcatccagtcactgtgataccacagtgctgagaatcagggggcccagctggggagtgagggtgaacaccagggaagggccccagccctgctgctggaaggtggggtgtttaccagggctgcaatactcagggaagctgggaacacctatcacctctgtctcccctccaggaggtgccacccccacctcaccaggtcctcccaatcct

SEQ ID NO: 27065 - DNA, 1114 bp, Homo sapiens
tgcagggattttcaacacaaggaaacacagattctcagaggtcatccccccgtccacgctggcagccactcctggctgtgagaagagatagtggcggaagcactctggagtgtagacgcggctgcacctggtggctctaaggggctgtggtgtaggcggcacgagtccagccacatcaggaacttgtccccacttagccatagggtggcctggcacatccccctcccctgtagcctctggaagagctgtttgcctgagggacagccctgccccacatccagcctgttctgcggaggagttctggggagcctgggagtggcctgggcaaggtccaggagttcagcgtctgccctggtcccaggctcactgtgccccctttccttctgcagacagacccttcctgctcttgatcctgtcccaggctcgctgtgccccctttccttctgcagacagacccaggcttgctgtgccccctttccttctgcagacagacccttcctgctcttgatcctggagcttccaggggcagcccagaggggcttgtcccttcttcacagctatgaggctggggcactgtaggatgggggctttttgccagattcccccaagggtggcacttacagatggggacgaccaggcagaaggttgcctcttcatggaatgtcagtgtggaagggtttcaaggaggcctcccagcctttgctctacttggatgcctctggtgatgtgggactcaccactgagtgggcaccctagagcatttagacagcaattggcgaaaacctctcgtgtcaggctgcatgaattctgtttcatggagttctggccattcctgtaaccaacagctctgtcccgaggctgtccctgtccctgtgcccaggagccccatcgttcaggccgcaagtcccacggggaagcagcagcatctggctggtcagcccggaaagacctttcacagtggctgcttcgtcactgttttgcggggagttttcatcagccttcctcagagtcccagtacccgagaggccaaatcattttggggttcctgaccaccaccccgtcatttcacagacggtaaactggggcccaggaagctgtcacacagctggggtaa

SEQ ID NO: 27066 - DNA, 1038 bp, Homo sapiens
acataaaataactaggttcaaagagatcaatgcaaactttagaattttatcagagtagtcaaaacaatcttggaaaggaagtacaatattggaggacttacacttccagatttcaaaacttactacaaatctccagtaatcagtgtggtactggcataaagacagatatacagactgatggaatgaaacagaacccagaaataagccttcgatatataatcaaacgattttcacaagggtgtcaagagcattcagtgaggaaaggacagtctttttaacaaatggtgccagcaaaactggacatccacatacaaaaggatgaagttgggcccttacctaacaccatatacaaaaattaactcaatatagagccaaaacctaaacataagagctaagactgtaaaactcttagaagaaacaatagggcaaaagcttcatgacgctggatttggaaatgatttcttggatattacactaaaggcacaggcaacaaaagaaaaaacagacaaatcggacttcatgaaaattaaaaattttcctgcatcaaaatacactattaacagagtaaaaaggcagcctgaaaacaaaataacagaaaatatttgcaaatcatatatctgataaaggattaatatcctgaatatagagagagctcctaaaactcaacaacaaaaaacccttgtttcaaaaatgagaaaggacttgaacagacatttctccaaagaaccaatgagcacctggaaacatgttcaacatcactgctattaaaaaaacaaacctggcccggcgcggtggctcacgcctgtaatcccatcactctgggaggccgaggtgggtggatcacgaggtcaggagatcaagaccatcctggctaacatggtgaaaccctgtctctactagaaatacaaaaaattagccaggcatggtggtgggtgcctgtagtcccagctactcaggaggctgaggcaggagaatggcgtgaacccgggaggcggagcttgcagtgagccgagatcgtgccactgcactccagcctgg

SEQ ID NO: 27067 - DNA, 1053 bp, Homo sapiens
cccgagggttccctgtccctcacctctcaccactctccacttctcccccaacatgccagggacactcctgacttggggccctggtaactgtcctctggctctggaatgtccatccctcctccatgtctgttcagcatcgccctccccaggaggctgccctcttgctgcaccagccctgcccatccccagcaggctctcctggtctcgtcctgtcatctcgtcctttttccctttgcactcaccacctgccacaccacacaccacactctcactgctgtctgttgtctgtcccctcatctgcaatgaacgggtcctgaaggcagggctttggtctgctctgttctgatgtgtgctgagtatctagaacagtgcccggcacacagcaggtactcagtaagtcatctgttgactaaatggacagtgcccggcacacagcaggtgctcagtaagtcatctgttgactaaatggactgtgtgaccgacagagtcatagagtgttagcaagaaaggacctaagagatgggctgggcatctctccctccacagcccattttggagatggggggcctaaggccacatcatgagttaatggcagaactggggccggcattctcatgagctgtttgtttttccagggggctctgaggaagagaagagaggaaggtcacatcagttggctctgccatccagtggggactgggctgatgtgtgggaaggaaggcctgggggcctggggaccaggagcctgcgttcttctcagcccctgctcctgagctgcatggacttggggcagttattcggtttttctgcctcagctgcctaatttgtgacatggagggaatcgatggtcaaagcaagtcccttctgtgactgcagccatcgtccctcctcagggttagctgggtagctttgagacagcactttgaggagtcaagaacacacgacaaatgcggtaaggcggaggacagaaaccaacttacacgtggtgacagacgcctccctcccagactggaaaggcctttgtctcggagaacagccttgtgcaggggcggg

SEQ ID NO: 27068 - DNA, 1138 bp, Homo sapiens
acgagcgtcataaacacgctggaggaccagagcaggggcggctgtgtctgcaacccggctttccttctgacatcacctggtctctgcccttcagcccctgcccccgtctctgttttggaagtggtccatcacagttccttctcaatttgttgggcctcgaagggagaattctttctctggctttggagtctaagaacaggtttctgcatactgcagaagcgtggctgactgacagcctcactgattccggggaatggcgagctgtcatctcatccgcagagacacagactacaccttcaggaactgcagcttgggtgagggcacaggctgcttaaacgcatcgcaggactcacaggtggttggtcccagaggggtctctcagggtgggctggtgtgtgcacaggcctggccatctgtcctctagaggcctgaggagagaggtcacagaggggactgactccagctaggaccttttctcagggtgtcctttttcatccagtttttagacctcatcttcctgggtgttagaaactcgtgaggttggtggagtgtaacaagaacgtcttaaatcctttgaagaaaaaacaaagtgaagcatgaggagaatgacaggcattcccactcctctttaaatgggctgcttcctgcttctcttagtggccctcagggcctctgtcacccagaggaccccacgttcttagagcaccaggattctaccatatggcagtgcacacggggaggaccccgcgttcttagagcaccaggattctaccatatggcagtgcacacggggaggggcagcctccaccgactacatccccatctttaggaacatgtgggctcagcattgcaacttttaaatgtgaaatcacagcctgttcctcttccctgccctcctccttccggtaacgactctgggtcttttctccaagggcacagctgtgtcaggttgctctgggttgaaatgaattctcgtgttgttcttggatgggtgtctgggtgcgtgtgtttctgtttcctgcttttttgtgtgttgtctccattatttcaagaataggtattctataagtcagtatttgataattagttgggggtttctgatttgtttttatgggagtggatgtgctaggcaagcatt

SEQ ID NO: 27069 - DNA, 1036 bp, Homo sapiens
cgttcggccgtcaggtaagctcgagctgggcgcgcgggcttctccgggtcgcaggcgggcgggcagcgacgcagaggaaccgcggccgccgagtgtttcacggccaggtcgtggagccctcccggaggtccgtgcacgctgacctggttttggcatcctggacccgtggctctgctcaattattgtgggatatagagttgacattttttttttttgagacaaagtctcgctctgtctccaggctggagtgcaatggcgcgatctcggctcactgcaacctccgcctcccgggttcaagcaattctactgcttcagcctcccaagtagctgggattacaggcgcccgccaccatgcctggctaatttttgtatttttagtagagacggggtttcaccgtgttggccagtctggtctgtaacttctggcctcaggtgatccacccgcctcgaactcccaaagtgctgggattacaggcgtgagccaccgcgcccggcctgagttgactgttgaacaagagtttgaacttcacaaggaagataacatgtacttttcattaagaggaagcggaatcagcatagaggtctttaggcttgagcccagttccacgggccgcgcccgctgaccccagcgactgccaggtgttcctggcggagggagcatctggacaggggaggctggagagcagccagagcttgggcttggcagggtggccccagggcgacaatcgatgacgctggagaaggggttgggaccgatgtgaaggttttagagcaggggttccccaacccccggtaccgtcccttgcctattaggaaccaggctgcacagcaggaggtgagcggcaagtgagccagccagactgtatttacagccgctcccttcgctggcattaccgcctgagctccgcctcctgtcagaccagccgccttagattctcactggagcgcgaaccctattgtgaactgcgcctttgaggggtccaggttgcgctccttatgagaatctgatgcccgatgatctgtcactgtttcccat

SEQ ID NO: 27070 - DNA, 1028 bp, Homo sapiens
aggaaataaatggtagcatggatgaggatgtttacggtgacaggaaataaatggtagcgtggatgaggatgtttacggcgacaggaaataaatggtagcgtggatgaggatgtttacggtgacaggaaataaatggtagcgtggatgaggatgtttacggtgacaggaaataaatggtagcgtggatgaggatgtttacggcgacaggaagtaacaatagtcctttgggtgtcttctccctgaagcttgctcctccatttggcccactgtgtgaacacccaccttcaccacgtccttcttgtttgctttcatccttcggtgtttttccctgttcagtctcgtcctgcagcacccttcacatcgtcgccacagccatcttcctaaagggcatgtgtgtccatggtcacaccaagcccgttcacaccaagatcgtgaacatgcctgatcacgtctgaagggcacgtgaccctgttctgaagtggcctgcagctcccgtggccctcagcaaagccaatggacgtgtactctgcttcctccaggaagccctccccccgctcccccctctggtagacacgtcttgtggttggtgtccacaaggaagttcctgattagcctcggagctgcccgatggcctctccactcctggcacatggcctgctggctggcctggggcagaagtgcgtggaaatggagggcgtgtttgaggggtggagtgaccctcctcttgggaaaccactgcctggcctgtgtgctggtcgggaagggccatggtgcttcccatgggcgggcttggcaagcctgcgctgagtgccgtggcgtcctgatgcctcctcctcctcacagctacagagggccggagctggagatgtggtctctgggagtcactctgtacacgctggtctttgaggagaaccccttctgtgagctggaggagaccgtggaggctgccatacacccgccatacctggtgtccaaaggtgagcgtgagctgcaagtggtagacagtcgacactgtccttagagaccag

SEQ ID NO: 27071 - DNA, 1046 bp, Homo sapiens
atgatttttggcatcggtattgagatatagttcacataccatataattcacccatttagagtgaacagttcagtagattttagtatatacagaattgtgcaaccatcaccacaaacgaagaacatttcatgacctcagaaagaaacctcatacccatcagtagtcagtcgcataacccccgtcctgctcgaatttcctccatcccatcctgggcaaccacaaatctactttctgtctcaatagatttgcctattctggacacttcatataaatggaatcatgcacagcatgctcttttgtcactggattctttcatctaacataatgttttcaaggttcatccatattgcagcatgtataagtacttcattcttttttatgaccgagtaatattccattatatgaacagacaccatattttgtttatccgtttatcagctgatggacatttgtgttgtttccattttttggccattaggaataatgcttctatgaacaattgtatataagatttgtgtgaacatatgttttcagttctaggcatatacctagtagtgcacttcatgggtcatgtcgtaactctgtgtctaatgttttgaggaactgctgaacagttttctaaaaaggttatactgtttttacattcccatcagcagtgtacaagggttcctggtctacatatccttgtcaacacttattattgtcttttcatttctagccattctagggggtgtgaaggggtagctcactgtggttatgatttgcatttccctgatgactaatgatgtcaagtgtcttttcatgatcttattggctgtttgtaaatcttctttggagaaatgtctgttctgatcctttgcccattttttttttcttttgagacagagtcttgctttgtcgcccaggctggagtgcagtggcacaatcttggctcactgcaacctccacctcccaggttcaagcgattctcctgccttagcctcctgagtagctgggatcacaggtgcacaccaccaggcccagctgatttttgtatttttagtaga

SEQ ID NO: 27072 - DNA, 1027 bp, Homo sapiens
acgcccggccccctggcccctggccccttctgtgtgggccccatctgagagccatttcccaaatctgagagccatttccctagtcggctgtgaaatcggatggtgtttgtagtcaatcagttgtttttttactgttgtggagtttaccagggactctccaatctctctctcgtttcctctcacacctcctcaaggcagcagcacggacttccccttgcaggtggggccgaggctaggctgcacggctgacggggggtttgggggccctgagatgaagcgagagcgctgaccaaagcattggcaagttctcctgtactttactgttgggcttttggtagcattctctgcaaaatcatttctaaatgtggacttaatttggagaaatttgagactaagtgctttattttttaacttggtcacaaaatttggtctttttcttgttataaattggtggcattaaatgctttgtacttagttctaatggagaatcggtgcaatctctccttttgactcatctgtggccctacatgatggtcacccatgtcattatccccagggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatga

SEQ ID NO: 27073 - DNA, 1106 bp, Homo sapiens
gcccacgtccacctactcttctgggtactgaactcctctctgggaggctttgcctctgaaagacttcttcactctgcttggtagggcccggctctgcaggtgcctcctccaggactgacatccttgctgtgttctactgcactgttcaccttgttggcctcatcctgaaactggttctcctttttgttgtacagctgtgctgacagcaatgggagctgtttgcttcttagcttatgttctggtgggagggggacagttgcttctagaagttcgccgagatgctccctgcaaagttgtccttgcttctgtttggtctgaggtggggtcacttgtgtcttctggaatcaaaactagcaatgggaatatggttactcggtggcaccattaggtgctgtctgctgggtttgggttcccgtgtctgcagctcacagtggatacaaaggacaattttaaaaatttgggcctggacgtgcaggtatttctggttaacgtctgagtcaaaatttagtgatctaaggtcatgtgaagccagactctgttctttcttgaggccaggctgtggctgtggagtgcacgggaggctccaggggcctatgctgttcagtgacaaactggcccacgtggacttcagatgcccaggaggcacagcgggaaaaaggatgcatctttcctgctgtcctccccgctcccgcagagggtcccatcagtttccctcctggataggcttgtaactctcagtaacctaattaaacttccacaactttagttggtatttatttactttctcccatgaaggacaaaaaattgcatgcccttaccctccctttgctttttttccccctttccatttcatgttagttacttttacaaagaaacttctgtaacatttacaatatattctgaatagttatattacttttttattattttattttttgagacagggtcttgctctgtggcccaggctggagtgcagtggtgctgtgtcctctcactgcagcctccgcctcctgggctgaagcgattctcccacctcaacctcccaagcagctgggactaccagcatgtgccaccacaccttgctaatttttaattttttttttgta

SEQ ID NO: 27074 - DNA, 1049 bp, Homo sapiens
cctgttgactctgcctcctcctgctcggactgggcactgacttcccttcacggcgggtggccttccctctcaccacttctgggtcccagggccaatggactctttcctgttctctggggtcctgaacgtcaagtcagccccctcttcacgtaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggtgagcaggaggtggccggggcactgcccagagccatggtgctcagctttgggcacatgtcagaatctagggaagttcttcaggatcccagcatcccagcgacatctggctggaggtgagatgcaggcagtgccaggacgcagtcagcatccaggggtcttgctgtggaactagccaagagcatggcacctttctctttttcataaaaaagtgacaaagttggacttccgtgtaaatttgcagtttctctcaaaaccaaatcagagtggtacctcagacctacaagaaaggtcaaggttgcgagaggcccccaagcatgtgctatgcagtgaggacgagcatcggggacccccactaacctctagcacagggtggtcaaagggcgaatgacttcctggtaagcagggatgaaacccccccaacctctggcaaggctgacgtttgaaggattgtatgagcggagcgctgcagacgcccagcctctggcagggctgacatttggaggattgtgtgagcagagtgctgcagacaggagcaggggttctggaacttggagcagactgtgctggggtgctggtttgctaagggggttggctttccactcctcccgtgagcacgtcgagtctggtgaatggggtggagctcgtgaacctcacatggtgtcagtgtacccctgcgtggactctgggttgtctcctgcagccaggtcatacctgtagcctttggccatgggtgttcaggggctgtggctgccccctctt

SEQ ID NO: 27075 - DNA, 1124 bp, Homo sapiens
tggtggggaggcgacctgtgggatgcgggtcggttgcctctctctcacttgctctgcatttgtgaaacaaaaggtatgccctccactctgtgttatcagatgcccgccctccactctgtgttatcagtcttggttgagctgtttgggcggcaggtggccctgcagcctgctgagtgcacatagtgtcatctctctgggcatccaggaagcatgtcacacacagccattcaagcccctttgttttcctgagaatacagggtgttttgagtaggaaactaataaactcatactgcactctgtctatgttttacacttcagtggttatttaaaactttgattttgatagaatttcacagaatagtataaagacacatcctgtggcaccagtttcttttctcaacttctccccttttacacacgttttttttctgaatgtcatttttagacatgtccctttattcatggtgggtattttcttagaacaaggacattctcttacataattctagcacatttatcggaatcggatttaacattatataacagtagtatctaatatgttgtcggtattcaaatttgccagtttttctccttcagaaacacctacttccccatcctaggatcacccttgatttcaggcaggcgtctgtctggtctcctgctcatttatttacatcacacacctcctgggttctgtcttagtgataattattgttgtgtctgttttgtgacacttattgttgtggtgtctattttggtacacacgcggtgtcccagtgtggcctgtaggagcccctccagctgtcttctgtgtcctgttcacacgcctcttcacttctggggctctcgctttctggcataaggagctggcacaggtttaccttggccttgccctttctgtctcccctagacctctcaccccccttcccactgcctctcctgggtggggctgcgtgctggccgccttccctgatgagccctgcctcacagtcaagcctcacttgtgcagtgggtctgccctgtgttcctcccatgaactaactcatctgatctcactgaagcctctgctgtagttagttgctgttagcttcatcttcaaggtgaagaagggagacacagagctc

SEQ ID NO: 27076 - DNA, 1050 bp, Homo sapiens
agaggcacagaaggagctggaggccttgatccaaaacctggtagggagcgggcctcggcggccgactctgctggggccgtgatggggtggcttatcttccatctcttcttaacactgcaggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggtaggcacttgggtgctcggggaggggttctcaccccccagtggccactcaccgaagccgtgtatgagtgttcgctccaccctgtagggaggtgactccctcatacagccctggaaggcttcagaaggggctttctggtgctcgctcttctttcctcagcctgtctggcctccttcctgatagttggtgagaattctgcctgcgagaagcacttaaaaaaaaaaagagagagagaaggagaagaggagaggggagagagagagaggaaagaaagcaagagaaagaaagaaaatgcattctgtataagggatcaggaaaaatgaaaatgcagtctaaggggtcagctctcttctcccctctgtgaaggaaagaaaatcgatttgagggcatccacgtgaatccatgggaagtcatgagaagacgtggtctttagaagcagtctttagagagtgtcccctccaggccactcccctgccagggccttggattccctttccctaataatcaagtctgatgcctcctcatggagtcagaggctaccccaggaggtcccactcctttggctgaattggccaccctccagggatggcacctggccttctgggacacatttcagaggaggcccacccccttagacctgtcctgctacctccctcctccctgcgcctggagccctggactcgggagaaggggagcatctgtgccaagtgg

SEQ ID NO: 27077 - DNA, 1091 bp, Homo sapiens
ttgagttgaggggaggagcgatattggttttctccatgagtttctttaaattcattaattctttgcagtgttctaatctgcctcatttcatctaatatcattttcattttagatgttgttttcttccctagaagttcactctgaattagtatcttctgtattttcagttcttaacatgttcagtctttctgcttttggccatagacaatacagttaaatacctgtttttctgtccttggctggctgattctaacactgtcatttctgggtggttttctattttcttttcctcgttatgggttttccccctattctttgcatttctggtgtttcttaatgagggtgtttttgtattcctctgaatattattttgtgtttgtgaagtcactctgaaacattttgctccttttaggacttgcttttaacgtttattagggaggatcagagcagtatttagttcaggcccaaatatttccactgctgagataagatccttctgagtactccacgtcccagaaagttgaaactgctgaggacggttctggaccaggctccgactgagctgcaggcactgtttcctggtgtctgagctgtaggtactataccaggccccgactgagctgcaggcactgtttcctggtgactgagctgcaggtactgtaccaggccccgactgagctgcaggcactgtttcctggtgtctgagctgcaggtactgtaccaggctccaactgagctaaaagcactgtttcctggtgtctgagctgtaggccactatacccggccctgactgacctaaaggcactgtatgaggcccagctgagctgcaggcactgtttcctgtgatccttctggggattctttcccaggcccagggtgatttcttcacgcgtatcagtatatgagtggctggtctccggatctcagaggttctcgatgccagtctctttgggctctgatctccggatggttctgtttcctcaccttcccgtactgtggcagcaacttggggcagctgtagggctcaccttgtttcctgtctccagggtcttgaaagtcaccattaggcggtaagttcagtccagtccctg

SEQ ID NO: 27078 - DNA, 1045 bp, Homo sapiens
gtaatttgcaacgtaagttagttgttggacaaatgatctatctcacttaccctcatgacaaacctctgaaggtttgtttgcaaataccagtgctctgtcgtgttcatgctacccttaggggtagaagggatactgtattttactctctagcacaggtggtgaatcgggctgtgttttttgtctttaaggtggaaaatagctattcaatttctgttccgatcttcaaacagtttcacaagaatatcattgggaaaggaggcgcaaacattaaaaaggtgataacttgtccgctgcatcttgcttcttcttgccttgtcctctgtagccctgcaccattttggttttagactaggagggactcttccttacttctagccctgtgctcaactgtgtctcaactctgggagagctctagtcagcttctcatggtgatctctctccctgtagattcgtgaagaaagcaacaccaaaatcgaccttccagcagagaatagcaattcagagaccattatcatcacaggcaagcgagccaactgcgaagctgcccggagcaggattctgtctattcagaaagacctggtaatgggagatgttttctaatggagatcctccagtaaaatctctaacagcctctaagattgagcctggggttgagtcacgcagggtcattgggccagcgcaggctgatgtggaagattgcacctttcaatccaggctactgatgagttggtcagcagttttctgcctttgtctctcacgatacttacttacctggaccctgcagcagtaacatttgacgtgggcacttgtcttattagacattttcttcttgttacctgaaaatcttatctgaaggtatttacggtattttctttcctttaaaaaaaattgacatgcagtaaattgtacatatttacagtgtacaatgtaatagttttgacgtgtgtatacatccatggaatcattcccaccatcaccccaaaaatgtcccatgccattttgtattacagtctccctccatcccacttggcagctcctgaaaacc

SEQ ID NO: 27079 - DNA, 1035 bp, Homo sapiens
ggagcatgtcgcatgtcgcatgctttatgttagtggcttctgtggggcaaacggtgtccttagtgagaggcaggattattcggccacagtatttagtttcctgactatggctccctaaccctccctttcaactttgtttgatggctgtggatatgtccctccctccctcacatctatgtgaagcagtttgggatcagaagccgctccgaagagagctcccactgggagctcaggggctgcagctgtgccattctgttttagctatctctttggttttggtgtggtaggttcacatcgagttcacagagggcgaagacaagatcaccctggagggccctacagaggatgtcaatgtggcccaggaacagatagaaggcatggtcaaagatttggtaaggtaccccttggaatgttgtgtgtgctggtgacaagggaggctctgagttgggcatgggcggtcatctctcgatgacatcccacatgtccgggcacagacacccagggcatcctagctgggtgagtaataggttctgaaacaaccagaagctggtcgaagtcctggaataatcgtgggtggaggaaacttcatcttgaagaaggcatctttcaggggagatgcaggggcagtctccaacaattcctgacagctgagtggtcagaaaaggcaaccgtggagactgctgggttttggttcagctcattggccaagtaaccaggcgcatccatggacctctgtgctcctcctgcagattaaccggatggactatgtggagatcaacatcgaccacaagttccacaggcacctcattgggaagagcggtgccaacagtgagtgaggctgtctgttgcggtggggccagtgtgccctgagacccttgtggggggtgtcagctgtgagaactgtgacgtccgtgcagacagtccaggcccattgctgcctgtaatgggagttacagactttacatcctcctgcctgctggaagaggccacttttccttttccctttggtgcagtggttggattagagctgcttgg

SEQ ID NO: 27080 - DNA, 1726 bp, Homo sapiens
acgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggtacacgatttagaggaggcaaatccccatgggcaggaatagaaatgaggatttgggtctggagattcagttaaggcctggttctgccccttatctttttgtccttgatgaagatgcttattgtctctacacttgagtgacccgggtgagatcggtgcccgcccccccttgctgttgagcatctgcctggcagttgtccttgccgtcctgggcctctgactgtgctgacaggctgccagctgggctgccccgggtcagatgcacatcccggacttgttcacgtcttagattaagctgttagctcagcttagtgaactttgaggtctgaaacgtgttccttaattgagggaaaggattgggtgttttgcagtgttcaaggacgaagttatcagccggcgggtgactagactgaggggaaaaatccagtccttgaacagtgaagtttctggggattggctagtcctgatcacttgttgttcacttcttgggatcagcatctatagtctgggccgctttggcttgctttctgcagcagtggccatgcccacctgcccgcttcccacacctttccctttgactgccccttatggtgctcttatttagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggtaactgcctccgagcatgaagtgtgtctcctttgagtggagtccgcggggccttcatggatgagctctcgatttgtaaatcctggggcctggacacagtgcaggtgcccaggtttggggagagcgtgcctctgagccccaggtgagcagcctggctttcactgtgacacgaccttgagctctgcaaacccatggctgttctcccattttcttaggccaatagcttcaccgtctcctctgtcgccgccccttcctggcttcaccgtttcatcattggcaagaaagggcagaacctggccaaaatcactcagcagatgccaaaggtaaggacacgtttttcacctgttgtattgaatttgtcttgttttctgtctttctgtttctgatattgctttgttgacctttgtactgtggatgcccttgaaaactggtgtatttttctgaattaactggcctgtttgacatggtcaacttccgtgttagcttaaagaacagcagaataaatgtctgtagatgtctgtaccatccttctggcctttaaccagagaggattgtatgttcttaggtttcataagtatcttaagaaacatgtcatttagtaattatggtgaaataacttcatgatactttggcgggccgggtgcggtggctcatgaggtcaggagatcgagaccatcctggctaacatggtgaaaccccgactct

SEQ ID NO: 27081 - DNA, 1010 bp, Homo sapiens
ttacaggtgtgagccaccacgcccggcctccacggcaatcatttttaaccttgtatgttacagtggaaaatcagagtttgcttcaaaggcaattctcacaggtggtgctgggtaggaccattgttttgcaaatgcaggggtctgctctgtgcctggcattgccatagttgtgatttttttaagtgtgttattagactctagaggacttaaaaattgacgtagcaaggcttgctttcaagggactcaccccgttaggggagtggggctcacaatgtctgagctgatgtttaccaaggaggccatgtggatgggggtaggttcgctgtcagagactgggagtctctggcctcctctagctctcacactcagggtgctgggcctggtgacctcctggggccttttcctatcactatgaattagaagagaggggtggggggagttgtccttggagcatttgatggttcttgtttgtctgtttttaagcactaaaacccttaaaagtgtttttcatgtaatgctaaaagtagtgcttccttttaatctgtgttggctggtccagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtagaaacaccattctttcttttaaaaattttatcatgtaacatgtctatgtaaatttttaaattttttttcttttttttttttttgagacagagtcccgctctgtcgcccaggctggagtgcagtggtgcgatctcggctcactgcacgctccgcctcccgggttcacgccattctcctgcctcagcctcccgagtagctgggactacaggtgcccgccaccacgcccggctaatttttgtatttttagtagagacggggtttcaccatcttaacaaggatggtctccatct

SEQ ID NO: 27082 - DNA, 1076 bp, Homo sapiens
aacttatatagtctttaaatttttaagttgagttctaattgagtggtggtctgagaatgttactatgatttaattctttactatttgtttaattttttttttttttttagctcctggccaggttttatggttttttaaaaaggtgtcacttttaatcatgtgttcaataaagtagatttattaattgtgtttgcatcctctatacattttccaatcccataacctgtgttaccaagagagttgggtcagtctcaccctttaaccttggatatatcaatttctcctagtaaccttcagtttttactttatatgttttgcagctatgttattagatacatgtaatcagagttactgaatttttaagttcttgaccttctctgttcttaataatgatttttatcctacagtctgtgttatctgaaaataatataaccaactttcatatggttagtatttgctcggagtacttcttccatctctttatttcagcctatatgtctgtatggtttaggactgttgaatggcctatagctgctgttagagttggtcagtttagtctgttaacacgtatttagattactgatgggtttgaattcattcctctcatcagttttgtgttttatttaccttgctttttcattgcttcttttacttttcttgcctcctattcttttttcttgttttctctcttttctttaacaattattaatacagtataatgtaaccagtaataatgtacatcgtaatgaataccgctgaacctaccacctaatccaagatctagaacattgccaataacttccatttgagtaagagtttagtttgaatgttaaaaactctttgtttttcctagattgtctttaaatttttaacattcattctcaacaagggctaaaattagtatctctagcctctccccaaataataagaatcttgaaaccttgcaacttcatatcccccttccaccttatatattattgctgcctaagcattttaattctgtcttttattttattttgtacttgcatattctgcttacgtacctatctataatttaattcccttcaaattttatt

SEQ ID NO: 27083 - DNA, 1049 bp, Homo sapiens
ctactcgggaggctgaggcaggagaatggtgtgaacctgggaggcagaggttacactgagcagagatcatgccactgcactccagcctgggccatagagcgagactctgtctcaagaaaaaaaaaaaaaaagaagccatctagctatcaaagtccttagatggcatcttcttgcactatgaggctgtctcatttacactgaaaatctgtttagtgcagctactttcatcagtgaccttagctaaatcttcataactcactgcagcttctacatcagcacttgctgcttcaccgtgcactttcatgttagagagatcttaaacttcaagaaccaacctctgctagcttgagacattttttcctgcagcttcctcacctctctcagccttcatggaattaaagagagttagggccttgctctggattaggctttggtttaagggaattttgagactggtttaatcttctagccagaccactcaaactttctccttatcagcgataaggctgtttcgctctcttaccatttatgtgttcactggagtagcacttttccttcagccttttttctttgcattcacagcttggctatttggtgcaagaggcctagcttttggcgtgtcttagcttttaacaactcttcttcacgtgccttcttaatcatttctagcttttgatttaatatgagagacgtgcagctcttcctttcacttgaacacttagaagcaattgttgggttattaattggtttcccctcaatattgtgtctagggatcgggcggcatgaggagagggagagagatgggagtggccagttggagcagtcagaacacacacagcattgattgattaagttctctgccttgtatgagcgtggtttgtggcactccaaaacaattacagtagtaacatcaaggattacagatcaccataacagatacaatgacaatgaaaacgtttgaaatattgctagaattaccaaaatgtgctgttggaaaagaggcatggaaagacctgcagagttgccaaaaccttcagcctataataaac

SEQ ID NO: 27084 - DNA, 1049 bp, Homo sapiens
ggctcttcatgtaccttccctgccccagacctggattctgccttttcttcaagaaggcctgcttcccttttatggcagttggctctcagagaaacagggtctaggcaccagctaggttgctggagtgttactatacccaggccctctcagtcaacagagtatgtgtatacatacatatacaaaacatacctacagctacatgcgtgtgtatttttaacacagtctcattttttaatatctccatgtattgaaaagcatgagtttattccagtacccccatttccaatgtagtagcacagggtttattctagtttctcgctttccaagtggataactccgtttcccaacagtgacaatcttagatcccagtgtctctaatatgtttacttccttgattattcaccctgtatggaacgaggctcctcttgttgaccttcctgcttggatgcccgctgcctcctcatctcactcagctgctgtcatcctgcacctccacccaccatgagcatcttcctcactccacttgggctctgataccctagctatgtagatattctcttatgtggaagcccgtatccccagtttaaaaacaaaaaaagtccaagtcctacacgctctctttttgcagcttgatcattttcatttaatgtacagtagtctgtgctttttccagactgatacgtgagccgttggattcttgttggtaacagcgccttactgtgtggtgtccttgtcccacttagtatgactgccttcgtgctgacgcacactcgtgttcttccagttctttgcctgtggcatgctgttgtgagcctcacctgtcacacctatgcttctgtattcttttgcaggcacttctggagagtagcatttttgaagtgtgattgctgacttagattgtatatttctattttttgttatgtgtttctaaattgccttctaattttatacttcctcaatggttgagtagtcttttttccccctcaccattataaacactgaatgatcacttttgttcatctttgcggatctcataaaggctgcatgaa

SEQ ID NO: 27085 - DNA, 1849 bp, Homo sapiens
caacctgtcctctgagcatctgtagcagtagtgtggcaggaggggaagatgggcaaggccgagagagccctttcctgttcagggttcttggcagggatgggaccggtggggcctgggccctggctgactccggcctgtgactcccaccctggagcatgcccttcctcttgctgccaaatgctgatgggtttgtctccggtcccagagcaccaagctatggatcatcatggagtacctgggcggcggctcagcactggacttggtgaggcataggccatggcagtggggggtcatgcagtgtccgagtcccctgcccctcagactcatgggctccaggggccacctctcgtttggtgtcatggcacgttaggtgttaattaggaatcgtctaaagcaaaaatgaactgccatctgcacgtctgcccagttggtgctgaaaggggtcctggcctgtgggagtgggcgggggcaggcctgctgggagatggctgggagcctatttttctgttacatgacagtaaggtgaggctggtttatatgctttagaaagagcctccaccaccccactcccatctgaaacttagttctgtttgggaagtaaaggaacacgaagcccccagctatctgcagggacagcccttccctgtgagagaggcagagaactcaggcattgggcctgggacaggagctgaggccctgctgtcgcaccttcctctccagcttaaaccaggtcccctggaggagacatacattgccacgatcctgcgggagattctgaagggcctggattatctgcactccgaacgcaagatccaccgagacatcaaaggtcctgctgggggtggatgtggctcttgtaacgtcctgagccccactgaccttagagaggccggggcctgtgaggggcaagtggctagtggtgcccagggtctggagtatagagaaccttgtggccaccctgaaactgagcagtcctgtctcgctccctttccagaagatactacttgtaacggtttccttgtacgctgaggaaaccagctgtggactgagtgtaggaaagggccacacttggctggagttgttggttccctgtggtgcacggcacagcagcaggtgtagaattgagtagccccagcgtgtggtctggccctgctgagagcagacgggaggctgggccagcccatggggagggacttgccactggcaacgagccatctctgtcatgtaggggacgattctggtggagcagggggcttcctggcaggcccgtgttggctacacccttggtcagggtcacctctgcggtagcccccagtgggcgaagtcgcttgtcgttgggatttgtcgtaaaagccaaatgcaggaagagccctggagctcggagtggagccgttgggctcctgctggcagtgcccctgtggccctaggtggccctgggtttgagagtggcaaggagggctgaggtcctgaggacagccctgctgtgccctaggaggccaggtggatggtaccctggcccttctcagggggcccggggtggagccacgtggagcctgggatgacgcctgcctgtcctgtgtcaagcagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggtgggtgcagcgggcgggcaggtgcgggcaccatgcctggctcgggtgctcagggcagcaacagtccttgtgttctgtccaggctgacatctggtccctgggga

SEQ ID NO: 27086 - DNA, 1038 bp, Homo sapiens
tctgggagggaagagggagaccgttagaaagcagagccagcaccgccaggcccccagcaccgccaggccccccagcaccgtgcaccagaatatcagcaaaattgcatgaagggaatgcaggagactgttcgggaaggaggtctgtggcctggactgaaggctccaacacaagaccagacccgatgccgtgcacattcagacagtgtgaagggccaggaggcacgggaggtggggacagatggcagccaggcaggccggccggagggcccctgccgagcaggagagaggccttcatggccctcgctggggctccagacatccagaccagggtgccagctcccctcggccacctgcctgctgccccccaggggctacaggtatgccgccgtcatcctcctgtggggccttggagcctgggctaccaggaaggggcaaacccagcttcattcagactctgcctggaacaacagcagggactgcgtttccggaagcccacggactccctggactctgaagttccttctggggaagtgaatgaacgtccaattctcttattcccttcacttcctgctaatacatgaaggcttttccctgcagcctggacctgtggccttggcgttgctcaaagtgtcgtcgcccactgggcacacagtgcccagccccatgccagactccacaggaggaagacaggaggggacggaagtcttggggtttctgtgctgagggacacctgtagccatgtgcgacatcttgggacattgccctctgcacccccaattcagccttcagaggagaccacagcccccgcagaccacgtgacctcaatctctcgagatgctaaagctaaggccccagcagaggggtctgagcgctgtcacccctggccgctgatttacacaccaggccaacacccgctgtacaggaaagaaggctagactctcggcaggggagccaccctccacacccagggcccagcggcaactgcggtctggccggagcagggcaggaagttgggggcgtggagacagaggaagggtt

SEQ ID NO: 27087 - DNA, 1028 bp, Homo sapiens
caaaacaacacaaagccattttctttctcttaactcgttgccatatcagaagtctcaccaggcacatggagacgaggctacacgggtgttgggaagcagagtcagaataggtagcacacaggctgcgcagggttaacatccagggtagcaaccgcaggtaccacctccagggcttggggacaaaaagtattaccagggtggggtttcagggacctcagagcttacaggatgtgcttggttctcgcaagaggggcaggagggcctaggactgtactccaggagccaagggggcaccaagggacctggtggctgggctcagagctgtctctgctcccaaagtgatgctgaaataacctgggaacaccagggaggtcccagccccaactcctgcatccagggctccagcacacccagctggaagggtgtgtggaagggcagcactcagggcagagcacagacaagccaagagacaagaagtcaataactgacggcacagtgctgttttcacaaaatgcataagaattctgtaatgttctctaacagtcctattcgtatttcccttactgcctaagaaatatcctcacacgattggattatcaaagctttattcacgtttgtgtttggctacaaagtcttttaggatccttttgatcctaaaagtccccctcttccctcccctgtgcccttgacttgttggtgaagctggtcacttgtcctcgaaggtgtccccagtctggacttagcatcctccttgtagtgtttaacttgttcctctgtcccctctatatcctgtcgtctggaagttggatctaaagttgtggctggaatcacacccggacggtgctcagttcctcgtgtcacagcctcatgtccaattgtgtcactttgttgaagcattaataagcttggatggcgacagcctgacccctttatcgtcagtttcccctcaactgttcccctgacagttttgccacctgtgggtgaccattgctagaaccagaaccttcactgggactgcagaattctcg

SEQ ID NO: 27088 - DNA, 1109 bp, Homo sapiens
gtttgtttttgatttggggtttttctttaagagagggtctcattccatcacctaggctggaatacagtagcaagatcttggctcgctgcaacttctggctcccaggcttgagcgatcctcccacctcgccctcccaagtagctggggccacaggtatgcaccagcatgcccggtttttgttgttgttgttgttgttttgttttgttttgttttttgtatttttagtagagatggggtcttgccacattgcccaggcaggtcttgaactcctgaactcaagcagtatacccacctgggcctcccaagatgctgggattacaggcatgagccacctaatgagcacggctactttatttgtagtttttgtagagacaagcttttgccatgttgcccaggctggtctcgaactcctgggcttaagcaatcctcctgccttggcctcccaaagtgctggaattacaggcataagccacaacccctggccagaacattttttataccccaaaaagacacctggtaccctttagctgtcagccccaacttccatctcccccaacccctggctaccactaatcttccttctctgtagattgcctgtcctgagcatttcatagaattggggccatagactgtcacttagtgtaaggtttccagagtgtatccaacttggagcatgcctcaggcctcactccttttcatgactgaattattccattggtgatgtgctgtattttgtttatccattcctcattgatgggcaagttgttcgttactgaatcttggctgttaagaagaatactgtgcctcgcgtggtggctcacacgtgtaatcccaacactttgtggggctgaggcaggagatcacttgagcccaggagttcaagaccagcctggacaacatagcaaaacctggtttcacaaaaaatacaaaaagtagccgggcttggggaggcatgcctgtagttccagctacttgagagggtgaggtgggagaatcgcttgagcctgggagccggaggttgcagtgagcagtgattgtgccactgcactccagcctgggtgacagagtgagaccctgtctcaaaataaatacatgaaataatactgaat

SEQ ID NO: 27089 - DNA, 1063 bp, Homo sapiens
cctgaatgtgcaactgagacacagagtggtaaaaatgatactttctggttctgttatatttttggagatattaagctgaccaccaaattacaggcttgttaatccaaacataaaaacaaatgcatgtacttaatttatgtatcaaaattaatcaccctggccagtgcggtagctcatacctgtaatcccagcactttagaggctgagtcaggaggattgcttgagcttaggaattgaagaccagcctgggcaacatagtgagaccttgtctctactgaaaagtatttagccaggtgtggtgacacatgcctgtagtcccagctactcgagaaactgaggtgggaggattgcttgaacccagggagggccaaggctacagtgagctgtgatcataacactgtactccagcctgggtgacagagtgagaacctgtctcaaaaaaaaaaagaaaaaaattagtcacccaatattactgaaaataatagtgcatgtttgtattttacacgtacccctgagctatttggggtcacaaggaagctgttagtatgtggttctcatattcttaccgtacaagaaagcaaaagccccttgaggtccctcagtatcccttcccaccacctgctccccacaggtggagaaattgcctgcttttagggagatagcagtgtaggcctctgaagtagaggagagccaccagggatggggagtggttgaagtatctttattttttaattatagaagtaatacacagtttttttaaagtttaaacaaaatataaaaagcaaaccctcccttagtctccattacacaactatatgttaagaatcttattaaaccaacttggtactatttgtataatgcctagcagtttcagaacggggctgggcacctggctctcagacccccagctctgagaccctccatccccttttagaagatctcattgtttttaaaaatatctcctacctttttatattattattgattgaatgcatgaggtcaaagtaatacatctgcacataaaccaaaaggtgagaattctgggtaatacaaaataacccag

SEQ ID NO: 27090 - DNA, 1031 bp, Homo sapiens
tttgtagtacttttttcccccgttttttgaaagagggcgtctccctctgttgcccaggctggagtacagtggaacaagcaaagctcgctataacaactcttgggcccaagtgatcctcccgcttcagcctcccaaagtgctgggattacaggcgcgagccaccgtgcccggccacgccctcactttttaattctgccatttcttcatgtgttagcttgagtccttcccctctgaagtattacgttgtataataaggaggacaagactcatgattcctttgcttcttcctgctgtgcggatcagctgacagagccgcaggctctgtgggaggttctcgtggacgccttccctcagctcattgtgctgttgtgtgatgtgtggcctgcagtcacagcctttctggtcctacctttcctccggaaacaggacagcatttggagggagatgggatgagtaagggagggagagagggtgctggcacagccctggcaagaagggccagtggatgagactaggctggcacataacaggctctaggagtgcctgtcttcttcctgctcttccacgggagaggagaccctggcgtgtgtgtggcagaaaagacactgccaaggacctcgtgcctgtgtccggacccagctgctctgtgctgcaggcgttctaggccgggggtctccaggggttctgtacatagactgtttgctcctggccagcaggcctgtagctgtgctgggagggcctccatggggcctgggctgtgggtggcggggactggcagccgttctatctacctacttttctgtccacttgtctgtttacaaaggaaaaacaaaggtgacactggagaaaccgacacgtttgaggttctaaaaattaaacgagccacaatataaacagtctcacatcttggtacctcaccaaatgtcccctcattttttcctgtttttacgactttcgaaacaaaaacctagactacactaagctttaactgttgggttctttcttggcagaatttttccctagattggtgt

SEQ ID NO: 27091 - DNA, 1045 bp, Homo sapiens
tgaatttatgttcgtggagggtatacggtctggtctagatttattctctttcatgaggatgtccagttgttccagcagcgtttattgaggaaaatgcctttgcaccattgcatccctctgctgctttgtcagaggccagttgactccttatgtgggtgcccctgtgatttgaaggccccagtgagactggctgagtcgaatgaatcggacttttctttctctgtcttgagcagtgcttctcactagtgtcaggccccgtgtctttgtacatctgtgatcttggcagctgtagggatgatggtggacttgtggtatttggctgagaacatccttgcagtccaggctaggggtcatgagcatggatgagtcacctgctggctgtgcccacgcttcccccgccaccatcctctgctctcttctttgcctgtgctttcttcttcctcgacagggtagagctggcctctctgaccaagacagctgacagtgcatctcctttcccctgccgtgtttctggaacattgaactttaccagttgtgtttgttactatttagtaaggttatcttctccatgttgggttttgctggaggtgtgggtatggcatcttctagagaagatccagacctttttggattaaaagtaaggttacaaatcactgtgctgtacttgttgtcatatgagatttctgagttgtattgttgggataattttctttttctttttttgagatggagtctcgctgtgtcacccaggctggaatgcagtggtgtgatctcggctcactgcaacctccacctcctgggttcaagcaattctcctgcctcagcctcccgagtagctgggattacaggtgcctgccaccatgtccagctaatattttgtattagtagagacagggtttcaccatgttagccaggatggtctcgatctcctgaccttgtgatccgcccgcctcagcctcccaaagcgctgggattataggggtgagccactgcgcacagcctgttgggataatttaagcttgacagttcaaggcctatgaaacag

SEQ ID NO: 27092 - DNA, 1655 bp, Homo sapiens
atttactttatttttaaatttaatttttgtatttttagtagagacagggtttcaccatgttggccaggatggtctctcttgaccttgtgatccactcgcctcggcctcccaaagttctgggattacgcaggtgtgagccaccgtacctggcccttttttttttatttttaagacaaggtattgctctgtggcccaggctggagtgcagtggcacccgatcatggctcactgcagcctcaacttcctaggctcaagcagtcctcccacctcagcatcctgagtagcttagggccataggggcatgctaccaagcccggctaatttttttttttttttttaatgtagagtcaaggtctcaccatatcacgcccaggctggtctcaaacccctggcctcatagacttaatgttttaaagatagctttaggtatatagaaaaactgatcaaaaagtagagtatgtagagcgctccctacatactacccctgccttccccccttccccattatttatgtgctgtgttatgttacatttgttaaaattgataaccaatattgatacattagtaactgagtttatatgaactctcctaccacctttttttgttttacatcattgtagtaggtttcctcttcattcaacacttaatgttgatgtgtgttctttcaatgtttttatttacatttatatacatatgtagaaactactatagttagaattttgttttttaacataaatgaggtcataccatacaaattatttggcagctttctttctaactctgccttacagatttctgcacttacagatcccctaactctgcccttctcattctctttaattgtcgtcgcattgtctctagaaccacggtacgtgtagccagttccctgctggtgaatcttcagtggttcctcatcatccgtgttacatgaaacactgcattactctcctccggcttagctttgtgtcttgcttggaaaggctgtccccactccaagtcttaaatgaaaatgagaccatttttaataatctttttaacacatctagaatttatggaggcaattgttcttctgattttgctttttgtggctttgtagaaaagtgatgaaacacgtatatgcccaatttaaaatgaagaataatcctgattttactttttagataataatcttatcccaggtacccagggctacgtctcttgtgtccatctattctcctacaggttacttgtttccctaatagatatttaagtttcctctatgtctaactgtggcttgatagtttttttttgttgttttgttttggttttttttgagacaagagtctcgttgtgttgctcaggttggagtgcagtggctcagtctcggctcactgcaaccgccgcctcccgggttcaagcatttctcctgcctcagcctcctgagtagctgggattacaggcgcgtacgaccatgcacagctaatttttatgttttagtagagacagggtttcaccatgttggccagggtggtcttgaactcctgacctcaagtgatcctcccacgtcggcctcccacagtgctgggattacaggcatgagccaccatgcccgaccaatagttcatgtcttttttgccctaattaatagtcccttgtttggatgtaccatagttcat

SEQ ID NO: 27093 - DNA, 1075 bp, Homo sapiens
ctaaaaatgggaaatcagtttaattattccaagtaatgattggcgtatctctttggcaaaatctttaccaaaaatattgagtcctgtgaagagaatggagaataagaaaaagtggttgaaaaggttgaaaatggcttgtctgatatatcttattttaccaaagggaatagagataagatgacctgcctgagttcgccagccactaataaagaggcagagccagggctggggtctaggtgtccttactccctgcacagtgctctggctgtgatgtaaacagatgtgatctaaccacctttccatggtggaaagatttaagaataagccctggtcagaagtcaagttgggaaaaaattttagacctaaagtaaatagtaattctcagctttattagacccaatgcccatttcaaaacaagtattctgtgaaatatcccttactatattgaaatggaattcataggtattctaacttacctcatgcacatttcagaggaaatcagtataaagtcctaactataacataaattagaaaaagagagtaattgataagatgatgatgtgtattccatgcgtaggtgcctgagtacactggagagcatggatgtttacacctgtatgtggaattatcttgaattcaacagtgacaaaggctgttgtatatagatgtattatgtcaacaactcaaataccacaaaactctgttgctgttactaacatgacttttttgaaatggtaaacagctgttaggagaattgcaaacaaaatagtgattgaatattgtttcttcagttataccatagttacattcctggaaaaatgtgcttgttttaaagtagtagaaaaaaatacttagtgttcatatataaaatggccttacattcagataatttatttaggctttacacctccatgagtatctaacaagacatttgaaaattgtgtgggatgcaggtcattcttcatttcgtgaaactctactatgaattgtagaacatccagcatctctggtctctgcctgtaaatgccaagaacgccctccaactactatgacaagcaaaaatgaccccagggct

SEQ ID NO: 27094 - DNA, 1047 bp, Homo sapiens
ctggtcctctatctctggagtttaccccacttctgacagtaccaccactcagttatttttgtctgatgccaagattactggcttttttcaagcgcatattttctttgctctgtgttttcacccattgcttggacctgtgcattgtacatttttggtgagtcctctattcagcaaatgtttttctctgtgggttcagggatcctagggttgggcccctgctttagaggcatgcacttcccctgtggcatgggaaataggtgagttagagagataattgctgttacagaggttagcacagagatacttcatgagtatcctgggaaaggctacttggaagtgctgcctgagttgtgtcttcaccggaaagggaattatttcttaaactctctttctgccttttcatgtgtctgaattactacgtaacagatttttttttttttttagggagaaggttgttccaggctgaggaaacagtaggttagaggcatcaaggtctaaaaacatggggctgtccctgaactttagctggacaaaaatgatttgtctggaatcctagcatataccagctgtggagggtggggccagatttggggaagcccctgatgtgaagtacacgaatctccctgtggacagttggaaaccactgaaggattctgagggcaacagtgcctttggctaaagagcctggtgggttggagaggatcaggcagaagattgagcttgtccctcctccatatcgctctgaaggaaggacttggttcccttccttccctgccccacctctccccccacgtcaaggagagtattttgcggcaattaggaacacaggctttgaagaatgatcagctgggttcataccctgagcttacacctttccctgtctcagcacatttagcctcttgaagcctcagttttctgatctgcaccttgggaataattatagctgtgtcaaaggttttgtaggattgaatgtgatcgtggatatcacatgttgacattcagtaaatattcagtggtctagtaactggtcactggaaaaaaatattc

SEQ ID NO: 27095 - DNA, 1040 bp, Homo sapiens
agggcccccagcgcttacctgcaggcaaggtgctgctccacgaccttctccagctgctgccgctgctgaatctgtttccctccctgaaacgtagccctgtctctcagctggcttcctgatctgggaagggtggtgcctgtcccctgttcagctgactcaccttggactgggatgggcacaggtgagggctgtggctgggtaaacaaggcaggttgccagcccagaggaggcctttggccttagtctggatttggaggtgggattaaggccctcacagctgctgttcagacggttatgaaccaagacttcttggccttttcttaaatagctctaaatttgggttggacacctagtcctgctgatcgaggcagttggctagagggcggtttgtgataggtatctaggggtctaggccaggatattaaaaagtggtcatatcctgtgacccagcatttcttctaggaatttgttacagtggagtcacagggcccatccatcactgctgcttctagtaaggaaaatgtagaaatcccaaatgcccatctctgtggtctgcttgaataaatcattgtctgtggaagatcacagagctattaaagtcacttaaggaagaaggtatgaggaaacatttctgagattctagtgagatgttgaaaaatcaatattgtgaatctcttcttgcattttgttttcattttttgtaaagtggatgtgcgttgaaagcagtctaggaggacatacgctaaaatgctgagtatctctgaatggcagcattgagggtgaggttttcagtttgtacttttgtgtgttccaaggtggtttttttttttttaagttagcttttgctctgaatgctcatgacttttgtaagggggaagcaattaagtttgattattttaatgggaatttagagtggttgtctcttgggagcagacctaaggagctgtgtgctgaggtggagatttttttttttatggcacatttttggtgtcttaaattttgaaaagtttaaatgtactacttattccaaaaataattat

SEQ ID NO: 27096 - DNA, 1032 bp, Homo sapiens
gacgtctgacattctggagtctggggccgaggctggacagcgcaacctgccactgtaggtagaattcctatgttgaaactgaatctccaatgtgatagtactaagaggtggggacttttggaaggtgattacgtcattagggcagagattaggactcttatacaagaggtctgagggaacttgtttgcccctttacgtgacgatgcagtaagaaaatgtaatctttgaagcagagagcaccttgatcttggacttcccagcctccagaattataagcagtaaattcctgttaaaaaattacccagtttaaggtatgctgttacaacaccctgaatggactaagacacagtcccaggcaggagcgttagtttccacttctgcaaaattggggcagtattccctaacctgcagaattttgatgaagatgaaatggatgagtaacagtggggaaacttctgtctactcccagcagccttctacggaaggtggacttttcagcagaagactctgcccagctgagccctatgctggatttgggtggtcaaatttgagagcaggagcttggcaaagaggggctttggggaggcagtcagtttggcgggggcatattgtaagactgtgtgcttacaaaagcacaatatattcctaagatttctttggggtgactttatttgggacagttttgggggagttgacggaggtgggggcactctggcccctgatgccttcccccattcaaacagacttgggggttcctgtggcaatgcacaagatgggggtgcaaaaagggggcaagagaaggaaggtagcatgatggacagaggctggaccagtatagtgacccccagggaaggtcccctgggagggtgcaggcaagtaggagggtactctgagaatagagtcaggttctgaagctgttgccttcctatgatgcaagcctcagctcctcctccatcctcaaatcttcagtaaacgccctctgttgacaggacattcactactgcacagtgggcactcagctgctgctttgtg

SEQ ID NO: 27097 - DNA, 1025 bp, Homo sapiens
tttcacagagcagaagtttttaattttaataaagttcagtttaagaattttttgttccatgggttgtgcttttggtgttgaatttaaaaactcatcgccaaaccacaaaccacatagattggttcctatattagcttctgtaagttttgtagttttatgtttcacatttaagtctaagatccattttgatctaacttttataaaaggtggaaggactgtctggattttcccatttgttaaaaagattctcctcttccctcttcctgcactgaattgcctttgcttctttgacaaatataatttgactatatttatgtgggtgtatttctgggctctctattctgtgctgttgatcagtttgtctgttttttcaccaataccacacagtcttgcctaatgtagatttatagtaagtcataaagtcaggtagtgttaatcctctgactttgttccttttcaggattgtgttggtcattctaggtcatttgacttcccatattaactttagaatctgtcaatattcacaaaataacttattcgaattttattggaattgtgttgaatctatagatagggttggggagaattctcgtcttaaaattattgagttttgctattcatgtacatggaatatctctccatttatttatattttctttgatttttgtcatcagagttttctgtgtttccttatattgatcctgtacatattttgttggatttatgcctaggtatttcattatttttggtggtaatgtaaatggcattatgtttctaatttcagcttccaactgttcattgatggcataaaggaaagcactaaacttttaaatattaactttatattctgtgaacttcctataatcacttattagttccaggagtcttttgttgttgaatctttgggattttctatgttagacaatcatgccacactgtacacagaaataaagacagctttatttcttctttcccaattggcatgccttttattctcttttcttgtcttattgcactagcaagaa

SEQ ID NO: 27098 - DNA, 1085 bp, Homo sapiens
tttttccttcatgtttgaaggatattttcactggataaattccagtataaaaaggttagtttttctttagccctttaagtatgtcatgctagtttctctcctggcctgtaaggtttccactaagaagtctgttaccagatgtattggagctcctttgtatgttatttgtttctttggctgcttttaggatccttttttatctttgacttttgggagtctgattattaaatgtcttgaggtagtcttatttgggttaaatctgcttggtgttctatataaccttcttgtatttgaatattgatatatctctaggtttgagaagttctctgttattatccttttgaataaactttctaccctagtccctctctctactgcctctttatggccagtaactcttagatttgccctttggaggctattttctagatcttgtaagcatgcttcattctttcttattcttttttcttttgtctcctgactgtattttaaaatacactgtcttcaagctcattaattctttcttctgcttgacaaattctgctgttaggagactctgatgcattcttcagtatgtcagttgcatttttcagctccagagtttctgcttggttctgtttaattatttcaacttctttgttaaatttatctgataggattctgaatttcttctctgttatcaacatgattttgttgagtttcttcaaaatggctattttgaattatctatccaaatattcatcaatctctgtctgagattggccccaggtgggtccatagatgtcgtccagaaggcagggcctgtagttgggaaccttaggagtctacctgatgctctattctactgcggctgagcttgcatccaagccacaagacaaagtcctttccactattccctcccctttcctcaggcagaggagtctccccatggccaccactgtcctaggcccgtggtgagtactgcctggctaccacctatgttcattcaagacccaagggctcttcagtcagcttatggtgaatgcttgtagtcctgattctctcctttcagggcagtgggcttacctctggcccagtacaggtcc

SEQ ID NO: 27099 - DNA, 1050 bp, Homo sapiens
ccaggcagaggcaatggcgagtgcaaaggtcatgtggtgagtggagaatctggcacgattgggggaaagcaaggctgtaggcccctggggccactgtaaaaattctgggtttcactctgagtgcagtgggggctgtgggagggttttgcacaaaggaggaacgtcacctgacttaggttttagaggcttctctggctgctgggggaatgtggctggtagagaggtgaggcagaggcagggaggtcagcgtggaggttcagtcagggtggtaagaagaggtcagggtctggccatgtgttggaagttgagccagcaggatctactaacagatgggttgtggaacacggatgaaagggagtcaaggaaatgtctcattctgagtccagcacttctaaccacagagcctctgacctggggagggagggggctgcatttcctgtttacaggtgaggaaacaggcttagagaaaagcaactttgccaagcaccgtgctacagacaagacataaaggtcatctggccccagaacctgagctctggacagtcttagcaccttagaagtttacctactgcatggatggggccaccagagtctgccccttccctgcagggatgtggcacagcactgagttctcagagctacccagggcaagggtgaaggagtggggaccctgagcccctgggccagctgtcagcttatttaccaggccacacgcatccccatttttggtggcttcaatgcaggtagcagtttctatcacagcacctggtttgtccctgcccaatgggtgtatccagtggtgccggcagaatgttcccagtgctggcctgctcttcagatgggcaaccgaaaccatccttcagggcgctaggttagcccagtcccaggtcctccccatctcagcttccttacagccagtgagcatgttccaaggactctaccctgagtcctgtcacctctgcgtctttgctcatgtggttccctcctcttggaatgccttccttcatcccagcctctgtcagcctttaagacctagctcaggggccacca

SEQ ID NO: 27100 - DNA, 1034 bp, Homo sapiens
ttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattggatcaggagaatgggaatttttttcctcc

SEQ ID NO: 27101 - DNA, 3013 bp, Homo sapiens
cccgcagaccctcatcgcgcgggtcccagcatgcacagcgcgctcccacgtggccggccgagcggttcggggcggggggacgggcctggaaagctctagatccgggggtctttaccttgacccatgggtagaatcgctctagcaattagaaataagcctcccggacgccgcccccgaacgattaaagcagaagctgggatgtggggcccaggtatcagcatattttaagagcttccaaggctgagaaccgctgcttgactgcgccgcagaggcaggagggagggaaggaaaccacttagcctctttctccccccaggtggaggagtctgtgctcaacctgggcaaattccacagcatcgttcgtctggtggccttttgtccctttgcctcatcccaggttgccttggaaaatgccaacgccgtgtctgaaggtaagtcggccaccgccaagtgtcacagagagatgtggttcctttcggtatcctctcgggcagcttgtgatagtatttgccgtccttggctggctctgagtctgataggcgtgaggcagtatttgagccatacaatgtgtaatttgaaataattgtcttcacagagctcaaggtctgggaactgtgctagaccaaactgtttaagcagacgatgtggaatgtgtgttaacgtttccttgtgggcactgtagtgacaaactattttttatttttattttttttgagatggagtctgtcccccaggctggagtgcagtggcaagatctgggctcactgcaacctctgcctccctggttcaggcgattctcctgcctcagcctcccgagtaactgggattacaggcctgtgccagccaccacacccggctaattttgtatttttggtagagacggggtttcaccatgttggccaggctagtctccatctcctgacctcgtgatccgcccgcctcgacctcccaaggtgctgaggttgcaggcgcgagcgacggtgcccggccgacaaaggggggtttcttaaagggggtcggcttaacacctacttgtgcctgaggttttgcctaaacacaatcaagtgtctggttctctgctttctgttcgattggaaagggcagttgggtaaacacaggctgagaaaaaaaggtttggttccagaaggcaaattctacgaaatactcgagggtgtgttacaagctattatttattgcccacttgtgctatcagacctgaatgcagttgttcccatggctgggccaggctttgcagtgatgacttgcgaatcaaatctgtcaatcccctgagtgcaatcactgatgtctccatgtctctgagcaatgcctgatggggagggatctaggtatgccatcccagcgtgctcggtgggaccagggtagtcagctgagggatgttagagttgatcgtccttcagcctgttagtgggaactgtgttctttcccctgaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggtgagaccatcatctgttatattcctgttatcctggacattttgggggaggaggttctggaaacttggttgcttgttgtgatttctgggaaggccttcaggctgggctggtgcccgtgggtgcgggagctagctcagagccccttgttgctcaccgtcttgccctcttcttaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcaggtaaagtgcaggggccacccataatactggagcctttggtctgtagttcagttaattttgagtcttgatgaggactgaccatcctgtgggtagaaccatgtgggctggggctgggtgtaggcctcctggtgcttaccacaggctgtgttcttacactgactgtatagaaagaggaggtagagtaaacctaccccatatacacctcagctcaggccctgtgcctggtctgtattgtgaatgggggaacatagaattgaggaagatttggatctttgtcccatttcctccaggcagagtaggtgtggagaaggcaaggctgtagctctatggtttttgatgaagcagctgggccagggagtgactgtggctctttgcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggtcagtgcagagcctggcaacctgcataaggtatggggctctaaatagctggcctcttgcattcacacttggtttttcctaggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtgcgtcacaggggactcaaaaatgggagaataaggactgttgccatgtgcacctgcactgctgtatttcgtgacccaccatgtcttccctagttgtgcttgatggggaggtggggagcagggctgtcgtgcaactgggcaggtcagcagttcatttctctgactgcttccttgactctctctccaggtaggtgcacgtctcatcgcacatgctggcagcctcaccaac

SEQ ID NO: 27102 - DNA, 1710 bp, Homo sapiens
tacaggcctctgctatgggggtgatggccagtcctggtgtctgagtgattcccagggcccagcaaagggaccaagtttccaggtcagcgacattggatgccttccctctgcctctgggagctatgggttggcatgcattggggtagagatccaatctggcctgaggctcactcaggacttcggggtgagaggaggggaggagctgagctgccttggctaatggggttgaaatttctgatcttaaactctccactgaatattctctcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctggtatgggtgggggggcgttggcaggtgtgagaaggggctgggtggctgggtggggaggcttgcaaccatagcttccacaatgatggcaatatttttcgtcaacagcagttcacctagtgagtgttgagactctgggtctgagtgaagctgagggtagagggaacacagggttggggtagtttctctctttgggctgacaggctttgtcacccacacacatccagaggtgcccacgagtgtattcggggagaagcttcgagaacaagttgaagagcgactgtccttctatgagactggagagataccacgaaagaatctggatgtcatgaaggaagcaatggttcaggtcagttgggctttgctgggtgtggagtggcatagctagctgttggaggtgatgaactgtctgagcctgaccttgtagaatggaggcaaaaaaactgatttaatgagcctgatccaataaagccagaaaggagtcctcagagcaccagaagtcttcaggcccttttagcacttttctttgaccaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacga

SEQ ID NO: 27103 - DNA, 1528 bp, Homo sapiens
ataataataataataataataataaaattaaattaaaattaaaatggtggcaggaagcagaactttcagcacctttctttttccttgaaaaatttagatctgggagtttacatcaggacacaagaagtctccttattcttttttgccactgcaaaatatttcattgtatgggtatgccataatttatttaaatagtcagatattgctggacattttggttgttttcatcccttttcagggatttaaaaatgctgcagtgaattactttgtccatgtgccatttcacacgtgtaaatttatatgaaggctattactaagtagaattgctgggacaaagaatatgtgcatttgtagttttgatagctactgccaattcgatctctgtaggggttataccaacagcattgaaaccagcaattttgagaatgcctattccttacactctggccaattaagtatttttgtttatttgttcaatcaacaattcttgagcatctactctgtgctaagaacttttctacatgctgtggattaagcaatgaccaaaatagacaaaaagccttgtgttcacgggcttacaatctggtaggggaaatagacattaacaaactaaatgaaaaaaatacatagcatgttagatggtgataacagctaagaaaaataaagccattgaggaagatctgggagtgcctaggaaggaaggtttgaagctttagggtatttaaggtctcactgaaaagatgacatttgagccaagacctcaaggaagtaagagagtgagcgatgtatttatgtatctgggggaagaatattctcggcaagagtgtgcctgctgtgtttaagggaaaacaaggaggcccaggtggctggagcaaggaaggtagtaggaggaaatgatgtcaggaataatgaatggggcagaggaaggcacgaccatgcagggtcttataggctgcatggaggccacacttgtgggtcattgtaagggctttggcaggacatggaagccattgaggggtgttgagaatgataagacctgccttatattttagcaagatcactctagctgccatattgacaatgacctgtacaaggcagggagatgagttaggaagccagtacaatagcccaggtgaaggatgatggaagctgagactagggatgctataggggaggttgtaagaagcggctgcattctgtgtacatttcatttcataggcaggactgacaggatttgttatggaaggagagagagagagtcaaagactcaaagatgtctccaaggtttctgacctatcaacttagaaggatggagtttcctgagaagggtgtgatttggggaagagcaggttttggaggagaaagatctggagtttggtttgagcatgttatgtttatgatgctcactaaacatccaagtgaggagctgaaaaagccacagaaaacatgaggatgggactcaagagaaaggttcaggctgcagatgtaaatttgaatgaatgaaatcatcgaggggatgagtgttgat

SEQ ID NO: 27104 - DNA, 1033 bp, Homo sapiens
gtgttcttgtttctttatggaagaatggattttcagaggtctttacttagcaattcccaaagtcctgtccctgtaattgttatttcttacctgggcacaagttaaaagtgccttgggggctttagtccagcattcatccagtcacagtaatttttgactcttgaattctatcatgaatcaatcagcacctgttgtggggctgggactatgatggatgcttgggagaagagaggcttaaacaatgatccctgccctctgagagcttacagagcagttgaggagacaaatataattatgtaaacaacaatttataattttgaaaaaaattcgtgtacttgaagaaaggtcagtagagattatctataattacataataataagaagaaatagaaaacaatgtaaggcttgaagaccacactatccaatagtactttctgcaatgatgaaaatattctgtaccaaccaatatggtagccaatagccacacatatttattgggcacttgaactgtagctaccgtgactgaggaattgaatatttaattgtgtttaatttaaatcaaatttaagaaataacacatggttactgtatctgacatcacagctctaagactttaaatatttgcttgattggccaggatgaccctgtggcaggggtagggaaacataccctcccatgggaggctcatagctcttctctggctcctagggatagatagaagctgggggctatggatactccctggcatttaattgtgcctgctgcctggtgggtgttgttcagtgacactattggaatagtttaggtccgagccacctggcaaaggtaagctctggtctactctattgggggcaaatttagaccctagatcaggcacattataagtgcaattagatgaaaggggctgtgggaactgcaaaagaatcagcccccttcctaatccactggtcaatgcaacattccctgttttcctctacagccacaaaactagcccaatgtcatccatctccttccacgctttccagcaggatct

SEQ ID NO: 27105 - DNA, 1033 bp, Homo sapiens
cccagctactcgggaggctgaggcatgagaatcacttgaacccaggaggcggaagttgcagtgagccaagatcttgccactgtactccagcctggcgacagagcgagactccgtctcaaaaaaaagaaaaaaaaaatcacagtatagtattccatgcatcgacagctgtagttttttttaaatttgtttttgtttttttgagacagggtctcactctgccaccctggctggagtgcagtggcatgatcacagctcactgcagccttgacctcctgggctaaatgatcttcccatctcagccacctgaatagctgggactgcacaggtctgtgccaccacgaccagctaatttttttattttttgtagagacatttttatgttgcccaggctagtcttgaactcctggactcaagtgatccacccgccttggcctcccaaagtgctgggattacaggtgtgagccaccactctcagccaacagctgtagttggtgcaatcctttttattcttttatttttttctacctttttgctattataaatggtacttttataccccttgttcaaatacttcttttggattatttccttggactcttactcccaacctgggctcaccaagtcagaggatacagtttcggtgcctaattgcaatctggaaaggttgaactagtttccagcactatcagcaatttatggggccatttcttgacaacccatctagtgctattacaaagaaatgtaatgataccttgaattaggtttaatttacattgctttggaaaaagagaccagtagctgatttagattttttgaaagaagtacagtgctgtgatatagattatctccaagatttatgtaactgaagccaacttgtggttgaagaaagatttggttgatgagattgaaatattgtggaagtttagaataggatcatagcagtataaaatataaggctagatgctgttcagttggaaataccaggcattgtgccggaagctggggacaccccagagtaacatagatgtgatgt

SEQ ID NO: 27106 - DNA, 1051 bp, Homo sapiens
ggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcac

SEQ ID NO: 27107 - DNA, 1014 bp, Homo sapiens
atcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaa

SEQ ID NO: 27108 - DNA, 1057 bp, Homo sapiens
tcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttc

SEQ ID NO: 27109 - DNA, 1990 bp, Homo sapiens
gaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagag

SEQ ID NO: 27110 - DNA, 1023 bp, Homo sapiens
gcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaa

SEQ ID NO: 27111 - DNA, 1030 bp, Homo sapiens
ttacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttcct

SEQ ID NO: 27112 - DNA, 1061 bp, Homo sapiens
ctagtttcaaacacctgacctcaggtggtcccacctcggcctcccaaagtgctgggattacgggcatgagccaccactcccagcctattttatttttttgagacagaacctcactccatcgcccaggctagagtgcagtggtgtgatcttggctcactgcaacctctgcctcctgagttcaagtgattctcctgcctcagcctcccaagtagctgggattacaggtgcccaccaccacgcctagctaatttttgtatttttagtagagacagggtttcaccacgttggccatgctgatctcgaattcctaacctcaggtgatccacccacctcggccttccaaaatgctgagattacaggcatgagttaccgcacccatccttatgtgcttttaaaaacactttacattatagagcatttcaaacctgcatagtagaatatcataataggataatgggcataaatatatacagttattatttgtcaattaaaaaaagcatagtagaataatgaacctcagttgccatcaaccagcttccagggttatcagcacgaggcctattttgtgacatctgtaaccccccttatttttcctcagtccagtattttaaggcaaatcacagacatcatatcatcagtaagttcttcagcttgtatttatttttatttttatttgttttaattttttttggagacaagggtctccctgtgttgcccaggctggagtgcagtggctcaatctcggctcactgcccaccatcagggctcaagccatcctcccaccttagcctcctgaggagctgggactacaggtgtaagccaccatgcctagctaatttttgtgttttttgtagaggtgaggtcttgctatgttgctggggctgatatcaaactcctgagctcaagcaacccacccgccttggcctcccaaagtgttgggattacaggtatgagccaccgagtgcagccactgtatttctaaaaggtgaaaaatttaaaaactgttaaacaagtaaactataatcattttaaaatactacataatcattttttggatttcc

SEQ ID NO: 27113 - DNA, 1033 bp, Homo sapiens
aaagtagaccaagatactcgtgctaaaactaaacagggtggctaactgttaaaagatttaatagaagcctatgttagagacttctaacataatagacaaaatgttcatgatataatagcaaatcacttgtcataccatcaacaaaggaaaccacaaattgaatcagaaaagacaatcaacagtcaccaatacaagatgaatcagatgttggaattttctgacaaggattttaaagcatccatcataaaaatgcttcaaaatcaattaaaattatcctgaaacaaaagatataaaaatctcagcaaagagccatataaaattaattaaaactaaataaatgaaataaaaaagcaccaaaatggaaattttagaactgaaaaacaacaggaaaaaaaatgcttactggaccggctcaatagagtggcagtgacagaatcagtaaacttgaggaaggaactatagaattcacttaatatattggaagaaagcaaactgcaaaaaaaatgacttgtggggcaataacaaaagacttaatattcacgtaattggatttccagaggaagggagagtaagtaggtctaaaagagtgtttgaaagaaataatagtggaaatcttaccacctttggcaaaagaaacaaacctaaggacccaagaagctatgcgaacttggtacaggataaacccagtgaaacaccaagatacattataattaaactcttgaaacctaaaggcgaagagaaagtcttgaaagcagccagagagaaatgatgcattacctatagggaacaccaattcaaatggcagtagatttctcatctgaaaacatggaggccatctgaaatgttacattacctatagggaacaccagttcaaatgacagtagattttctgtatgaaaacacgaagaaggacaagacatgatatttttcaagtgcggaaataaaaggactgtcaatcgtgaatttctgtatctggtgaaattgtgcctcaggaactagaggaaaatagaaacattctcagataatggatacc

SEQ ID NO: 27114 - DNA, 1083 bp, Homo sapiens
gatctcttgacctcgtgatccacccgtctcggcctcccaaagtgctaggattacagacatgagccaccgcgcctggtgaaagttaaaaatcttaaagcaaccagtggattgagacacattatctttacacaagcaagaaaaaggctgggcgtgatggctcatacctgtaatcccagtactttgggaggctgaggcgggatgattccttgagcccaggagttttgagaccagcctggtaacatagtgagaccttgtctcagttttaaaaatttattttcttattaaaaaaaaaaaagcaaggacaagactgaaaactaccttcttattataaacaatggaaacccaaacaatggaatgacagttttaaagtgcagaaaagaaaataaatgccagcatagaattgtataccaagagttgacaaactttctttttaaagggccaggtagtatatatcttagactcctgggccatgtaagatctctgccacagctattctgcattgttgcatgaaagcagtcataaacaatcataagcgaatgggcatggctgtgttccaataaaaccttacttacagaaacaggctactagtccacgggctgtagttccctacccttctatatccagtagaaaatatacttcaaaaatgaagaactaaagatattttcagatgaacaaatacagaggggattaatcaccggcagccttacagtaaagggagttccgtaagcagaggagaatgactgcagaaggaaatacagagattctaagaggaatgaggagcagtggaaagaataaagtgtgggtaaacttaactgaatgttaattgtatgcaataataatgtcctctgggatttagaatatagaattgaaatatacaccaacaaagcacaagcagctggtataggtggatggaagaagtgaagcttaaggtccttgaattgcccaggaaatggtataagtactaatttatattaggccttgataaatcagggatgcaagttataatttctagggtaatcactaatagtagtaaaagtaaaggtaatagcaaaataaaagtaaatagtaaaaggatgcataaca

SEQ ID NO: 27115 - DNA, 1022 bp, Homo sapiens
cagcaacatgaagcagtgtgtggactccaatgcctacgtggcctccttcccttttggccagtgtatggaatggtatacgatgagcacctgcccccgtaagtgaaaaagggagccctaggcacttatgcatgccctctgtataggcaacaactcagccatgaggctgtgctgtcagcctctgaacattttagaaacaagactggacatgacctctgctcaaacctgaccagagactgccatcgagaccttgctgcctattgagaaccttcatacagaatcaggcacattgacagtaaataaatgtaagatagatcacagagtacagaaataacttgtccaacttcagtgtcatattgctcaatccatgtaatatctccatatctgaatttcctaatttgtaaagtaaatgctttccaatagataatctctaaggtcccttttgccttcaacatcctgggattgagagaggagggaagggtcatctctgttatgtattgggcaaaatactgggctctttacattcattatctcttttaaataatcaagacagaataatatttttgactcaagccagttgaatagtctgttaaaaaaaaagtaaatacagtgaattcagatctacctgtgatagtcaattgcaactttttttttttaatagctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccaggtaagatgccttgcatatccaaattcaagtgtttcactactgatttatgaagaataaaaccttgaaagctacgttgtgtatatgtaactccctgccctcagcccctttccttcctcctaatggttggtac

SEQ ID NO: 27116 - DNA, 1043 bp, Homo sapiens
atctgggtttatacatagaagaactgaaagcagagtctcaaagacatatttgaacatcagtgttcttggcagcattattcacagtagccaaaaagtggaagcaggcccaagtgtccatggatggataaatggataagcacaacgtggtctatgcatccaatggaatgttatccagccttccaaaggaagcaaattctgacccatgctacaatgtgatgaaccttgaagacatactaagtgaaatactccagtaacaaaaaaataaacattgtatgattacacttttaagagatacacttgtggtagtcaagctcataaagacaggaagtagaacagtggttcacaggggctgggagaaggggaaaatggggagttagtgtttaatgggtacgaagtttgagttttacaagatgaaaagagttctggagatggatagtaatgatggttgcacaacaatgtgaatatacttaataccactgaactgtacatttttaaatggtcaagatggtaaatgttatgtgtattttatcacaatttttgttaaaaatgggaaaagaggccgggtgtggtggctaacacctgtaatccgagcactttgggaggccgaggcgggcggatcacttgaggtcaggagttcaagaccagcctggccaacatggtgaaaccccatctctactaaaaatacagaaattagccaggcatgatggcacacatctgtaatcccagctacttgggaggctgaggcatgagaatcatttgaacctagaaggcagagttcacagtgagctgagattgcaccactgtactccagcctgggcgacagaacaagactctgtcgcaaaaaaaaaaaaaaaaaaaaaaaaagggaaaagatcacctgcaaaggaatgacaagctgaccgctaacttctcagaagtcagaagagagtgagagaatgtctttgaagtactgaaagaaacctccccacctagaatagtgtgcccagtaagcaccttccgagaacaaggatgaaataaagatatcttcaaattagaataaaaat

SEQ ID NO: 27117 - DNA, 1049 bp, Homo sapiens
ccacctgcagcttcccttcagtcacctcctaacctatcctgggtcctatggcttaaggggcccagagtgcactttctcagggggtgctggctctaggatccctgcctgggccaccctaccctgttctcctttcttgtcaccaaagagcgtgttcaagccggctccagtcctgtgttgtgcatggccctggggagtggagatggaagccatcagcactattggtgagacctgattcacaggggtgcaaaggccgcagctgaatgccaacgggcagcctgagcaggaaggcttcctcccattttgtctgagtatatatctacaaggtcaattaaaaggacaggaaaggccaggcgtggagactcacgcctgtaatcctagcaatttgtgggggagaagcgggaggatcacttgagcccagagttcaagaccagcctgggcaatacagtgagacgctaactctacaaaaaaatttaaagtagctggatgtgttgcctgcctatagtcccagctacttggggggctgaggtaggagcattgctgatgggagcgggcagcgaggctgcaaaaaaaaaaaaaaaaaaaaaaaaagccgggaaagggaattctaggctgggggaacagtcagtgggggaggctccgaggcacatttgggggacaaggctgaagccattcacatgccaagaggtaaaggaggtgcagcttcatggtcgcggtgggggtggtagtggtggtggtggctggaggaacacatgcaagtcaggcagtgaggcccaggcaggccttgtggggcccccaaacaccaatgggccaagcctccaagttggggcttttacgtaaggctctataggggttagcgccagagtgcccctttcaggtttaaggtataaacctcttccctgttgttttgatggcctccagtcaagaagggggcttgctggtcagccctactaagcgttcgccctgggcgacactctacaaggttttactggggcccaatgaaattgacagatctgccagggacacacactgagagtccagaagcagcgttc

SEQ ID NO: 27118 - DNA, 1051 bp, Homo sapiens
aactctgatatctaactctcaaggcatgtccttgccaagcagcaatacaattaagtgtgcctaatcttatggctcccacactttcaattgttcttcctgaaacaattagatatgaagccgcaagagcccaggcagggctggattgattcttgaactaatcaacatttatgccctcttggctaaactaggcagagttggttttattacagttcagatgtgattaagcacactgtattgtgtcagcggcaggtgacgagccacacagtgtcctgaggcctgatgaaagggctatgccaaccacagtcccagaggaggagctggctgtagcagcgactgacccaggagctgaagtgagccaagccccctcctcctgagacccctgagaggtaaggcaggctcatgccagaccctattacgtcccacatcatggctagaaccagaaccatcttacatggctggtcaaggcaaggataaccccaggaagtcagaggacttggagactctgtattgtaggaaaaaaaaaaaatactagaaaagacactggagcgtcaccagcagtcacccctggatggtggcattattattattagtagtattttttttgagatggagtcactctgtcgcccaggctggagtgcagtggcatgatcttggctcactgtaacctccgtttcctgggttcaggcaattctcctgccttagtctcctgagtagctgggattacagatgtgtgccaccatgactggctaatttttgtagatggtggcattatgaatatggattttggttttcatcatcaaatatttctgttttccccacattagctgtaaacagtatatatttttggtaaattaagttgaaagaatgaaaaaattaaaatagtataaagaatatctgtttaagtgcagtggagtgtgcctgtggtcctagctacttcggaggcttagatggaaggattgcttgagcccaggagttcaagaccaaccagagcaatgtagcaagactgtgtctgttttattttaaaaataaataaataaaacataaagaataa

SEQ ID NO: 27119 - DNA, 1042 bp, Homo sapiens
taccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaata

SEQ ID NO: 27120 - DNA, 1033 bp, Homo sapiens
gtgagaatccaggtcatctctcacccacatatcccctccgttttccttctgtctatttgcaggtactcacgattcagaactgtggcattctgggcattaaggctctttgttttgaggggaaacaacatctttctgaattttgccttgggagttgcatacgctcctcccagagaatccgtttccccattttattaggtttctttttctgtgttgtgtattttctcccctttacaagtcttcaattcaggaccgctgcctggcagccattgctgctgttgaaagtatcaattgtcctgatactgtaatatgagctttacagtgtgatgccattttacatatggttggactttttggtgggtgttgccagattcctatttcaggaaattgacttgtttaaatgcagattgtgagagggagggaaaatggcaagatgtgagatttttattgaatagtcttctaccttagcccagtcacccaactgcttttttgaatcttctctgatatggatgattaaatgtagttctattttgctgtgaaaagtttgggagttttcagttcttttgtctttttccatcttcttgcaacagatttggaaaacagattcttaacctgtgccattttcagagtcagtcacctagttttgttttatttgagaagcacctgagtttgaagcaatgcaaaatatgagatccttcatggttttgtattacatcgttggaaatggatgtaaattccaaagattcagcaaataagagtatagccattagccacaagggtttttttggtttgttttttgttttttactttgagacagcgtcttgttctgttgcccaggctgaagtgcagtggcatgatcatggctcattgtggccttaacctcctgggctcaagccatcctcctgcttcaacctcctgcattgctgggactaaaggcacgtgccactatgccaggctaatttttcaatttttatttttttaaatagagatgggatctcttatgttgcccaggctggtcttgaattcctcctggtct

SEQ ID NO: 27121 - DNA, 1057 bp, Homo sapiens
ttgctgtggtgtgagagcagaggaaaaactttgtttttccacactcttaaaggatttcagtcgttgagacctattatgggaccttgtgctttgcatacgttttgaaatgtggcctaagtcaagtataggttgtctagactgagtaccttggaggtcttaatatcaggaaatatgttaagggctgtgaatagactgaaatatctgaaaattaatggccaggactcactaactagaaggcaggggccttctcttatcagtgagctctaggctggatgtgttagctcacgtctgtaatctcagtactttgggaggctgaggcgggtggatcgcttgagcttaggagtttgagaccagtccgggcaacatggtgaaacctcgtctctacaaaaaattagctggttgtggtggcctgcacctgtagtccagctacttgggaggctgaggtgggaggatcacttgagccagggaggttgaggctgcagtgagcctgaacctggtgattgtaccactgtactctagcctggatgacagagtgagactgtgtctctcaaaaaaacaaaaacgaaaacaaaacctgggtgcagtggctcacgcctataatcctagcactttgggaggccgaggtgggcgaattagttgaggttacgagttcaagaccagcttggtcaacatggtgaaactgtctctactaaaaatatgaaaactagctgggcatggtggtacgagcctgtaatcccagctactcgggaggctgaggcaggagaatcgcttgaacaactgggaggcggaggttgcagtgagctgaggtctgtcgctgcactccatctgagcaacagagcgagactccatctcaaaaaaaaaaacctcttggttttaattggttatattggattttgttttttggaatctgttgagataatcatgatttttttcccttcatcttactaattggaatttctaatgtaaaagccattgctgcattactgagaagaatctcttttggctatggcctattaattttactgtacaactagattccattttttattttattatt

SEQ ID NO: 27122 - DNA, 1046 bp, Homo sapiens
actcttgggctcaagcgatcttcctgcctcagcccctggagtagctgggactacaggtgcacgtgatcatacctaaatttttttttagagatgtggtcttgctgtgttgtccaggctggtctcccaactcctggcctcaagtgatccacccaccttggcctctcaaagtgttggaattacaggcatgagccaccacacctggctgttttgtatttactgtacttttccccatttcttgtcaatcagcttttttgaactgattgctttattttttttctaatgtgaaagtcattttttttttctcctctggagttacctctaaattttgacacatttaaactatcacttctatattcttgtgtagaattaatcagaatctatcttttcttcccttttccaacaagacagaactgctgcttgctttcatttccttctcccttctcttccctcttcaacttcctatgtcgaaatcatgtaagtattttagtttcagattgcttatttttgtaaaagtcagtacttttgtttatttcttaaagctcttggattaaaaaaaagtttcttaaagctcttggatgttttaaaattatggcattcatctaccaattatgttagagaaggtctttgaaaagtaaagttgatcccttacatatgtgaaaattgtttttgcactcccgcttgaaagcttatttggttggctggatataagtttcaaaatcattttccttataactttgaagccagtgctccgttgtcttctggcatctgtgctgctgatgaaaagtctgatactgacttttatgtgatttatgtatctttataggaattcagttttttccttatgatatcttgaaatttcaataggatgtgtctaagttgtcttccccttctctgctgaccgataaacactgttcagcccttagagtaacctgatgattggtgtcttccctttccccaaggaaatttctggaactaacataagatgttggtccttctggttctatattctctccctctctcttttttttttttttttagttagagac

SEQ ID NO: 27123 - DNA, 1141 bp, Homo sapiens
gagccactgcgcccagccaatatgcctttcttttaaattgccaactagagtgtgacaagaaagcctttggcctctcgtttgatcaggtttcttgaagaagcttttcgtgaaagatagagtggtagttatttatgtttcagagacttttaaaaaatccatacacaagtctttcaggatcttctcattccttttttagttatttcttttaaaaagtagtctgatatcttaccttacaggttggagaccctgatggattctgcatcgttttaggatttgcctctgattcttgctagtgttctcttttctgtcattatggggtttgccccgttttctctaatgtgctattcctgtgttttggttttgagttcttggttgcatgtgacctgactgcttctggagacagtacagtgcttgtcgtctctcagctgctgcttctgtgtctcaggagggctgagggctgccctccctcgggagcctccgtgcttcctcaggctttgctctttgttctgtacctctcttcacgttacctttgggtggtggttttcattcctgtgccgcctgcttctgggccagtgatccaggtgtctggtgaccacccgggcacagctgcttggctgctgtgggcacctcagcttcccatgtcctgtagggaactcacccaccggccttgctctccacacctcttactcctgtgtcccctttctcggggatgctgccccctcctgctgtcctgtcctctgttaggggtgaatcttgaatccatcttatctcttactctccctccctctcccagctcagtcgggctctcaccctctgtgacccacctcacaacttcacctgtttcattgcactttgcatccgacctcgccttcattccttagttgtctggaaatgctccaggcctctgctgcttctcacctcattccccagaaacagtcaggttctgtctcttaccagaggtaactgagctgctgctggcctcatagctcctgtcgccctcactgcgggtttggttttcctcttatcacagtggtctgaagtgcttggatagtctaggacatccagccccctccccagacagggactccttagggcgtctctgctcccaggctggccttggcccttctggggtgctcaggaa

SEQ ID NO: 27124 - DNA, 1047 bp, Homo sapiens
tgaataagtctaaggaaaattgcacttatttttggtgtattttctttcagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggcagttccacgttactttacactaaatcctgggaatgaatgtctggagagacagggcttcttttcttggcagaatttccttgggtagtgggcggactgttctgatgcaagtgggtacactggcagaagcagcacaatctggaggactaacatgagtcagcagggccactagaattgacaccccctcaggggatcagggagaatctggtttttctttcaggctaagtagaaaaggaagaactgaagtgtctgtcaaagaactcatggggagtggggggtccttcagggcactgtggcacttgggaggtgagtctcagaagactgcctgaggagagtgccaggctgcaggtgctcttggtaggggctgaagcttttctttctgctttgca

SEQ ID NO: 27125 - DNA, 1050 bp, Homo sapiens
ggttcccaacgtgctgggattacaggcgtgaaccgctgcacccggccagcatcaattgaaatgatcatatggtttttgtcctttattctgttgatatagcatcatttttattgatgtgccattttcattttgtggctgtatctcaccttattgaaccaagcaggcatttaagttgttttaaggtttttgctattgtaagtaatgctgcagtatggtattcttagataagtgcctttgtttggaactgctgactcaaagggatgtactttgtttaggttttgatacaattaatatattcccttctgcagtaaatttgtagccactctgaatgcctgtctttgtgatctctcctccctgcagagtaatactgagtattcacttgtttcttgattttagcagaggcattttagtctactgattacaatcataaactcaggagttggactccttggtttatagcctagttcaatcattaagttgtgtctgttttctcacctgaacaatagggctgagaatactatcaaccttatagggttgttccgaggcattatcatttctttcctttacaaattgtgtcttagagctcaagtagttgattagggaaagtttctcttcatagaatagatgatgaagtgatataattaaaatacttaaaatttccaatccccaatgaattgatagaatgaggcagtaatcatcaatgctgctaccatcacagaaacaaccaaatactatgtacctcctgatggagaaatcttgtcataaaatcatatttgagcttgatcaagactctagttctaagtgctggtttataggaaattcaagagactgaagatcacatggacctggttgctttagtaaataagtgtgtgtgtgtaaatttctttttccatgtctgtgatttcctggcttataattctgaaagcccttattaaagtctcttgttataactttggggcacttggaaactcagaagcaggcctccaaaaataaaatctccctctctgaccatctcctcctcccctttctcctgctcctttctctccccaa

SEQ ID NO: 27126 - DNA, 1073 bp, Homo sapiens
ttctcccacgggttggccaaagagcccctaacacagggaagacttgcaagtttctcagggtcagccagcagggccatgaggagtggggcagcccttgccttactttgtacccagtctcggagagaaggggaggtgacaggggccactgggttccatggggcctgcaggccgaaagcaagggcaccctggagcagtgcaggcctgtgtggcacagtgccctcatcccgaggcccaactcagccccagccccagcctctgctgtggagcattcctgacgctcccaccccatttcctcatctctgtctcctctctaggcttctttggaaattgactgtccaaaccctcattaggtgctgtctcctcagcagatggtctctggagtcaggttctttgtcttcgatttctgtagctcccacgtgattcagtaaaggcatgctgattcatcatagggttcctggcagaagggcaaaactatcaggggaacaaagtagccagagatcacatgcggagccaccttctgacttggtcaagaactccttgctggtcagacctggctgttcctagcacgtatggttgtcaggaggttgagttggtactaaatcagctgtgaagattagcaactgcctgggcagtgagaaccaggcctctggtttcgggaggaatttgttgtgcagcaaaataaaatattgccatgttagtgtttatttttagtgttgaaatgccaccttaagttgacagtgttaatgctacattgacatatgatatacttagtatcagtcccaatatttcattaaaaagtacttagaatttataaaactgaaaaagtaaaactgatgcaagtgtaccaagtttggacacattagagaatatcaagtaaaaatcaaatttgatacaaattaaacgcacaacataaattaccattcctgtgtaagttagtagataaaaattaatgtttactaagatgtactaaattacatttacttcatttactacatttaattcaaagttaaaactaagatttaaaatgcagtgatcagtgggcaaggtggtatgtacctgtagtctcagctact

SEQ ID NO: 27127 - DNA, 1023 bp, Homo sapiens
agcaaggattggttggatgctactgagatggctgtgaggatgctggagaacagtgtgtggggcttgacagtcagcagttaatctttcaggaaacggttttctgacacagtgtaggctgaagccagactcgggaagtttggggacatatggtaggtgcagactttgtaaaatagtttggaagtaaagagggggagaagtggattggtggctccaggccaaatggagttgaaagaaaaatggttttaggacaaacatctgaagagtggaaaaaaatctgagagaaaggatcatgatggtagaggcagagaaaggaggagttgattggcataggagagcactggaagatgcgggacctggggcctgggcagggaaagagaggccatgtctcagtctgtttgggctactataatgaaacaccatgagctcagtggcttataaacaacagaagtttatttctcattgttttggggtctgggaagtccaagattatggcgccagcagattgagtgtctggtaaggagctgctttctggttcatccagggcttctcactgagtccttatgtggtggaagaaggatttctctgggacctcttttataagggtgctaatcccattaatgaggggttcagcctcatgacctaatcaccttccagtagctccatcttctaataccattgagatgggggttaggatttcagcgtatgaattttggggagacataaatatgcagaccaccgtaggccaagacttcagattggggtaggtggcaggcacttatttcacttctttctgaaggagcttgttactgacagattatcattttaggtcctttagttcaagcttgtctgacccacgacccaacacaaattcgtaaactttcttaaaacattatgagttttttgttttttgtttgtttgcttgttttagcttatcagctatcgttagtgttagtgtattttatatgtggcccaagacagttattcttcttccagtgtgggccagggaagccaaaagattggctc

SEQ ID NO: 27128 - DNA, 1033 bp, Homo sapiens
ttcctggccatggaggcatcatggatcgctttgactgccagtatctgatggccacctttgtcaatgtatacatcgccagttttatcaggtatagtacctttccatctgaaccaagttggtggatttttaagtacggtgcaattctagaattttagcggcatctaagttccagtgaaaagcatcccaaataatgcagttttcagttgtttctgcttacagattttctgaggcctcctgtcatctgttaatagataactctctgatccagagatcagagcagccactcagataatcaggccctggaagcttccgggccctagctcagtgctgtttcttcacattctgttccagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaa

SEQ ID NO: 27129 - DNA, 1032 bp, Homo sapiens
taccgaaagggctcctcatttgtctcttttgtcccattgtgggcatatggtgggctccttgagaggagggagtctcagctggggcctggctgcagagacctgctcttgaatagggctgcctttgggatcagggagccgagcatactgggcaaggctcatcatgttcctttgtggaagtggttacttggtgggggtggggtggggaaggggggtctaggaagccgaagctgagtgcgcactagagctgctagcaggcaggccagagggtcagcttgtgttttattttctgatttctcctgcatgctttctggagatgaggattttttgtcaggtagctaggagagcactgccaccttgtgtccatatagcacaatgtttctctttcctattcacagacaagattcaagaaaccatttttacgtgtgtacattcaaatcttcatgaatggcatcacttgctttagacccattttttttttattggtcagaaataaaatgtgactgcaactgtgtgccctcccttgtcgtgaattccctgtttatcacttccatgcatggttttatgcttctcatttgtttatgtattcatgaatactgcatagtcctgattcagagacttttgctttgctttccaacttgtatccctacattctcacaacagccttcttacctcgggtgagagtcatgagcaccttaccaggcagggagcttccccaggatagtgtggtggagtcaggactcactccatcctgcactttacccacaggacacctggagggtcccccagccctgcttgcttttgtgaacgtcgtgtgagtacaccgaggtgttgcagctttccttccctctagctcaggaggcctggcctgagccaggttggagcttaaattgctgttggctcctgcctggtggaacaagggggtcatagaaaccagggctgatgggcaccccccagcccctgggagctctgctcatgaccgctcacagggtaccgagtctttgccttttgtgtgtgcgcatgctgccctcttaa

SEQ ID NO: 27130 - DNA, 1026 bp, Homo sapiens
acattgaaggccatttaagaatgaaaacgctcattttataaaaatgaggaaatcagtaaaaaggacatgagttccttgccatctcattgatcatcacactgaaataaactcattgaaaattattcaaagacatcatgacagatacttcctaaataaggaagaaaatgttgatttcctaacctgcagatttttgtaaacattggttttggatgtgaacttatcaagaccctgctgtgtaagtttaataatccatgtatgggttgagtatccctaatctgaaaatctgaaatctgaaatgctccaaaattcaaaactttgagccctgacacgacactgaaaggaaatgttcattggagcacttcagatttttgaattagagatactcaactagtaatattgcaaatatttggaagtccaaaaattccaaaatacttctggtcccaggcattttggataagggatatactcagtctgtaatacactaagtgttctttgttaaattattaggtttttgttagatacaagggaataatgaaattattttgtttttcttgaattcatctttaagattttaaattcattagaagaattcattataaggtaatcatcagcattttgtttttcttttccagaatttatagaagaaaatttcctagcagttctttaaaaagaacttagaaacccaaaggtttttgaatctgtagattttccttttggcattatttttttccttaaatttcttttttcttttttccttgagaacagcctgtgagacaagaagaaaaaggaagatttagtgttgtttcttgttaagaatggtttggctgggcacggtggctcatgcctgtaatcccagcactgggagtccgaggcaggcggatcacgaggtcaagcgatcgagaccatcctggccaacatggtgaaaccctgtctctactaaaaatacaaaaattagctgggtgtggtggcacacacctgtagtcccagctactcgggagactgaggcaggagaatcacttgaacccg

SEQ ID NO: 27131 - DNA, 1050 bp, Homo sapiens
tgtaaaaggacttcaccaagttagggcctcctgggtttattgcagattaaagccatctcagtgaagatatgcgtgcacgcacagacagacagacacacacacacacacacacacacacacacacacacacacacacagtcaaatactgttctctgaaaaatgatgtcccaaaagtattataataggaaaaaagcattaaatataataaactaatttaagaagtgataaagtctccagatgcagtagctcacactgtaatcacagtgactcaggaggctgaggtgagaggattccttgaggccagggttcgagaccaaccttgggcaacatagcaagaccccatttcttaaaaaaaaaaaaaaaaaatttaaacttagctgggtatggtggcacatgcctatagtctcagctacttgtgaggctgaggcaggaggattctttgagcccaggagtttgaggttacagtgagccacaatcacaccaatcactgcactccagcctgggcaataaagtaactcttgactcaaaaaaataaaaaaaattgtagtggtagccatgtgttaattgttaaataaattctccaaagggctaaaagtaaattacttataaattttttatagttgtatttttgacctgccttttatatgtatgaatatttcatagttttgcatatcagatgtaggcatacagacaaatacataaaccaatgaatatattacatattctgtgttccaataaaactttatttatggacactaaaatttgaatttcataaaattttcccatgtcaagaatacaaaatacttgagttttgtttttagctatttaataataggtctcatttattccacaggctgtagtttgtagtcttgcttgaaacaatagaaacagactgattaagcaggagaagttttttgaaagaattttgtttggctcacggaattattagaaggcaggtgaaccaggagggtaagcttccagcagcaatttgtaaaaccatgccttagaattggactaaggaagaagctgctgacactccactgccacaca

SEQ ID NO: 27132 - DNA, 1035 bp, Homo sapiens
cagattttcaatggagacaaaacacccttctattggaagaagatgccctctaaagctttcataggtagagagaggtcagtgcatgggcttgaaagaacaggctgattctcttgctagaggccaatgaagccagtgagtttaagttgaagccagtgctaatttatcattctgaaaattgtagggcccttaagcattatgctaaatctactctgcctgtgctctagaaatggaatagcaaagcacgaatgacagcacatctgtttacaacatgatgtgctgaatattttaagcctacaattgagacctactgctcagaaaaaaaagattcctttaaaaatgttactgctcattgacaacacacctggtcacccaagagctctgatggagatatacaagaaaattaatgttgttttcatacctactaacacatccattcttcagtccttgtcattttgactttcaagtcttactatttaagaaatacattccccaaggctataggtgacgtagatagtgtgattcctctgatggatctgggcaaagtaaattgaaaaccttctagaaaggattcaccattctagatgccattaagaatattggtgattcatgggagaaagtcaaaatatcaccattaactggatttttggaagaagttgattccaacccacatggatgatttgaggggttcaagactagtggaggaagtcactgcagatgtggtagaaatagtaagatagctagaattagaagtggagcctgaggatgtgagtgaattgctgcaatctcttgataaaaattacctgagttgctttttaaagaggtttctagagatgaaatatactcctggtgaagatgtcgtgaacactattaaaatgacaacagaggatttaaaatataacacagacttagtggataaggccgctgcagggcttgaaagaattaacttcaattttgaaggaagttcttctgtgggtaaaatgctatcaaatagcattgcatggtacagcgaaatcttttatgaaaggcagagtcaat

SEQ ID NO: 27133 - DNA, 1073 bp, Homo sapiens
gtaagatcctctactagcaaaaagattatgactcattaaaggctcagatgattgttagcatgtggtgtgagtgtttgtgtgtgtgtgtgtgtgtgtgtgtgtgtatatatatatatttagacagtgctactaccgtacacaaaatggattatagtgtagacataactttcatatgcactgggaaactgaaaaattcgtgcaactcactttactgcagtattagctttgttgcggtggtctggaacagagccttcaatgtctctgaggcatgcttgtatttatttatttatttaaaaacctctatattggttgtgtttccttcagattctattttttgtttgtttcggcctctcttttgtgatggagactttattgaaatgtatggtgatccttggctgctaacttatatttgaatgaggcatgaaaagttcattgggagctccgtaggcactgggtgcagggcctgaattctcagtatctttaagtctattctgtagatcctagctctccatctgctgcttgggaagtataaatgccttcccaccagggttttgggagctaagctgtgggaggaggctgggatctcagtgttcggtatgtagaccttcgcttgatccctattgcactccagtgccccttggttcagagagtaacatgtggagttggggttggtaacttttcctgcaaagggccagatagtaactatttcctgctttgtgggtaatgtgatctctgtcacaaccactcagctttgctattgtagcgtgaaagcagccatagaaaatatacaggtgagtgtgaatgtattccaataaaattttacttatagacactggaaattgaatttttttttttttttttttgagaaggagtttcgctctgtcacctaggctggtgtgcaatggcgctatctcggctcactgcaacccccgcctcccgggttcaagtgattctcctgcttcagcctcccgagtagctgggattacagccacccaccaccatgcctggctaattttttgtatttttagtagagacagggttttaccatgttgaccaggctggtctcgaactcc

SEQ ID NO: 27134 - DNA, 1035 bp, Homo sapiens
gaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttgttccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtga

SEQ ID NO: 27135 - DNA, 1068 bp, Homo sapiens
tgaatagacttaaccttgacagtaagcttaaagcattagtgtcatttaattacatgtctgaggaatttatgctaactagattttgggcttttgcagcgaattttagtcggggcctcattcctgagcccaagtgaccctttcacctcagcttcccaagtagctgggattacaggtgcacaccaactgtgctttgcagttttgtttgtgtgtgtgtgtgtgtgtgtgtgtgtgtgtgtgtgtgtgtgtattttgttttttttacaagcccacaacatcatagctttgcagtttttaaccaggagctggtggagatctttgaaatcatttaggccaattcttttagttacatttatgatgaaactagggatctaccttaaagttttgggaagctctttcaaaacttcagacacctagaaatatatatagtgcagttcagttttagtttctgcagcatggtttggaaacaaaagatacataggatttaaactcgatttgttttcttcttacagtagaagtaaatgctcttgtggcttgaatcgcatctcccaagaaagatacgttcacgttcaaacccccagtactgtacatgtgaccttatttggaaatagggtctttttagatgcagtcaagatagaattagatcatactggattacagtgggccccaataactaggtttttttgttaaaaaaaaaaaaaaaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaataaatgccaatgttgaaaattaaaatctagaaatatggctctaattataatttcatagaatcattttttcccctgagtttcccctgagtttgcataaa

SEQ ID NO: 27136 - DNA, 1034 bp, Homo sapiens
tgctccaatcccaattcttctctgtgatgtatggatctaaagtgtaggagccctgaggtccctctctgacttaaaaggctattattccaaagtgactttcaggtgtcattttgctaggtaagatttataaatatgagtccttggcaaaggattttcgtgtcgaattgggccattaatctagggaaaataagaatggtggactccaggacaccaggcagaatgacttcccttggttcccttggttgaatgaatgggattaacttcacccccagatcaaggcagtgagcattgactggtttagccaaccaatgtagtccacccttttctcaccgtagagctgtgctgtctcatacagtagcctctagactcatgtcactgtttacagttaagttttaattaattaaaattaaattaaaaattcagtttctcaatcccactacctacctttcaggtgctcactagccacctgtgtccaggtgccatttccatcattgcagaatatgttattggacatcactgcacagagcttggatcaggaatggctcttcagagccaatgcaaagtttcttgcaataagaagcttccttgaacttgtggggaaagaaactttccttctttttctggattatgtgctgcaaggatgtaatatctggactcacttttgttatcttgttcccatgaaagaagatattggagtagctcagatgccactttgggagctcaaaggggaagctagccctgcagaagacaagccagtgaagaaccaagtccttaatgatgtcatttgagataccagatcagtccatttcagttccatgaatgaatcaatccccttcataggctatgccagtttaagatagagtgtttgtccctttgcagttagaattactgactgacacattggacaatcatttatttgaaggaaggcagagactcaggtgttaaggatccagctaacatctggcccataaacttgaaagagaaataaaagcgggaatagaatgtgttaactctgtcagtggctatcattccct

SEQ ID NO: 27137 - DNA, 1077 bp, Homo sapiens
tctcttaagagggatttctcttttatctttttcttctttaatattctgatgtacttatttatagaacaaagacattagtcagcttttgtggtgtagcaaaccaccccaaaacttatgccttaaaacaacaaccatttttttgaggtcacccttctttgggttaacaatctggtgcaggctctgggggatcatttttctggtctcaggtgggctccttctggcttctgcagctactcatgggttggatgtgtggctctgctgatatggctggcctctcctgtctgaggcttcagctaggatggctaggctgacttgtatctgtcccatgtggtctctcatcttccaacaggctagtccagcttgctctggtagttcactggcagagttctgaaacagggtggaagctgcaaagccctagaagcagaattgccatactggcacttctgccacattttctatgccaaagcaaatcattcataggttggggaaatagatgccacctattgatgacaagatctgaaaagtcacactgcaaagaggcatggttacagtgagaagaataatttgtgactgtttttgaattacatacaaaaaagtaatttcttcttcaaattagtagaagattgtctctctgatgggatagaactgactgatagcttcctcatccttctgaaatattaaggcaatatgaagtaccccacctggacaattgtgttaattatatatgcccaatattagagcacttacgctgcagtgaggtgggtgtctctcaccataccctagacttggaggtccctgataggtgttctgaaagaagatccctgtaaggttatagggaagtaaagccgcatcccaacatggtgcacagacagcagcctcctagcaacatctcttaaagcagatggtgttttcagacatattgaggaatgaggtgggttgggagcagttgcaacaagatagggaaaccttaagtcatctttgaggatactagtttgttgtgctattttttttcttcctaaatgatttggaagtgatttttctgtgcctgatgtagtcttttttttttttccctttctt

SEQ ID NO: 27138 - DNA, 1131 bp, Homo sapiens
agacagaagtatgtttatgacattattatgtgctaattctttcttaagagtggccatcaatttataaacttccacagttcttttggaaacttcctgggaattgtctattttcgtccatgtttgtaatctctgagccatataaagagtgaagtgtattgcgacgttttcactttcaaaactattcttagccaattttgttagggtcttataaaatgtgctaaagagtcaaacgttaacatatcagctttgaatatatcaggatatagaatgtcagaagttaaacttagaattcttacagtattgtgtagcagactgctaaaattagtatatgattgatgacattgtgatttgataggtaattcaaatattttgtaagtgtttcagaggaaaatattgctataaagcaactgatttagaaattgaaatgagaaatgtcccaagaggtgaatagttgtaatatttattcaaaagtaatgttgcctatcctgctcctgataaccactatttcattctctatctctgtacatttgactgtttccttctaggattccgcatataagtgaatcatgcaatcttttttttctgtgtctgtgccagacacagaaaattatgcttatttcacttagcataatggcttccaagtattgtgttcgagatttttgctaagtgaatagctatagctgcttttgccattggagagttgggggatgggtaactatgtgagatagtggatatgataatttgtttgactatagtaactattttaatatatatatatatataaaacataatatcatgttatataccttaaatgtgcacaataaaatgtattttaaaatatggcctaaatgaacatgatgtagggtttcctttattagtattaggaaggattttaattgtgcatgtagatataagacatttccatatgaaatttatataataacaaagatattacacaaggaaaatgggtctctttcacttctacacctgaaatgtaggcggcgacacttttatctagtcatagaaaacacaatgaacttgtggttgaatgtactcaaattttctatcaaattacaaaatttgtcaaaactgtaacacatttatcatccaaattgtcttaagaaacgtgca

SEQ ID NO: 27139 - DNA, 1919 bp, Homo sapiens
gtcatttctcatagaaggagacagaattgtttactgaactcaggcatcttcataagcaccctaggtgatatagtttggatgtttgtcctgggctccaatctcgggttgaattgtaatccccagtgctggagatggggcctggtggaaagtgtttggctcatgggggcagatccctcatggcttggtgttgtctttgtggcacctccttccacccaaccttgctcccaccatgtgagatgctggcttccccttttgctttccaccatgattgaaagctccctgaggcttccccagaagccaagcagatgctggcacatgcttcgggtacggcctgcagaaccgtgagccaattaagcctcttttctttataaaatacccagtctcaggtatttctttatagcaatgcaagaacagcctaatacactgggatagtccattcattctaagtctgttgttattcaacaaatatttataaatcatatcctatgtgtcacacctatgattttctgccttaaataatagggttccctttcatcattttttttccttgccacttatttgacaatactggttgcttctgctttctgacattgaattcagttaatcttattctgcttttgccatctgtgataataagttattatcctagaaatatgttttgaatttaaactgaatatccatcttgaagttgccttaaattctttatgataaaatccatttagcataataatccgaaaagacagagtgaaaaaaacattatttaaaatagttgatttaatgttgttatgaaatataacaggactcttgaaaaggtgattaatattcttacacatgttgaaacagaacaatatgagttttttcttatctacttttcttatctggtcttctctggcttctaactttattagcattcgtatattttattaattaaaagtcttcttgatatacattctgtgaaatacttatacaaaaacaaatatcaaacctgaaattcttcaagcttctcgatccagctactgatttattgaaaacactgagaagagaaatgtatgattaaatgatgtaggatgaaatttgtccatactatactataggaagtaggaaaatcttcaggacaatcaatctggtttagtcaacaaataaattccaagaaaaaaataagacagaaggggaaacaatagtttagaacacatacagctcatcttaaacaattccaatgtatggctttcatttagattgggatttttaaaattatggcacttgtgagataatttgaatattgagtatttgatgatatttaggaattactattaatttgctttaggtattttagttatttgcaaaagagggaaactacaccgttagagatacattctgaattatttacaggtataattatatgatatctgggactggattaaagtagaataggggcatgggagaaggggttggggttggataggatgaccacgaatgaatggtttttgaggctggtttatggctttgagtgtgcattatactattaagtttacttttgtgtatattcaaaattatccatgataaaaatggaaaaaattaaattaatatataggtagatcatcctcagtgtatgaataaattatagtttattttttccaataaaaactttgttatgtaatagcatggtttcttaaattcacctgttcgatagaaataaggttaaacaagttcaagaatcaactaacatcctcctacagtaagcttcattgcaaatccagttttgacctttgctcaaagaagagaatgagaaaataacacatttgtgtgtgctcttttcctgacctatgacttgtatagatgttagcacagtggctttggttttaaggtaaacattctttcagcatttctcatccttctcccattttcctgcatttctcatc

SEQ ID NO: 27140 - DNA, 1080 bp, Homo sapiens
ttttccaaaatggtttaaaagtgttgagttttgaggagcatgcaggagttaaccagaaggttaaagtaataataataataacaacaacaataataaaagggagcagggtggagttacagaaatagtgttacagaaatatgcagtgtatgattgtcaaatttggttgttactggttagctgggtgcatgaatttgcaatcctgtcatgtgttcattttgcttattcttccctgaaatttccagccactaatggaatgtaacactttaccctttttgaacttcttccttctcaatgcagtaccacattaaaggtcaactgtgaaatttccacgtcctattaaatactattcctagagctggatataatatttcagaatgctacccctgttccaagacatacgcatactttagtgaacatgaaattctgtgtttgaatatccagatttctttttttgcctctattgtctttgctttgactttgtggatttggcaatggttgataaattgttttagagtagaagatcactagattagaaacagtatttaactaaaaatagacctcttggctgattatcagtgtctcaagagacagtgtgagtgaatttctgtttctttttgccatgatgctaactgtcacccggaatataatgcttactggcttaaccccttttgttttttatattatgtttagaatgtgtatgtctccttgtaagaatccaatttgaggggttcagaaacacatagtgaatatgcctgatgagtagtgatttttcaataatgatttttacatgttatgtctcctcaaagataacaacagagcaccatgttgcctaaattcatgtaacttccttctgggttaaactgtttattggacatttctgaatatatgcaccatatgtggctatctttcaaagtatgtgtctgagatattattcagagccttttccagccatttagagatatatgtggagcttagagagaataaaaatataatgtgcattatttactagtaattcacataaaatattccatttctaaagcatgttgcagaattattctactggtaaattaagattgaagt

SEQ ID NO: 27141 - DNA, 1039 bp, Homo sapiens
tagtttttcatttaccctgatgtagacacaaatagaatctgcaatataatcaggcaccaaccatgggattaattagctaactaattacgtaaatgggatcccagttttaacagtcatacctctgcaaaaattgtctttttctttgcaaaaacaatgaagtgtcaacttttaaaaaattaatcctgccaacttcttataaaaagattgtgtaatgtcttggggaaagatttaagatatacaagttaaagatggcctttgaaagacagacagatttgaatttaatatttgactcttttctaagaatttaaaattattctcaaagacgaaaatgaatggtctgaaactcaacgaaatcttttccatgtgagttatgcactcatggtgtccctgtaggagttagagaggtgaataaattgaacgagtaatgatttgtactcttaaacttcctggaaggagaagtggcttggagggtgttggtgggaatagccaaggtatgactgtgatttcaggtaagataatttgaggagctgacaatttacctgcgtggaagtatccagcaggcatttgggaatatgtaattggctcctgaatcagacatgtcagtgaggtgatactcatataggagtcagttacctaaaagtgacagctaaaccttatgaaggcaatgaattccaggttagtgcagagcctctgcacagttccaaacccaggggatgctcttctcattctcttatctgaagttaagctccagggcttatcattcacataaactacattatgaacaatgctgtttccatctctctatcatgccagatgtcatatactagatgaggtctctcagaagagctagacagaagtataaggactcacctttatatatacaaagtgaggaacaagacaatatgtacaaggactcatattaacatatgcaggatgaaaggggaaaaagaggtcagttaattggttttaaaaaaaagatgaaataagacaggctcaaggaaaacggaaagggggcaaaattgcgggaagtgtttggcct

SEQ ID NO: 27142 - DNA, 1035 bp, Homo sapiens
gtttttactaattaagatcagatttatactcttttgtatcagagaatgtcatggtgaaaattaatataacaaagtcatactgacatttactttagatcagtgtaaagatatactacatgtccactggaatggcaaaaattgaatgactggcagtaccacatttggcaaagatatagataacgagaactctagtgcattgctggtagcagtgtaaattggctactaccactttggaaaactatttattaatgtttgtctgtgccctacatatatctactgtatcagtctaagataaatgatcatatgtgtccactagaagatggttacaagaataatcatacagtcgtatttgtaatagccccaaactgtgaacaataaattatttatcaacaattggatagataaacaaattgtagtatattcacaaaatagaatactgttcagcaataaaaagaatgaactattaatccatgctacaatatggataaaatttcagaaatgtcatgttaagtggaagaaataggacacaaaagagaaatatgattccttgtatatgaaattcaagaaaggcaaaactaattgaagctggtagacatcagaagagtaacccactctcttcctggggagggtttttccaggaaaggggtgcctgataattttggagatggagatgtctaagtggtgctttcatgagtgtgtacatatgcaaacactcatcccactgtgcacgaaggttagatacttccccatgtatatgctataccgcagtaaaagtatgaaatatatgttttatacctcaaaatgtttcacaacacattattttctcctttccaattccacagagaagagagaggctaagtctagtacaaaaggttggttctgggccaaactggagaggagatgatgcaatggaagtatccaggcaaatacaaagggattttaacttgtctgtgtttattgcaaaaaaggaaatttgttatattgtgaaaatagtaaaatagtgtggcttaggagaggttctattttggagggggg

SEQ ID NO: 27143 - DNA, 1043 bp, Homo sapiens
tctcaaatcattctgaagcagtggatgaattcttcccttaattcaaagaaattattgtttcctattgtcctcagtgagaagcatctttgctattactcagactagggaaactaccaggacacccattcaacttgtttctttctcaatttgtggttatgaacaagaattctcagtaagtttggactcaaccattgacttggaggaggcatcagtgttaggagtcagtgacttgctctgccctagaaatttctgttattttcttagctgtcagagttactgcattaggtctagctttgtttcttgtatgttcttgttttattttgtttataactgttttgcccatgtttaaatgtattctgtgaagtagtttttatcttctgtcttaacctgaaaatcagtaaagggttttaacctaagcccggaaagttactgctatttcctttgcagatggtgcattgtccctgtgggggagctgtctagagggtataaccaactgtgtgaactaggcctatcagaaggacatttcactgaacacctgctggcttttatttttttactttatcttttgtcagtgtcaagggtattatattttttcctttttttttttcatcaccacttacaagccagataagacagaacattcacacctcactgactttctttttattgggaaatttttatttttcctcttgatttattttttcttgctctgagtaggtttataaaactaaagtgaggaacattcagataagatgcactgtcaagattattctaaaccccagcatctttactattttgaaagcaaaacttaaaacaaaaaagattaattaaaaatgttcttaaaatttgaaggtgttttcctttccaaaatgtatttctgcaggaattcccactgatttgaaagataaaattgtatcagatcaacatctccagttaaaaagctagttttccatgttttatttccaaatgctatcaaggggataaaatttaaactttttttgtgcacacatgttattcacatgtgagaataatgaaacataata

SEQ ID NO: 27144 - DNA, 1031 bp, Homo sapiens
tctattgactttacccaaggacttgggtgattgtatagaattcattaatcctgttttccttcaaaactctgtataccttttcctaccttctggtatgtgacataacgtgtaagagtggcctgagttttatttctttgtaagaaattattggccaagcacagtggctcatgcctgtgatcccagagccttgggaggctgaggtaggaggatctcttgagtgcagaagttccagaccagcctagacaacatagcaagactctgtctctgcaaaaagaaaagaaaagaaattattgctcttttggttttatcgtcctggcagttctaaggtactttttctctcctcttgaaattgccccccaaaattagctcaatataatatgagtgcacattgataacatttcataacttcccctgggaatatcaagaattatattaaatagacagatctggaaatgtttccttccactttgcccttaattcttatttctcttgggtctgcttggcctcttcctctggaacatcagtttatactacttgagtttgcttttcatatatgttgtcttctttcttagtctaagaatctgtttgtcttttgtgcctcttcattctgggagaatttaaagggtttgttcctgtaccagtggtttgctttttctgatctgacatttatgtgctcgttttctaataaagattttaatattgatatggtatttttatttctcagtgttatgttagcctaccctgttcttgttttgtttctgcatgtgtctagctcctgttttatctcattctctggcatttttgtctcattgtttatagagttattgtttcaaggaattttattgatcctataaaccagatgcttcacttgtgtttgctctagtaaatattttcccaaatgtatgctccttctcttcgttttgcttttatatatatatatttctatacatataaatataaaatatttctaaatatatatatttatatctatatacatatacatcacagtatcttcagggctcaatcttttg

SEQ ID NO: 27145 - DNA, 1049 bp, Homo sapiens
ttttgtataaggtaggaggaagggatcaagtttcagtttcctgcacatggctagccagttttcccagcaccatttatttaataggagatcctttccccattgtttgtttttgtcaggtttgttgaagatcagatggttgtaggtgtgtggtgttctattccattggttctgtatgtctgttttggtaccagtaccacctgtttcggttactgtagtattgtagtatagtttgaagtcagctagtgtgatgcctccagctttgttctttttgctcaggattgtcttggctatacaaggtcttctttgatcccatatgaaatttaaagtagttttttctaattctgtgaagaatgtcaatggtagtttcatgggtatagtattgaatctataaattattttgggcagtacggacattttcatgatattgattcttcctatccatgatgatggaatctttttccatttgtttgggtcttctcttatttccttgagcagtggtttgtagttcttgacaagatccttcacatccctcgttagctgtattcctaggtattttatgctctttgtagcagttgtgaatgggagttcattcatgatttggctctctgcttgtctattgttggtgtaaaggaatgcttgtgatatttgcacattggttttgtatcctgagacttggctaaagttgcttatcagcttaaggaatattggggttgagatgatgtggttttctaaatatagaatcatgttgctgcagacagagacaagttgacttctctcttcctatttgaataccctttatttctttctcttgcctgattgccctggtcagaacttccaatactaggttgaataggagtggtgagagaggccatccttgtcttgtattggttttcacagagaatgcttccagttttttcccattcaatataatattggctatggctttgtcataaatagctcttattattttgagatatgctctatcaatgcctagtttattgagagtttttagcatgaagtgatgttgaattttatcaaaggccttttct

SEQ ID NO: 27146 - DNA, 1053 bp, Homo sapiens
tctgctgtggggctccaacactgatattttctttaaagttcccaagagattccagtgttcaaccaagtttcaaaaccattcgtctaagtaaaaagagtaccagcttaaatggatgatttctcttttgaaaatagagattttacacagaaaagcattgagaattttcctacaaaatatgcttgtcaaaaggaccacttttcagtcaagttttccttaaacttgaccactatacttaatgtagagaagtacaccacggtacttgtatcagtcttctctggttaccacagcaaagtaccacaggctaagtggcttaaagcttaaacaacagaagtttattctctcacaattctgggagcgggaagtctgagacaaaagtgccagcagggttattttctttggaggcctttctcctcggcttacagatggctgccttccccgcatcttcacgtggtcctccctctgtttctattcctaatttcctcttctaataaggaacaagttgtattgcattagggcccaccctcatgaatgcatttaacttaattacctctttaaagcactattgctaaatactattaccttctaaattactgggggttaatacttcaacatataaatgttgaggggacacaagtcagcccttaacagtgttccctcattacattacaaagcctagcttaggatttgcttctttataaggagtagcagtgtatgattattttgctgttggtttaatatagaaaagtagatttttttctttataatcaatacaatggtcaatgtggataaaactgcatagtcagaatcatttcagaaatacacaattgcttttgcagagtggctttagtacagaatatgttgatttggcattatcagcactaatttctgcatgccccagggcacccagtatgtgtctttgtgtattgcaagtgcctataagagtatagttattaaggtcacaagctcttgggtcagaaagccaagccacaacaccaataacaagctgtataatcctgcaagttatatcatgtctctgagacttagtttcttcat

SEQ ID NO: 27147 - DNA, 1064 bp, Homo sapiens
gattgactgtgacaaatatatcatactaatgtaagatattaacaacagcagaaacagtttcccctgttgtagaaggtatagataggagtattctgtctattctctttgcaacttttctgtaaatctatttatagacatctaaaatagttgctgtagtagggcatggtggtgtgaacctatagtcccagctaatcatgaagctgaggtgggaagattaccgggggccaggagttcaaggctgcagtacatgaggatcacacctgtgaatagccactgcaccactccagcagcctgggcaagaccccttcttaaaaaaaggaaaaaagaaagaaaaggaaagaaagaaagaaaaaggaaaaatgaaataggtactgtaaaactgttctgaattggaagttttttttaaaaaaaaaaatcagattatggcgacataaatattagacatcccttagcaaattctctgatattttaaatcagatgcatgggacatactgtaaatttgtagatagctgaatgcaacacatatttaatacaatgattcttaactctggatagctttacacctttaagcatattagcatttttgtctgagtagctgaaatcacactgtaaaaaaagtcaactgtgttagggtctatttctagctgtgccactgcccagctgtggcatctgaaacaaattacttcatctcacattcggcagcctttctgcccacgccacaaatatagtgctgtgtgttcaggacacttaagaagtcatgtaacagtaataatttttttttattgctaatagctatgtaatcttatcaaggtctatttgaataaagggctctacaatccaaaatatagttgatttactatcaaataaatttaattttcagtattttacatggtattcaacattgtaatttaaacatttcgtttagaaacaagtagcatttctgtgggttagagactgatttggagagaccacatccacattcacttaccatgtgttcccaactaaattagctgaagatgcaaaaacccagtggacataaagtcagggctaagggagagaaagtg

SEQ ID NO: 27148 - DNA, 1042 bp, Homo sapiens
tcatggtttcttctccttatctacttctttgtgaatgtgataactcaactttggaattgtaactttgtttctggcatcgcatccttcctaacatgctcattccaaaaactactctttcactgcactacttaggcaagaggcccccggccatgagtctcagagttctcctcctcatatcaccaaagtgtcccatgggttccagtggaaggtgagcaataacagtatctcctgcagccacctcacagaactgttgtgaaggatagagatgataacagatggaccatgtattcactttggaggtaaatagacttggatttaaatcctgagtctgactgagtaagccaagtcaagttatttaacttctatggtcctcgatattctcagtttcctatgatggggctaatagtacctacttggtagaattattgtgagaattttcattcaatgaatgtggactgaacacttgctatatgtgggctactattctagggcctggggatgtaaaagagaaacaagtccttgcctccttgaattcagactgtaaataaacaattaactacataatataatatcagaaagagtttggtggctggaagaatagcaaagggtaaggggagagagagagaggaacagagtgagagtagtgatattgcagagggtgttcaaggaaagcatcttacctgcatgaaataaagggataaaccatgtagaaatctggaagaagagtatttcaggcagatggaagagcatatacaaaacctctgttatggactaagttgtatccctctaaaaggcatgtgctgaagccctcacccacagtgtaactgtatttgaaaataaggcctctaaagaagtaattaaggttaaatgaggtcataagggtgggctctgatcccatggactgatgtccttttaagaagaggaagacatcagagctcactcactctgtgcacacacagaggaaaggccatgtgaggagacaggggaaggtggccgtctacacgtcaggaagggaggcctcaccagtaaccacccctgaagg

SEQ ID NO: 27149 - DNA, 1045 bp, Homo sapiens
atttcctgcttttaataaacacaagttttatgagaaaaataaataaatttcaatataaaattaagatgtacagaatatagatttagcacatataaaaaaggaaacaaaaatcattttaccttcactttagcctgggctgatttaacaaaacaccataaactgggtagatttttaacatcagaaattaatttctcatagttctagaggctgagaagtccaagatcaaggtgctggcagatttggtgtctggtgagagcccactacctcacagatagccttcttctcactgtaactcacatgggagaagtggccagagagctccctgggacctcttttataagggcactaatgccattcaggagggagggcatcaccctcaggacctcatgacttccccaaggctccatgtctgaacatcatcaccttgggggttaggatttcaacatatgaattttggattgggacataaagagtctactgcaaatttcttcatgtcagtcacattttaaccaaaatcatcttacatggacttctctagaggtagttatattttttaaccaactgcacttttatatgataacatatttttatatgccacctgcaaaagggctacctaatgaggccacctattttttgtaagtgtaagagactcagctggaagcaagttcaagtgtgaagcactgtcccctctctacctgggacatggtgcatacaaatgggagtaacatgagctttgcaggggtcatcttggcctcctgtcccacctccaccacttaccagtcatcattcattattgttattccatgaacaatgccacccacaaacccagagtgactctcagttcattgcttgtcttcacccagcgtaatgccagttgtgtgtccttaacatctttctcatctccttattttgtcctcacttctctccccactgccaatgtttaggcctgcagcaacgatttcctaaattgcccaccttccatccagcttccatcacactgctagagtaacacttcagaaaatccaagttcaatcctattaaaatc

SEQ ID NO: 27150 - DNA, 1080 bp, Homo sapiens
tgttctcgaactcctgacctcaagtgatcctcccgaagtgctgggattacaggcatgagccaccggcctgctagcttcttctttcttgtcatgtgtctcttttgagatatcactcttccagagatgctctccttgaccaccttgtctgaactatccttatagtccccttgtgtcatctccttttgctttcttttcttcagatcatttatcaaaatcaagttgtttcttgttcacttccatgtgtaagtattgttgtctgtctaccccaattcaaatagaaactccaggagagtttgctcactgctatatcccccagttgtgcatgtgggtaccaggtgacactttctaagtagtttaaagtgagtacatgttcttaggaacttgctatgtggcctgaagctttctagaactcaaaatgaagagagagaaattagaaaggcagatgcttaccactgctccccagggaataataatttgaaaaccagcacttaattataatagacttgtattgccaggaaccccatccagtgggtactgagctggtacagtgagaaaactgtcaaacagaactttgtacaggagatactcttattgtggtccaaatctggagggttctattagatgaagttcatccaaacatagaacttagattaagggagtagatgtatactccacagccaatccttcacaaaactcatttgtctccattgggttttttataagctctggaaaacaaacaaacaaaagagatatttaataagttatctatttttttccagagtttcccttgttctcgtgctgatgattaactttaactcttcaaatcaattgtaagctgcctaaaggcagaaaagataatgtatttaaatatgtcttcttattcttaggacagaagaaggtccctatacatggcagatgttcattaaggatcagggtttagtgatgttaatgctattatataggttcattagtcatataaaagttcattatgtgccaggcactttcaaggcaagttctgagaaacaacattaatgactgggcacagaatctcagactagaggacctcatctggtgaacttg

SEQ ID NO: 27151 - DNA, 1050 bp, Homo sapiens
gggccaccacgcccagctaattttttttttgtatttttagtagaggcgaggtttcgccatgttggccaggctggtttccaacccctgaccacaggtgatccgcccgcctcggcctcccaaagtgctgggattacaggcgtgagccaccgtgcccggcaaccctgatctttttcaaactgcaatttaaaatttactgatcacacagaactgaattgatttttaattgtcattctgaagaagtaattaaactttaattactacttctgaaagagagggtttttactaggactttttctgacaggacaataatttcattttttgcaatttttatttataattggcaaataatgattacatatgtttatggggtacaatgtgatgctatgtgtatatattgttgaatgattagatcaaactagttatcatatccatcacctcacacactaatcattattttgtagtgagaacacttaaaatctgcactgttagcaattttgaaatatatattattattaattatggtcaccatgctgtgcaatagatctcaaaaattattcctcctgtctaactgaaactttgtaccttttgattaacatctctgtctcagcctctggtaaccaccattctactctctacttctgtaagtttgatttttttagattccacatataagtgaaatcataacagtatttacttatctttctctacctggctcatttcacttagcgtaacttcctccaagttcattcatgttgttgcaaatgacagaatttgcttcttttttttaaggctgaacagtgtatatatacatacaaaacatttctttatccattcattaactgatgaatggagataaatatatataaaacatttcttcatccattgattaactgatggacacttaggttggttccatatcttgcctgttgtgaataatacttcaagaacataggagagtggatatttctttaacagttgatttcaaatcctttggatatgaacatggaaatgagattggtgaattctagggtaattctattttcagttctt

SEQ ID NO: 27152 - DNA, 1047 bp, Homo sapiens
tatgtatgtatgcattccttgtgcctaaaacacttcctgctaggaaattaagccagccttctatatttgtactcacaatctatcctccaagatatgtagagttgataaaaattaatgcttgcctacaaaatttcagcaatgcttctcctatctctgtacctcccctctgtatacatttgaaaaattaatcctgaccatcccaggaggtagaaaggaaagggtggtaaaataaatagttccttgagattttataaattcatccagattaaaatatatatatatatgtatatgcacacttgtcttgaaaaagttgtgatgatgttatatatcagaaataaaaaattgtttccactcatccaaaagtttaggactcacaaatttttttcaagcagaaataattttgtttcataaatttggtttaatttcttttgattacataaaaaactagaaatggaaatttatgtatatagcaatgtaaaaatgatagtgagtttaatgctaaaatctgatctactgggctctgtttaacctaatacccaaagcttaagtaatggttaagttggggtttagaggggcctattaccttcttcagggcattggtattttgtttcctaccttaatctaaaattagtgtcttatttgccagtctaatatattttacaatcaatctacattgcctaccttttggagtatttctatttaaataaaacaaaatgagcgtttaaactgggaacgtattagattcttctgagctattgagcagtatcagatccttcagcaagaaagctgttttatcatttactaagtacctaggcacagcatcaccttgcccgttaaaagccctgtcaggtacacattttggttgctaggcagctgctggggaagcaatctcttccacacatatggtttatgccacctggcctgcatttcacaccaacctccccaaacttcccagggagttgcaagagaggtcctcatgttcctgtcttcactttccatttccctgtcataagcactccatttgttgtcagctttcattaaggacat

SEQ ID NO: 27153 - DNA, 1025 bp, Homo sapiens
tctgccaaaccactagctaaccacaagctaacaaaatagagacttcagagtccatacaacaaaatatatagcctttaaaaatagtccggaaaaatgagcaaagtgtttgaatagacatttatccaaagagatatttaaatggaaataaacacatgaaaagatgcataacatcagtaatccctcaggaaatgtgaatcaaaaccacaatgagataccacttgacaccatttggatagctattattgataataaataaataaaataaataaataaataaataaataaataaaataaataaaaaaaataataaaaatggaaataaaacaagtgttggtgaagatgagggaaactgtaacccatgtatgttcctagtgatgataggaaatggtgcagccactgtagaaaatggtattgtattttttcaaaaataaacatagagttaccatataattcagcaagttcacttccgggtatatatctcagacaattaaaatcagggactgaaacaggcatttgtacactcatattcatagcagcattattcacaatagacaaaaggtgaaaacaacccaaatatccatcagtggagaaatagataaacaaaatgtggtatatacttacaatggaatatgattcagccttcaaaaataaagaaattctgacacatgttagaacatggataaatcttgaagacatgctaagtgaaatatgccagaaacaaaaggacagatatttgtatgattccactcgtatgagataactagaggagtcaaatttatagaggcagagtggcagttgccaggggatcatcagagagaagtataagtagttattgtttagtgagtacagagtttcagctttggaagatattaaaaagttctgaagatggatggtggttggtgatgattgcacaacacaacattttgaatttagttaatgtcactcaactgtacacaaaatgactaaaacagtaaagttgggctatctatattttatcacaataaaaaatagtttagaaaagtcac

SEQ ID NO: 27154 - DNA, 1059 bp, Homo sapiens
tagaaaagaaagagggacaagtgaagggttctgctaaggccacctccgggccattcatcaaaaacttcaggaattttcttagagttgccctaaaataatagtattagctatttaaaagtgacctcaagagacatgaggttcttatatttatttttattctgggaacatatgcattgaggtaagaattttgaaacacttgcgtatattctgtacaaaatgtgtgctttatctcgtttctattttgaatttcaaacaaatttatgatgagtaagcagtagctgtaagtttgactttaaatgaaaaatgattaagaaaaaagaaaaggtggtgccataaattgtgttcagcaatttgttttgggacataatggaaaactgtgcatgacttccttgcaggtagaatacatgtgccaaaaagatcactgtttgcaaacatgaaaagttagatccatgttattgtgttttgtgagatcatcattacctgctattcctgaccttattatattaaaaaaaaatgcctgtgtcatcttaggctattcttccacccaatcataaaaaggaccaaattcttactgtgtcaatacattgcactatttgtcttggaattttatactggtaggtgtcctttgttggagaatgagatttactctacattctgcacattttggatatgtgtcaggcaaatgaaggatgcacaacttaaacttttatattgtgaaaacatcgtctatctggaacatttgtttaaaagctcataagtcaaaagaaagacattcgtattaaaaagatttttattaaaaaaggggcaacttggatttcagtctctcccttacacacacagaagcagcagcaattgctattctggtgactgtggaagaaagcacccctgccttctgtctcctgggtgtcttttctgcatttgctagacaagaacttttttggagccagagagtgctcaatggtgcccacataaaaacaattaatgtcaaactgaagggaaaatgtcaacgctgagacatagaaatgactgtgatttcagactgtgggttactgttagtac

SEQ ID NO: 27155 - DNA, 1026 bp, Homo sapiens
gtagagggtacaaagagaaaaaattgtgatagattactgtaaaaccccataatcctagaaaaactgattttgattctaatggaaattaagatgatgtctcctagcatttgcaaaattatttagtgccattttatgaatttcaaatcgaaagaggcacacaaaatatttaaaaatttaaatatttttaaaggcaactttatctgtttttctataccttaatatgacattgatcacaaaacctctgtgtcaaccttaatagcagtataaagaagcaacatagaataatggttccacttttgagtttcaaagctgagatccacctcactagtttcatagccttatgcttaacttctctatgccttaattatttcatcttcaaaattaaggacagaagaattcttgatacgcttttcatagatttgaattaaataatacctgcaaagcatttggaaagaagaatctgggcctgtgtaatgtgataaataagtgttaactcttctcaatgttttgaagtgtagtatgttggttttcattcctcaggtgtcgttgtccattttttctaggagatcccatgatttctgggccttaaactttcttctgttttccccagcacctagaagatgcacctgctcatgatgaaatccttaatgtagacttgtagttgtgatctaatcagtgacccaaagcatttgtgccccaacttatcacttaagaatattgcctagtggtctctgtacagaaaaattttggctaatgctgtctctacctaaagccttatctagcacgtgggaaggacagaggctttggagtccaacggctagaatatggctaaagggccagccacctgctaccgtataacgtgcatcctcagtcaccccaggggactccagcacccgttcagaagttctggctggctgtatttgtagctccttcttctctagaatccatatgaaagaaattcaactcttgaggagttaaaagtcaaattacaaagaccttagtagggtcacttcagctttaaggcat

SEQ ID NO: 27156 - DNA, 1047 bp, Homo sapiens
tctacagtccctcagtatttaagtcttattagcaaaagtaaatgtgaaaaaggtattgtgtgagattttacaacagcccaagatgaagagtatagatgtgtgtggtgtttgtcgatggcattatgcttctatccttgttctgacaggattctggccttttggaacattctgtctaaggattgaagctaatttagttgagaaacctaaatattacatttcgagaatgaatttaacacctagatttccaatcttgaaattacaatagtcactcacttatcaaagagtagagtagaaaatagttctttccttttaacatcttttctctcttaaaattggaggacagggatttataagtagtgttccatctatccatccatccatttatccatccatccatccattctttcatccacctatccacctatggtatgtacttgcatgtgtgtgtgtgtgtgtgtgtgtgtgtgtgtgtaaacatatttaaaaggcaggtttactcattgcttttggtacagttctctaaactaaagaagcttatgttggtacttttattgtccatgaaattatattatgaaacaataacaggtaggaaggatgggttcccataaatatcctcttactctctttgcattttgtatcatgtgcactactaatctcttacatttgttaatccattgctatggttttgacataagttggactgacaccttcatttagcagatgtagaaagaggcccagagaggtccacttacaggcaggagtagggccaggccagaaatctagtctcccgtctttttgcttttcttagcaaacagattccccaatgagcagacttgattgtgtcttgctgcacagcaatccacactaaccatacaggtgtaatgtccattatctaaaaaccccagtccgctttgatttcggatcatgtgcttcccttctctactgtgcagatgtcaggtaaacaggtcatcgctgcactgcttcattgtttgttccagtcttcttttctctgggttccttcctttattcattttcagctgttatgaa

SEQ ID NO: 27157 - DNA, 1043 bp, Homo sapiens
agactcacctacactatccccaggtcctcattgtactcattttattcattcacacgttttttgaatgtattcaatatgccagtgaccaagttctggagaaaccatactttgtaaaaagtagacattgtccctgctccagtgaaatttacccccccaaaaaaggagagaaggaaccaataaacaaatgatctcctgaactaattgtctagctacaaacccagacaagttatctgaaagaaaggagcatggtgccaggaaaacccagactggtctgagcaaggtaggtataggggatcgaagatcaggcagaacatcttggagcaagtgatatttgaactaagagccaaaggctgagtaggaattaactaggtaaatggtataaggtctggtagagtgagaaagagtgtgtggatgaagagaaaccctttcagatacggagaataatacacgcaaagtccctgtgataggagggaccatggtgtgtgcaaggaactgaagagtcatggtagatagaccacagagcatcaggaaaagaatatacaatggagccagaaaggtagacagaaatgaaacccataaagccttggctgctgcattaacaattttggcttttatcctaataagacttaaggctggctgaaggtagtgatatgatcagatttagactttgaaaatatttttattgattaatgtggggagcaaattaaagggtagaaggggcaagcgggttgcaaaagattagctagggatattatgttagtgcaggcaagagactctggcagtgtggagtcggtttatgacagtggtgatggacagaggtagaaggatgtgagaaacagggcctggagccggattggctgtaggatacagggaaagggaggagtcaaggaattgcctagacatgtggtttgtgcaactgagtggattttgactcccattcctgggctaggtgtcaaactgccaaactgggaatgagggggagggagccatgacagcaacgttggacatagtatgactgagatgttttcaggcatctagagaag

SEQ ID NO: 27158 - DNA, 1034 bp, Homo sapiens
tagtcctagctatttgggaggctgaggcaggagaatcgcttgaacccaagagatggaggttgcagtgagccaagatcgcgccactgcactccaacctgggtgacagagagaaactctgtctcagaaaaaaaaaaaaaagcttgtgtggtggactctaacctaatcagggctgatttatatgttgtttttttctcacatattttcctcaatgttctgttcatatcacatagaatcactgagaattcttctctgacattcacagggcccctaagtactgcttcacagactgaactgaagcaatattaatgggtctcttcctagataagcccaagcctcaagcatagccctgcgcctcagtcagccaatctagaaatagggcaagcttctaaagatgaaagggcacagtctctgcttttagtaatctcactagggcaatatagccaagtggaatgaagagatgagacaagggctagactgtgtgacatgggccataggttgacagaagctccaaaaatagagtgagtgctctgaggaagctacacagtagcaagaacatggtgagctgggtggaaaacaatgagttaggtcttgcaggatgcctggcaaaggtgggacgtctgtagagggactggcttgagcaaatggtctcagaacaagctgtggattccctcttttaaagttccagactttcataacttcactttggcctgcatgctttccttttggaggcaatatcttcataaatgccataagaggaaattcaacacagaaccctccactgatttcattttctatttgaatttggcagagacccctttaagaccgaatctcatcaagaaaaatataatctgagctacatattgtactaaatcacttcccccctttttaaatttgaaatcagcttttcttttatatatatttattttgagatggagttttgctcttgtcacccagctggagtgcagtggtgcgatctcagcacactgcaacctctgcctcctgggttcaagtgattctcctgcctcagcctccgg

SEQ ID NO: 27159 - DNA, 1048 bp, Homo sapiens
gcctcatcttctgggctcaagcgattttcctgcctcagactctcgagtagttgggaccagaggcgcacactagcacacctggctatttttttctgtttttgtagagacagggtctcgctatgttgtccaggctggtgttgaactcctaggctcaagcagtccccccacctcagccttccaaagtgttgggattacaggtgtgagccactgcgtctggcctggctatgtttttttgaaatgatatgttgataaaggactatataaattagaaactataccttcttttcttttcttctcttttcttttcttcttctcttcttttctttcttttctttctttttttgagatggaatgtcactctgttgcccaggctggagtgcagtggtgcgatctcggctcactgcaacctctgcctccctggttcaagcgattctgggttacaggtgtgtgccaccaagcccggctaatttttgtatttttagtagagatggggtttcaccatgttggccacactagtcttgaactcctgacctcaaatgatctgccctcctcagcctcccaaagtgctgggattacaggtgtgagccaccacgcctggctgctacaccatgttttcttttaaagagatattgggagaaatattgcaggaaatctaggtcactgattgattcctaactgtgttcagaagggactactttgataactgtaattgttattaatgatatgaagtaaattatttgtgaattttaccacattccttgaaagactgagactcagtcagggttagtgagtcttgattagataaatgacagcaaagtgaaatactgtttctgtttcccaaagatggatttagtcctttcatctgtttctccagatactcattttttaagaaaaattctggtttggttggcagtgacattcagattctgattgtatgccttctgcatgtttatttttacaacacactgtgaattgtagaaatatggtgggacagtcatatttccttggcattgaaaccttgcatattcaagaaagtctgtgctaggtt

SEQ ID NO: 27160 - DNA, 1048 bp, Homo sapiens
atattttgtttaaaatactattcagaacctgacatagctacagcatagaatggggtcacataataaaggttcttctcctttacatatgtgcgtgaactttcagtgagtcacatgaaatgaccactggtttggtcatttgagtttatttgaatacattagttatgagctatttagttctttcaagcagtcataattcattctcaaattttaaatcagacatgtactgtagctagcacgtagtaggcttttaaatgtgtcctaaaactaatatgtaagatgaggacatgggccacaaactgttattttgctttccttccttatttcatggttttgtatatcttattttggatttgtatgcattctgctgcttctaaaattagtatctaagcaatgcattttttaacattaattatcaagttttgtcttacttttaaattctgccttatataaggcagcataagtgggcattactgccttgctgacacctactttcctggggtgaaatatattgaccttgactgtaaccttgacatttaagatagttgactagactctgaaaagagaaagaccagcgtgattgtaaatcacacctatttgtataacatcctcaattacgtaataaaaataatccagaaaattgccaagatacttgaacatattatacggggattggtcttagaagcacagacttacccatgggaattagttcattttctgaagagtccttcaccaaactgaaagttgagtttacagtcctgagaatgtgatgcctctttggttattataaccacaaaacagtggaatggctgtttcttcctttaagcaaaatgatatgtttaaactctttttttgagggatgatttaaaatgtgttaattatgtggcttcatttggaatataagagatgatataaattaaattatcactgaaatttttaccctgcctgcctcactcactttgaccttaggaccttacaaagagtgagaaaaagccatcatgatgagaaaaagtgatcatctcaaactcgtgtatgtagatgaaaaaggata

SEQ ID NO: 27161 - DNA, 1033 bp, Homo sapiens
ttctattttttcttcacaggaaaagacaatttctctctgattcagaatcctgaaaatgtgatctcccttaaaaaggtaggtgtatgtgctttttaatttgtgactaaaaaaattttatcttgaataaattacaatccagatgatttaatcgagaagcaattttttatgccactaacacgtgccattgtgaattgaattaaaacctcagattcatctttctaaattcaatatttaactttgccagtctttttaaagaatgactattttgagacaaaagttgatgtctacagcagtcaatgtatgtgatgtataataagtgaatgcttctcagcagatccatttttttattgcaatacatttatttcagctcatcttgatgaaatgtgttcctgtctttttcagtgggtgacatctttctaggaaaccaagacagtgtggaaatgtaaaatggtctgtggccagtaaaaaatgtgatatctttcattttgtggtgtgagatttctttttcagtgtgtggattgtgatttgctgcatactttgtcagctgtaataaggttgggggcattcttgggtgtacggtatctttttgtaatccatacagagcctgcaagaggtttccaaatttcatggagtgaactcatactagcttaggagccactttggctttcttttttttttcttttctgaggcagagtctcgctctgtcacccaggctggaatgcagtggcgtgatcttggctcactgcaacctctgtctcctgtgttcaagggattctcttgccttagcctctgaagtaggtgggtctataggtgcccgccaccacacccagctaatttttgtatctctagtagtgatgggatttcaccatgttggccaggctgatctcgaactcctcatctcaagtgagctgcctaccccggcctccgaaagtgctgggattatgggtgtgagccacagcctggcctttttttttttttttttttttggtttttatctcatactttttattctgaaatatggactggctctcct

SEQ ID NO: 27162 - DNA, 1055 bp, Homo sapiens
ctaatttgtttgctttggaaagacctgacaaaaatagacttcttttaacacaaatggataattttctcccattgatgggcagttcatttaagaatattttatttattgtattataaaaatagcctctttgagacgaatggcctgctccaagtaactctcataaaacatagggattttcttccatacagaaataattactttgatttaaaatgggatattgccttctcaaagtattttttccactatgaagtatatagaagtatgtatttaatgtgtcttaaagtccactagtggaagtattactatcaccttttttcaaggctcattacctaaaatttttctaaaattaaaagcaaagacaaatatgccttacatttagaccaaattaaaaaaatggatctttattttggatagtccctttacctgtgctttactttcattatcacaaaaatatccttaactcttagcatttcataacaactgtgaccaatttttattatgtagttggaagtgttaagaatctgaagagaaggccttttacagtgattatctttgtgaacagtgtttagatacgttttggagacctgttgaaacaaataccctactctttttttttttttttttgagatagagtcttgctctgttgcccaggccgcagtacagtggatgatctcagctcactgcaacctctgcctcctgggttcaagtggttctcctgcctcagcctcccaagtagctgggattacaggcacgggccaccatgcctggctaatttttgtatttttgtagagatggggtttcaccatgttggccaggcaggtctcaaactcctgacctcaagtgatctgcccacttcgacctcccaaagtgctgggattacaggtatgagccactgtgcctggcccaaataccctactctttattgattgtctcacactgattgataatggtcagttcctcaggcataccatatgtctttaaaatattataaaaaactttgtaaagtcttttgttttataaacagcttatctgggctaggcctggagcatattcat

SEQ ID NO: 27163 - DNA, 1076 bp, Homo sapiens
aaagacaagtcttcagtggaaacagcactttaatatcaagttttgaatgaactgtattcatttcattcaaaactcagctctgacaaatatgggtaaaggacatcagtttcagaaatgcaatgcaatgcttgcaattatggaaattatttcatgttttccaattgcttatattaggttgattatatttaatgtttattcctgacaccaaatttatgtattttagttataaaatttgtgaattatagctgcaaaatattatagttttcaagtcgaattattaccagcggcattcctgtcaactttgctttcctcaggactttcaaatagaaatgttattaaatatttcctttttgtcagtgtttgcacttgaaggtaaatttaaacatgagtgtgttgtttggtttctctcattgtggatggactagctagtttaatatttaatggcaagttttgatgtatactgataagaagagagacaaagaaacattattgtatttaaatattatctttctgattgtaaaagtggtgcttgtcgtagataactctgtaaattcaggaaaacataaaaataaagatcactgttgttttaccacacacaaaaattactataactataactcgatgttatatacattacctattatatactgtattttaaaataaaattgggattatattggacatacaatcctgtttttttttctgttaacattatattgtgattacgtcctacgtgattttgttttaaacatggtttttaatggttgcatacctttaaaacaggaagaattataagttatcccaggaatcttctgttactggatacttaggtgttttgtttcattgctttaaaatcatttctactcctcttcacaatgtggatacttgggaattgtcacatcatagtcaatttcacaagacaatatagattaactagccatgcactcttaatgtacatatgcagtatttcagacattagaagtagggagatcagttttgcttgatgcaggcagttaaaaatcacgcgcatgtaaagaaaggaccaattttacttgcctcagtgttggcccaagttt

SEQ ID NO: 27164 - DNA, 1035 bp, Homo sapiens
catgaaaaggacttttattagtggcaggtcttcagatagtttgctagagaggagaagtgcttccaagttgagtgaaagcagaaagcgagccagagttgcattagcaagtgattcaaacaatgaaatctcaagcagcaaggcagctgacatctcagcacttactctgtgctgacagataaatataaattatttttgagacagtggttatttgagatatgtaaaagtttttagatagatatcattatcccaattttacaaatcaggaaacaagtttataaggtttgtaattagtccaatgccccataaacagctggtacataatggggctagggtttgaacgcagcttatttgatttgaaaacctaggttctttccacatgttaagtaatcccttgcctttttgagaactgcattttatagttagcatttatcctaagtggttcatggtttttactaattttaaagggaaagttctagttttatagggaagataacgttggcttgtgaactcagtgagaagatggacagtagagaggttaacttgtccaaaatcaaatcgctctgatgccaacccaggtttgttggagtgcaatccgctgctcttacctaccatgttgtgctgtctggctgattttaccacccaggagctgttgattaccagtgtttggttaatcataggaaagtctggcttgcagccattgccagtgcacaaatcatgttctgtgaaataaattttattttattgactcgaagagacaaaagtgaagctatgtcttctgaataatacccagcattgcttgtattggactttgtatattttttttcttggagtagaataaagtatgtagacaaaataacttatgaagcatttttattgttctgtggattctgttctaacttgaaaggtaactgctttttcactttttagattctacaaaaaagagtgtttgttacctggtgaatcaaaacagaggttccattctgtgatacgaaaagataattattaataaactaaaattaaataacactaatacta

SEQ ID NO: 27165 - DNA, 1069 bp, Homo sapiens
agatcaacacatttctttttgacaggaatcctttgtgtttgaacccaactgcctcttcaaagtggatgagtttggcttctttctgacatggagaagtgaaggcaaggtatggcccaagaagagcaagttgttctttctgctttgtggtttaagccattttgtttctcaacaagtagactgagtgctgttgatgaaccctacccttattcattcattcaagatttttaaaaatgtgcctacatgtgccaggcattgaagtatacagtgatgattaaggacattatcctcatagattccagtctaggagcaatgtcaggcattaaaaaataagttacaagtcattgaatgttgtgaaagagaacactggattgtcaaagagcttaatttaatcttgggagttagaaagaaatctgccagaagaagagatgctcaagctgaaatctaaaaggtacattaaaagtgtgttcatctcattataccctgggacttaattcgatgtatggtacagtgtccacatttaatgaacaattgagctgaatttaagaaaagaattaaagttatataaaaattagcatttttctcacatttcatgtacacacatgtatttaatgattattaacaatgttttatatataaaagtaacagattttagaaacatttttatattcagcattgcacatatatatgtctatatgtatgtatatatatatatgtgaaatggaatacttggggtcttgattatttctgattatttacaataattattgttacatggttttaattccctcttcaagctgactgtaatcagcactgccttcatcatcagaaatttttgccaagcagtttgcctgtatcataggtatggcataatttaagctcattgctgtgttgtattctctctcttcaggaaggacaggtgctagaatgctccctcatcaacagtattcggtcgggagccataccaaaggtacctgtgattggtatttgcttttctaaacacggatttacttatattggaaatggccatggcttctagagataaaaaactcactctttgtatccaggctac

SEQ ID NO: 27166 - DNA, 1124 bp, Homo sapiens
gtcaaacatagagaacattctgcctgttccttgcactccctcttttgagtcctaccctggcccctcttatctctccaaaatcaaaaacaccccttgggcagaacaacttcaatactcataacaaaaggagacagacagagctcactcaagaaagaatgggcattggaatgtaagggtcaattactccaagagtttaaacctaaacattttcaaaatgccttagccacatagtctcaacaagccagtattcaacactgcattggaagcccctgtgaaggttccttgtgaaggttcaatggcttcaaatttataaagcttgcactttagaaactctgttaactgaagtgtaaatgcactgatgcaagaaagagcaagtactaccccacatatcagacagatgcctctacttttaaataatcctttgagtatgatacgatgtttattttacttgaaaatatttcaagtttttccactccactggttcatataatgagacaaaaaaataaacaagtcccatgaacactggaaaggacaaggtcctagtctcatttgcagatgttgattgtctactctgatataaacaattccacggaaaaactgtttgaagtaattagagagttcagcaaggtaaccagagaaacaatgagcaaagcaaaaacctggagacacacatacactgccattaaccaggtagaatagatagtaggaaaacataaatcccatttatattagcaaaagacatgctggttcctaccaccttccagctggttaatcctttcactctttctatgaaagtttttattcatatactaatgtgtatcttcagggggctgcaaggagaggagagactatatatatagtccatttactgctttggtcaccctgtagggtgacctcctccctatccatgcaatcaacactgactagattttcagtagtagctttagacctgactcctcattggcttctcagtatttccttgttcgttgctccccaaagtgtgatccatggaccagcagcatcggcaccccttgggagcttattagaaatgctcagtcttgggtcccacccagacctgctgagtcagagtctgaatttaacaagatctccaggtgatttatctg

SEQ ID NO: 27167 - DNA, 1046 bp, Homo sapiens
ttaatttgtatgaacactatttcattgtaaagtttcaatattgtaacttcactatatccctagatgtgttgaacttgactgctgggatggaaaaggtgaagaccaagaaccaataataactcatggaaaagcaatgtgtacagatatcctttttaaggtaactttaaaaataattacacagacttttccaaactctgtgaaaatgcaggaaatagggagatggagaagagaaaacaaatgattcattttctcaagcattatgccttcatattcccttcttccagtcttgaggaaaaagtcaagacaaagatcttttccactgaacgtccccttcatgatactgttcttgctttcaaatggtgactgtgttacataacaaggtttctctggcagagtttacctagttttacttaccttagaaacagtgtctccttttgttatctacttatttgcttatttactttacattattcctaaaggacttcaaggtggcataaaaagataaatagaatacaggaataaaatagattgtaaatagggcctacaagaataagaaaggccgggcgtggtggctcacgcctgtaatcccagcactttgggaagccgaggcagggagatcacctgagatcaggagttggagaccagcctgaccaacatggggaaaccctgtctctaccaaaaatgcaaaattagctgggcatggtggcacatgcctgtaatctcagctactcaggaggctgaggcaggagaatggcttgaacccgagaggtggaggttgcagtgagccgagattacactgttgcattctagcctggacaacaagagtgaaactccatctcaataaataaataagtaaataataagataatgaggttagacaaatcaaaagaatgaaattctgtggtttgcaaatgtcagctgcagctgtctgtcggtttggtataactcaggatagatattacaacaccaggagcagcggttctcaactccacctacatgtgaaacatcaccatgggtattttcaaaaacataggtgctgctgggcg

SEQ ID NO: 27168 - DNA, 1050 bp, Homo sapiens
tgtctctctctggtattggtatcaggatgatactggcttcagaattatttgagaaatttttcttatgcttctgtttttttaaagagtttatgagggattggtttaaattattctgtacacatttgatagaatgtagcagggaagccatctgagcctgtgcttttctctcttttttttttttctttctgtagagatgaggtcttgctgtgttgcctagtttggtctcgaactcctgagctcaagtgagtctcccactttggcctcccaaagtgctgggattataggtgtgagccaccatgcctggccagggcctgtccttttatttgcaagcagtgcttaaattactaatttaatatagtattttggttaagggcaattataagtgaacattcatctcataaatacctattgatattttactattcagcccatctttttcctgtataatatccaaataaaaagaaattttaatatacctaattgtaacttttttttttcttaaaggtctgtagttactgtggaatcaataagccatggcatctaagaaatttgctgttaaagtaagtaatgtttaatagctttttaaaaagaggctaatcactttctaatataactgagctctgtgttaattgaaaatcgaggttcctaactttctgctttttacacttgggactctgcaaaatttttttttttccttcaacttttaagttctggggcatgtgtgcaggatgcgcaggtttgttacataggtaaacatgtgccacagtggtttgttgcacagatcatcccatgacttaggtattaagcccagtgtccattagctattcttcctgatgttctccctcccccttcccccacaacaggtcccagtgtgtgctgtttccccccatgtgtctatgtgttctcattcagctcccacttataagttagactatgcagtatttggttttctgttcttgcattagtttgttgaggataatgccttccagctccatccacgtccctgcaaaggacatgattttgttcctttttatggctgcttagtattcc

SEQ ID NO: 27169 - DNA, 1012 bp, Homo sapiens
gcctcagccttccaagtagctgggattacaggtgcgtgccaccatgcccagctaatttttgtatttttagtagagatggggtttcgccgtgttggccaggctgatctcgaactcctgagctcaggtgatccacctcctcggcctcccaaagtactgggattacaggcatgagctactgcgcccggcccaagaacatgtagttttgtctagggtaagagtcaaggtatgaacttaagaggtttcatccttagtctcatgaattcccaaaccaggagagaataatggaactacctgtgttgcatgcacattcatgctccatcctcaccccttcacccaggtgttcactactcacatatgcctgaattttattaactaaaaacaagttctttccttcactagagatgaatgtgtttaaaaagcaaatattgagtaaatttgcatagcagatcaaatgctttcaaaggggtaaggattttggagaatgctttgttttgagaaagcctgaagaccctgagctagagacacactgtttagaaagatgagcctggaaacactagtgagggagaaaagcagaaatgagcgccggagactccaccaagggagtccgaaaagtcagggcactgtgggtgaacttgaacctgaatgtagaatggctcttacggtatctataatttgcaaacttcttatatactatttacataatagttctccacttagagatctttaacacaccttcttgttttttggaatgtgacaagttttatagctagtatggacaggagagaggataactttaaaatgtggtgaatagggctgggcgctgatggcctatgcctgtaatggcagcattttgggaggctgaggcaggaggatcgcttgagcccaggaatttgaggacagcctgaacaacacagcaagaccttgtctctttaaaaaaaaaaaaaaggattaaataaatatggtgagttggttgcagtgagcagtgcttctgtatcatcaattagaaatattg

SEQ ID NO: 27170 - DNA, 1059 bp, Homo sapiens
tcagaagccagcagttctgcaggcagtttcctaaggtctggctcccttggcaaacgttaccttggctgcaggtaactttattctttgtgaataatgccagcctggccaccgttgccctcttctggtaaggggctaatgctacaaacgtactgagttttacaaggaaggaaaactcaagctcgattttcactttggtcaactgtgctatgccagctggcataaatccctacaatgaaatgaatgtttggtttaaaatgttgtaatgtatactcagaccatggaaccatgtgagggtctaatcttatttacagttttggctttgaggactaccttgggtatccatatcatttcccacagttgggccactttctgtttggcaaaaaagatttctttcagccttttctctgcctgtgaaaccctgtctggctgcttcattagctaacacatgtgtgaatttgcatcattgataatggcagcaaatgcaaggaatatggttttaatcaaattttagtatctaatatctctgaagcttagggcatagaacattagaggcctgggataaacaattcatattcaatagcagcattttagcatttcttggtgacatatttacacaatttataatttagagatgagtttatgttacatggtaaaacttgagaatatgctgaaataacgcactgtgttgggagggggcaatgaaaatatggggctactatggcagtttatgcaggaactactttaagggcagtccttgttgccctacccagtgcttaattttttgtgaccaatctttggttggcacctctctttccctccccaactgggaagaaggtaaatactccagtcaactaagtgggctttgtgtttaatggaacccgtaatgaatacttacaaaggaaacactgtttcgtgaggcatgtacttccttactataactctttttaaaatttagattcttaagtaatccattaggttgcagtttggcccgaagagtatcacagataaaagctagctaccatactcgtttggattattaggatctaaagacatgatgtt

SEQ ID NO: 27171 - DNA, 1028 bp, Homo sapiens
cagatctagattttttttttttttttttttttaatttgagactgagtttcactcttgtcgcccaggctggagtgcaatggcacgatctcagctcactgcaacctctgcctcccaggttcaagcgattctcctgcctcagcctcccaagtagctgggattacaggtgcgtgccaccacacccagctaatttttatatttttagtagagatggggtttcaccatgttggccaggctggtgatccacccccttcggcctcccaaagtgccgggattacaggcatgagccactgtgcccgacccagatctagattttttttttcctgttatacagtgtattggtttgctagggctgccataacataccacaggccgagtggcttaactaacagaaatttatttgttctcaaagtctaaagactagaagtgtaagatcaaggttagtttcttctgaggcctctctcctttgcttgttgatggctgtctcctccctcgtcttcacatgagttttcctctgtaaatgcctgtgtctcctcttatctagaagtctgagattaaagtattggcaagttagtctcttctgaggcctctctccttggcttgtcgatggccgtcctctccctttgtcttcacataattttccgctataaatgtctttgtctcttcttatgaggatgccagttacattggattaggccccatcctgatgacctcattttaatttaattacctccttaaagacctaatctccaaatatagtcacatcctgaggtactgggagttaggacttcaacatatgaatttgcagggagaggtgcacagctcaccccataacatacagtttaagtagagtctaagtatgttctccgtcttatttggaggtatggacataatcaattaactggtaagccagagacagctctggggtgcaccactctgaaagggttctgaccaaggtcaccactggatcatggccctccagtagaccaagtgacttgtccagccatgtgcttaaattgactacaaatttc

SEQ ID NO: 27172 - DNA, 1032 bp, Homo sapiens
tgttctattcagggtctgaacaaggttggtgtacacattcattgcactcggttgattatctttatcatagaagaacacctcctttaacctgtaggaaccctcatccccaattttttttctatctgtttatttaagaaagcgggtcaaatgtcctctggaatttcccacatttggatttggctggctgcatccggatggtggcattaacctgcctcttccagccccttgtattttctgtggattggtggtttgagccacaggcctgatgaggctggggtcccttgtgtgagaatactttgtggtatgtggggtgtgttttctgttgcatctcatctggcaacacatgatttctggttgtatcccttctaatttcacgctaacaatgtatatacaatgaaaatggagctttttatgattttaaaattaatcagtattttagatttgttcattaggtatttatattactagtaaatactgtttaagcaaaacaaaatttaaaagactcttttacgtaggcttctgaaactttgcttaattcaggcaattaagataaaaatatcaaggtaatgttttgcaataaaacctgggtgttagcatacatagttcctttttaaatctaagtctatgtaagatctaatttagcaccttaattaagatggtaagttattgcatacctatcatcataaggcttacatatcagcccaatatacatcttatgtgaactcttaaggacttgtataatagaagataaaaataaaaagcacatacatggtgggttttttttcccctataaaaacgcaaatcagcaggtagttaaaacaaaaagaaagaaagaaaagaaaacaaagaaggcatgagaccggttcatttaaattccctggaggagtgataataattgagctaatatgcattgccttctcataaattgcttcagtagtttaggccttgagtggcttagaaattagctgtctccccttgcctcttcactgttgctatagaatccagctaaaggcctgtttgtttgtgtttaaa

SEQ ID NO: 27173 - DNA, 1029 bp, Homo sapiens
atgtatgtttaagttttcccacagcaagatttctcagatttcactcagcatagcagacctcttaatgttagatcttgtattgtttgcccaaaataactatatttcattctggtcgcatacattgtaaaacaaaggatagcatttcattaaatagtaattaattgagaccttctggatatgtgtatagtgtttgtcaaaatgtgaaattgtaactggtcttttctatgtggttttgcaaaacaaaacaaaacaaaacaaaacaacaaaataaaaagctttttctggccttgcctttcccaacctgtcctgttcattttacagtgagcacaatttaaaatctaagataattgatataattcaggtgtttggtgttgatggcggggaggcagtaaattgaaggacaggagagcagtgtttatttctaagcactgagtgactaaaggtatagaacttagttgtggatgttggggaaatttggctgtgatacttggaacctcactaataatcaggactgatgtagaatatctggtgatttgggagttgtctggattctttcttcccgtcccatgtgttcttggaaaaggtgtttttcccaaatagaacaagatactctttggttaatatgtgagagaagcttttggactttgatgatctgatggaggagatgttcttggtgactatctttcgaatatcagaaaaaaaaacaaaaaaaactaatactagccaaagtaaaacatatctttggaaacactttcctttttctttgaccgaaacatattattttcttcttctgttatttaaagccaacaaatgacctggagaaagccacagcaatggttgggtgaggttgttccattccagcattcccagtaggattgattgaagtcctttgttggaacagccccattcaggcctttttgaaagggacctcctgagccttgattttacttttctttggatagactattttcaagtacctagtagaaagtcatatatatatattgggatcattgtattatgataatgttt

SEQ ID NO: 27174 - DNA, 1091 bp, Homo sapiens
ggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagat

SEQ ID NO: 27175 - DNA, 1064 bp, Homo sapiens
tgtggaggacatcctggggctgcttccagaagcatatcctgcaatgaggattggagtgaaggtggtttatttaaactatgtggtttatttaaactttcaaggttaacctcgaaaccagtgaggttacagaaatagcagctcaaggaagaagaaggaccaaggaaggatatgatttcaggcaaaatttcagccttggcttgatcccatgagaatctcaggagtgcaagtggcactgcagagctctctccttctgggttcaaggagctgggttttcatatatcgttatcagtcagtcactgggtttggctccccttaggagatggaaacttctgactccgtgccccaagtggctccagcaacccaagagaagacctctgaaggaagctgcaggtgcatgtgtgcaggtgcacagctatcttcttcatccttcatgtctgaagacctcttcaaagaggccttccatggcccacctatctagtgcaggtctgtctccacccaccactctctattctattgccctactttattttctgtagtgcacttagttgctctctgaatgtatttatttatacgtttaaaagctctgggtcaatgaggcctgagatttcatatttcaccagtttaccttcaatcctgaaagaatgcttggcacatagtagttgtttaatgtatatttgttgaatagcaatgagtggatggattaaaaaaaatcatgaaggctctgtagagaaatgtggaactattagaaagttctggcagcatggactatggcacaccaaatttgttattccctccttaacattatgcaagggaacatatgtgaagaattgtattaaagtttaatctgagaaaggtgtgtagtctttcacatcattgtagataatgttagtcttaatgggtgtattttacagtggtgtaatgcttccagaatattttttgaagaaaattatggcattgaagggaggcttttagttctttgatacattatatctctcaatagaatataatagcttctttttcccccagaagatgtgtgcatttcattatatgtcattatctgatat

SEQ ID NO: 27176 - DNA, 1053 bp, Homo sapiens
gacattgtgttcgtattcataattaaatgtattctttttgatgtgtgtgtgaatgtgtgtgttctttactacagagagaatgaaaatgaaaaaatgtgactgactgcagactaataacagaaaccaatcttaactttaaatatagcatcttaaatatgtgggtcatgctttaatttaagttccaaggcactcaatctaagacatcaactctataattgtgacttcaggtataggctaataatagctagctaatgtcatccccaggagggctgcagtcatctttagatgtctttctcctgtgctaggcatgagagaagcagctatggctggcctcttcactgctgtgtctccagtatgtggacagtgtcggcacaaataggcacctaacaaatagttgttgaaattggaaatagaaataggtgtgattaagatgggggtggggagatgtgggagaagaaagaagggaggagaggggaagaggggaggagaaggagaaaaagagaacttctgaaacaaatacgccagaagctcagtcccatgagggcagtcctacactcactgcattgtaaagaagtgcctaaaacaagtgaagcaacttgaagatgtcaaagtcctgagatgttaattaggaagaaagcaaatcgactgttaattatactgcaatcctccatgtcttatattatctcgattcttcattcctccctgtatccattcctttgccagacaactttgcagtgttctctagaccatgaagtgagtgacttgttccactccttgatatgggctcaaccatgtgctttcctttggccaataaagtgatagttcagagacacagggaatgtgtgtgtgactctggcaattcttctgtggggggcctctgtttatattgataattagatttttaaaaatgtgttataaaatttatgagcccatgtgagaatacagtgatatattgatgaagatttagaataatggatgaagaggtgcttatgtatttgcttcctatccaatcagtgcttgagaggggtccgcataatccaactaccgtctctt

SEQ ID NO: 27177 - DNA, 1083 bp, Homo sapiens
cattcttcctccctggaaatctataccctaataaaataaaataaggtaagccctcaatttcaccctcagctttgtaatgaacccagggaagaccaattaaacttgtgaaaatggtaaaacgagaacaggttttgacttatttgcatatttttgaatattagcaaatagttgaagagatctagtgaccagttcctgacacaggactctaaagtaatagaaggaaaactactctatggctccgaattttgtgttgtttgaatatccatgtccagtcacgtatctgttatatgccttcctagttccattcaacttccttttttatatcctggagcaatttcctccatcacttactctctatacagagcttgttttggtttggatccctcagaaacagatcctgagataaggatgtatgtgcaagtagtttattctggaagtgatccaaggagatgcttggattcagtgatccaagttagaggagtggggaggtgagggggagagaaaagcagggaataaaatatatgtcaatgtggaacccaatcctgctggggaaacttcaggagacaatgtagaacacaatttggaattatcccactagaagggcaagggagctggagtatttacacaccaactcctatcagttgtattggttgagggctgctcctcgggacagatgggattaattctctgtcacctccagcctgccctgtatgtaggcagagaggtttgggaagccagaaagagtcctagggcatctggaaatcaagccattgttctctatgacagtaaagctgataggatattggtgggatacaagaatgctatcaagtttacctcccttaagtcaagagagcaaagaggagctctatgtctagtggtctctgggagttccagctttcagtaatcatcagttctggcttcagaataaaaccacctaggaaacttttaaaaaatgctatcacccagacacctcaccagaaaactaatacaagtgaaaaataagcgtataaaagagtactcaacatcatatgctatcaaggaattgcaaattaaaacaatagactatcactacattcctattag

SEQ ID NO: 27178 - DNA, 1062 bp, Homo sapiens
ctacacccaagggtagctgaagctagcttaggccagcctgtgagagccaattgttagcatctcttcccaacctctgttctgtgacatcatattgatagcttgacatcagccctggtgggaatatttataccatggaagttggcaaatgctacaaagcagtccccaaccaagagccagcacaccactgcctataccctgaagtctaaatgttcttccaactccagggacctctgctattatctcgaagtctcttagttcaaattttcaagtgagagacagggatagataatcctgtccatctaattcttcacccctcacaggagtgtgctggagctggctcatgagagctattgagcactcttcccagctccatatttagcaacatcatgttggtagcatgaaatctttccaagtttcagacagggaagtgggtgtgggtaaagtaaaaaaggattggcttctctaatagagaagggcagccagagtagaagcttctgaagaagcttctagtaggctgttgacaatgctgtgcttcaaagaggtcaggtgaagcaggactgagagcagtgagcacagactgcagatagtgttagcagagcagtgaaagcaaagagatacccagaatggggagaaagaatctaggaagaagtagagttgtggattataaaccaaacaaccagaaggtacctagagggaggagattttttgtaattggaaagcttgtgcctgttgtaaggtggaggaaggagacacagaagacacagactaaagattgatagagatggagatggagagagcaggatcccggagaaaagagggctgagggggaaagaaagtgtttttctggtgcagaaatagcacagtctcctttccttttggaagggagagagggtaggcgaaacagggaaaatggaaccctaagcctctacctgtaagtctttctttactctgtaaactctttggatgaacaactaaaaggcgggaaactcatagcaggtcctttgtgacacaggagtggggaaatagctcttagcatgttatgccatggaaaagttaacacgg

SEQ ID NO: 27179 - DNA, 1859 bp, Homo sapiens
gggaggctgaggctggtggatcacaaggttaggagatcgagaccagcctggctaacacggtgaaagcccgtctctactaaaaatacaaaaaaaaaaaattagctgggcacggtggcaggcgcctgtaatcccagctactcgggaggctgaggcacaagaatcgcttgagttcaggaggcagaggctgcaacgagcagagatcacaccactgcattccagcctgggcaacacagcaagaatccgtcttaaaaaaaaaaaaaattattttaggctagtttccaataagaataaacccctacttttagtgcctaacacaataaagttttatcacatcacagctgcgtgctggtgggacagcccatctccatcttgtagctgtgccatctggccctgtgttctataatctggccctgtgttctataagatcaccacagcaaaagagatggcctggaaaaggctctagctcttaactgtcttgcccctcctttctttggccaaaagaaatatgtgtttgagattgggaagtgtcaaggagcacctggatatttggggagcatcagtggtctctgccactgtaccaacagttaagtcctgtatcaggcttcaaaaagaagaggaagtcattacccaattgttcatttgagaaacaaactccacatgtatcagcaatgtgctcatttcctaaacaagcctattggctgcattactagatatagaatgaaatattttgattctaggtgccccattttaagaaagattgatattgacactgtccagggacatgtagtcagaacatgtaaggatctccagatttttgtgtcctgaaggttttcaaagacttggaggagagggcaatggtttgtagggtacagaatactcttattctgtgtggttcccaaagagagaactagaaccaatgatggagttttaggatgatttctctcacaatgcaggatatttaatcagcaattagagactttcataaatcaaacataagccagatgacatctatgaagaatattgtaaatattttttgcttagcatgggagattggtctgggtagtctctgcggcctcttttttaaatctggaattttgtatcatgaatgtcaaatgaatatttctttttctttttaaataggacactgatgaaattcaagttaactatcctggaatgtttgaattgatggaagatttacaaggtaaggcactttaaagaatttttagactccattgggaaaggtaggccaaaaaaaaagaatttttagactccatttgagagaaacattttgagagccagctctttggcaggcactgggcaaagcactagggatccattgttgaggagaaagcagactgtcttcatggagcttctgatataaaatggaggaggcaggcaccaggcagctgtcacagagataagtgttaaattagaattatggtcagtgctatgaagtagaggcatatagtgctacggctgtttgtaaaaagatggcgggacttttttttgaagggtgcacttgaggatgatggaacacattggtgacttccttcagccacacttggcagctgagatacaggaatgaaggtagttgagttggtttagaagtagggttttgtcagggggaaatgtcccagtctgggagactcaaaaagaagtgttatctgaggaagtagcaattgagctgtgctctaaaaaaaaatggagatgaattaactgggtagacagagtaggcaagtgaatctgaggcaaggagaacagcatatgcaaaggccctcctgtgagaatgaacatagcaagaactgaaagaagggcattttggctggtgttcagggagtaagaaggagagagttaagtga

SEQ ID NO: 27180 - DNA, 1086 bp, Homo sapiens
gatcattatactacatagatatgtattgaaatatcaaattttaacccataatcatgtacaatcataatgtaccaattaaaaaataataatttttaaaaatgaggaacatatctatgaatttatttggagtaatttctagaatattctgttatgaaaaaatagcaaagtgcaaaagaatgtctccagggcacttctttcatatgagaaagaaggagatattagaaagtacttttgtgttctgctcatttgtgagaaaaacatatacaggagttaataggtaagactctgaagaaattagttatgtacatggattgagtagaaatgggttggaataaaggagaataacagcagagtagtatggatgaggaaggcataccttttttgtacggctttgactcttagaatcatagtaatattttacacagaaaacaaagtaaataattgaaatcagccaagtcagctttttttttttttttttttttttgaccgtagtgaggagtcatctagaggtttgacttggatgtagagaaagtttggtctctcttccttgtcatgtagtctcacggccttttcagtaacttccccctttatctctgcagcaagatatcctgtacttcttacacgatggttccaaactccaagagtataagagcaaaagctaccaagcattcctaatgtctaggctcagaaatcccagaacatcatttcctccatattctattgtcaaagcagtcataggctagcaaaaaaccaaaggtgtggaggatgacttttacctctgggtgagagaatggtttgtgcatacaggagggaaggaattgatagtgactatctttggagtttagagatcattgactgatatcagactatgtctcatgatgtagcctgactgtagaagagggaagagccaaatgactcacaaaggagcatagtctcttgtgggatgtcatatttacttttttgaaaataactgagcagtcattagattatcaactgaaatctttctgattgtaagaagatatgttactatttctgagattttctttgtaactgaaagtagatagctagtattgcaactacatagtg

SEQ ID NO: 27181 - DNA, 1050 bp, Homo sapiens
tctctgaaacaatgccatcatgtggactccaggaagctccttatactagtctcagggcccatgagggccaataagggtctgcaatgggaatgtggactgcttgggaatctctcacataccctttcctcatagtggaaagctccttctggctctgaactgatcccggccaggccagctgtttcacatccctttcctaccatgtctcagaggtttcttgtcacttctgtgctgaattccagtgttctgtcttagaagctttattcaaaatggggttatctactcactgttttggtccttctttgtgtaggaggcaagtgcctggaacttctagtcagcctcttgaacccttacctcaattattattatcattttttaaagaactgtagagtctcataaggcgtagaagtgacacaggacctagtactctacataactatggattagagagaggaatttcttcaagaagtagaaatgatagagaaggctgtagagagaggaaatgctgtaactagctacatatatattctggacttaaaaaactgtttcagatttcaaaaatctcagggaaaagatagatttgatcaaatatctggaacaggaaccctgattggaacaggaatctgtattgtggcattatttatttctctggtgcccatagaagacattatttaagtgacctcaataatctctcatttttcctgaaaacatctctggaatccttcttaagataatactctaggtagttactactgatgcaggatgttttgctcctcagctcagctaggtttggtttcttgtctcatgaccaggaagaaataggcaagtggacattgaagaatgagtggagtagaatgtattaagcacaaaggaaacccctcagccgaaagaggagttctgaaagcaggttgccggttgccccccttcacagttgagtaccaatactttgttataaaagctgatggggctgggttccctatttgtataaggtgcaaattcctggtggctccaccccacccttccggtgcgcatgcgggcccttagtctgaccca

SEQ ID NO: 27182 - DNA, 1025 bp, Homo sapiens
gcagtggttatctgaatggtgcttacaatcccactgtccttacaatcaaacagttctgcattgagatccttaatagccatcccacgaaccttttctggggcttggcacatgagcccacgcacgttgaccttcacaggtagtgattgtaaccagtcacgtacccatttcatcttgcacccgcaataccagggattgttgcgaagaatcagttgtgttatattgtccaaatcatcaaagataccctgaggtaaattacttaggttattattggacatatccagtcgatagagctgccttagataagaaaaagcatttgggggcacccgattgatgtggttatcttgaagataaagcttcctcaggtttgtgcctggaaggtttactggtgcagcagtcagggaattccgcaccagggacagctctgtcaaattaactaggttgaagaaaactttgtcacctaaaccatgattgttcaacaggtttccatctagaaccaggcgttttagactagtgagaccttgaagagatggtgatgaaatagtggatatgcgattatcatccaagcgtagttcttctatagtcctgggcaaaccccagggaattgtgctaaggtgattacgggacaggaaaagcagtcggagatagttgctgtctcggaatgctccctcttctatgctaactgcagagacagagttgtcatctaaatgtaattcttccagatagggaatttttgaaagtgaatcataagtgatagtccttatgttattttcttgcaaatgtaactcttttacatactttgggaggttggtaggaaattcatctaaactgttgtggtataggtatattctttctactttcagcaagtttttcaaatctgaaggaatcccagcattatttatttggttgttctgaaggtagagagttgtagcatcctctggtattcctgttggaatggatgtcagaaagcgatcattacagtaaatgaaacccgcatcgcagcgacacacagatggacaggatttagc

SEQ ID NO: 27183 - DNA, 1045 bp, Homo sapiens
ttgaagggtgaggagggcagaatttattgagtgaaaggaaagctctcagcaaagagaggggttctgtaaagcaggtctgcccctcacaatgaagtaccagcacatgaaccgaagaggccaggctcctcccttgcatgaggcacaaattcctggtggctgcaccctatcctgaggtactgtttgcacatgcaggcccttagtctgagccacattgatttatttcccttactgcgcatgtgttaagggatggactttttcaccgtgggcatgtttagtcaaaccctctgtgcacaatgacccggtgggtcggaacctctggggactcttccctatctgcctaggtatttggccgtctccttgcctctatcagtagccactgctatgtcctcagtaactggcagaatacatgacatttagaaagtcagtcatgaaagttaggtgaattaaattgattctgtttggaacactgacattttattgccagccataggctaattcgtgtttgtaaatgtgctctgtaactaagatttcacctaaaactttatgtatctgaagtgaaaagttgtcatctatcctgcaatattatctcctctttataagttttctatactgttcagcattcttccctaccagcccaattatttcttaaaaattgaaaagttaaataaattagtttgtcaagacatcttccccttcttgctgaattaatttaattaacaaagggcctgtcaaaatagccaaggcctttgatgtctgcatgtatggattccagtattataaatgattctgtgtccctctgacctaatgggaatacagtgtaagggtaagaaatgagccttaattcctcagtaccaaagagagaccagcattacccaattacatctaggagacaacaaatatcaccactaggatttaagtatctagctttatggatggagcagaacacataataaattattaggaaattggttgctgattagtttgcaccatatagttggtttttttaagagactgtaaagtgttactttgtttttcatttattttt

SEQ ID NO: 27184 - DNA, 1032 bp, Homo sapiens
tttcaatatgccatcagtaatttactagacatgcaaagaaataagaaaatgtattccagagtcaaatgaaaaatgagtcaatacagacagacccatagctgacctagataatggaattggcacatagggacattaaaataactatgtcacatctgttaaggaatttacatgactagataaaatagaatggatgaggagatgggaaatttcaggagtcataggaaaacagtaagaagaagaaccaaatggaaatttcaagaatgaaaaaaatgaaatatttgaaactttaaaaagtgaaatggaattaataacagatttatcacaactcagtaataaaaagacaacaaaaattagcaaaagacatgagcagatacttccaaaaataagatatatgaatggccagtatacatttggcaagacatctagcattattaattatcagggaaatgtgcattgaatactcctttatagtcattagaattaccaacattaaaaaggctgacgacaacaagggactgccaaaatttgaactctcttacattgctggggttatgtgtaacatggtaatcactggggaaaactgttatgttagttctttataaaataaatatgtacttacctagtaatttcactcaatgatatttgtccaatggaaatgaaaacgtatagctacaagatggtttatacaagtatgcagattgattcataatagctaaaaactagaaacagtctaatgtctattcacagatgaatggataaagaaattacagcatattcaacaatggagtattacaaataaaaaggaagaagtctaaatatatacaacacaggtgaatctcagaaatatttaatatgtggagtaaaagaaggcagtctctctatctttatataaagtttgaagttatatagcaggtaaaacagttctggtgatcaaagtcagaacaggaactccctctgggtgaggggaggggaaattgaatggaaagggcacaaggtagctttttgggttcagggaaaggttttgtatcttta

SEQ ID NO: 27185 - DNA, 1050 bp, Homo sapiens
agacagaagagttctaattaatggaatggaatgatgtgattttctttttagaaaagtttctctctgtgactttgtggaaaataggtaagaggtcagggatgcatgtgaagggaccgtgatctaggtgaaaagtgatggaaatctgtatcaaggaggtggcaatatgactgacagtaaaagaagaagttcttgagatacttagaagatggaattaatagggcttagtcactgatgggatttaagagagaaggaaaaggatttaaagatttagacttatctggccagagtgattcaaattcatagaaaaagtaacctgtgagaaggagcaggttaaaaggaagaggaagggaaccacttctgttttgagcagcctgaatctgcactgcctatcggatagctgagagacggtgtctagtggcagctgtacatctaaaacccggacttgggggaaagatcacaatataacttagagatatagatttgaaagtcattaatagatttagactgtcttaccctggaatccatgaatagtcctaaggggttcacaaacctcagatatatgtatatactttccccttgggctaaggatctgcactgagtatttccagttgccttatcccacatgcatatatgtgcatgagatcacttatatcccttctctgtcctatgtctatctatgtccccaagaggctgatgtgtttgctggcattacccgactcccttgccatttcttatggtgaggcattggcaggagatgagagggaaggagaaggaaaaggttgggatattcttttcccgccttccccacattgggtcccatttctggcagaggctgtattcctccaggactatggtcctgtccagagtcccctccttcatggagccagcactcccaagcctgcagtaacacaaggccttcagtcccagcgggtcccactttttgctcttgccgtcctcttggtgatttgacatgcttttccagttgcctgaaacctgcccatacatcatgaggagtcccttcattatggtctttgtaccatctgaggtgga

SEQ ID NO: 27186 - DNA, 1018 bp, Homo sapiens
aagacaagaaacctggtcctttgtgctctgccccattgcaagctttctcctagcaaacctgaccagtgacaacagtgtccaaagtcttttctagaaaggtctccatattggtacctttttcctgaagtaagggcttataacaagggcattaaaatatgctaatttctaatgctttctattaggcgtatccacatatcaaagcttttactggaacacctttgtcaaaaaaaaatataggtcatgcacatggccatgaaattccattctttatattttaagcagcatcaagattgttcttttccttcgctgtttggcagattagaattcctctttaaagtgggagaagttagttacttatcaaaccatttgattaattagctagacctgtcaggccaaacaggactagccaagtcttttaaatctcttaatatgagccaattttcacaataacttgttttattcatggccttcacattttaaattcttgctcattagtgacctggtatttgggcttgtctgaaaggagagcatccgttgtgttaaacagggctcattatggattataggttttcgaatggggatgcctatgcacaaaagatcgccctcccattttcctctgaatagttaattggaccttcaccttgtttttacaagcaaaggctaagcttcaataaggagataggcttttataatgccacagtttgggttgtactgaagagctggtgacctatcattatcaatacagatgtggaactaaagtacagcatgtgtttggttttgctagagacaataaaagtaatggctgtttttaaaaccagtaaaacactgaacttgatagaaggagaaattcattgaatatatcactctgcaatagttcaattccttgagtaataaaatacaaccaccaaacactcagaaataaacactagttaaaaaaaaaaaatgaaacacaagcctgaacccacaatacccatgcattgactcccaagaaaacagatttttacattccctaataaat

SEQ ID NO: 27187 - DNA, 1049 bp, Homo sapiens
ttccccccatacaacattctgctgcttatcttttgccttattttcaagttttgggtaattttttaacaacaacaacaacaacaaaatttaggagcaatagcatatgagacagaggaaaaacagtgggattccaggcttcctcactgggctttgttaagcagaaagttaaggagagaagacacctgagataggccttctacaaatgagaaaatttccaataggacaaaatgtggggggagctggcataggtagaaggaaggcaaaaacaggtaaatcccaagaaccatttgacaggcaatgttgtatttacttttgtaacagatatagcactgtgactgggggccagtttatgagagacattactttatactttgctgcatttgttgtggtgatggtttttttaagttagaaaatcagatcatctgcatactgaagagcagttatgagtcagttgtttttaaagccatacatttatatgttagagaatttaaactctttcagaggaaaatgcaaaagcaatgaatgtagaaggcagtgaagacagagatgattttaatgcacccaggtattaaaactgagcagagcctctaattattcaacattattctgaaattctctttcatcacaccataggcttttttttccctcttcttttctatttcacctccatttcttttctctctggccccagatatgaaatgaaatctgggagcaaccacaatttctgtctcactggctgagcaggatgcttctgaaagaagcagcatctatatatagtttttcttcttaggctgcaggtgtgggatggaatagaatgaaatggaacagaatggagcaaaaaggaatggaatgttatctctcctgaaattttttttatttaaattatggatgcataatagttgtacatatgtatgtggtacatgttatattttcatataggcatacaatgtataatgatcaaataaaggtaattgggatatccaattaccttcagcaatagtttttttgtgtgttaggaacattccaatggcactcttttagttatttta

SEQ ID NO: 27188 - DNA, 1031 bp, Homo sapiens
cttggatgaggtttctcttcccgaacttgagcaaggttttcccttagtacttgaccttgtatcatcctctcttggccttcagtccacccattccttagctgtcccttcaccttgctgacccaccatctcgctatggctcccttgcagctgattatgtcttgtccctaactgaaaaatagaaactaaatacattttgaaggaaaatggctaactactgataaatactgctttgccattaggggaattcttgagtaagatgatagtcagcagtgaatagtcagtgaaaagattatcatctcttctgcaaattgtccctggtggagatttgattatatgcttaggggccaccttcctgtcttttagaattttctggagcagctgtcattataattactgaggacctttatgtgaccttgtcatcttgggcaggtagctcctaaagggatttctgaagaagacaattcatattttctgtgcacctgccttctcaatattttttgttttcacttagtgtccctgaaactctttctctcttcacatttcactctctgcatcactaatgaggcttccatttacctctttaattaattaattaattcaatatttatttggcacctattaggccccctgtaggataataacaccttaagctctggtctcatttaggagaatttgcatttatgacaagactctagaagacttaaacttttaaggccccaagaggtaaatttctaatggttggccacccctgagttgggaggcactaatgtggactatgaactggatcatcagcatgtagaaccccagaggcagatttctcctgaagttaataaagctccagcctcggggtctcacactgacacagccttttttttttttttttttggctgtacacaagtgttttcggtcgctttatttataattgccccaagctagaaaaaacccaaatggcttccaacagagcaatagttaaacatccatatgatggaatactacacaacaataaaaaagccaacttttgatacatgcaa

SEQ ID NO: 27189 - DNA, 1041 bp, Homo sapiens
aaaattaagtgcttctggtgtgaactgagtcttcaggaaaggctattaattcttactgccaaattcagctagctttcatggaacctagaagcagctgccggggaagttgtgactttggcttctctttccctcattttccctagagcagtagttttcaatctcagcttccctttggaatcacctggagagcttaagaaataccaatgcctgggtcttacccctcaaaattctgaggtacagtggaatggttccttgtcgtgacctagacataggatttgtattgtctcccggcatattctaatgtacagccagggctgcgatcttctgagctggtgaacgtgaagtttggctgtcccttcatgggctttatagttttatctgcaggcctcactttttatgggcagttgacctcacctcacttcattttgtgtgatcttggccagacaggctagcacctgcaaagactgaggtatgaaaagggaatgctattcatttttctttcctttcttcttttttttttttttttttttaaaaaaaaagcatttgacttttgaatatcccttgagctggatgtatgaattaactaaaattattatggttgtcttctatttactgtatatattctgaaattctagtgctcaaattgtttcttctgttaacttttgacagtattagaagatttagaatttgataaggatttcctgccttgactattctgtatcttagatgtttctattttgaggagctaaaatggtataatgatagatctggaagttataaaaccttttgctgttcaaattgaccgtaccaaattgaccatcatctccttgttctttctgagagttagatgcataatcaggcataatctcataatgttaccaatttatttcatgtgattgggtccaagagttacagagtaactgaaatatcccaggtggaaatataaggcaactggatttgcctgcccagagaatgaggagcctcattcacttgttggaaatgcagttttatctgagctttactccagtaccgtccatgatg

SEQ ID NO: 27190 - DNA, 1029 bp, Homo sapiens
ataactcactggacgttcctcattggaatgccaccaaggccagaaagagaaactcagttcctttaaaagccagttatcttcaatatattgcttggtcatagtaaatgttccacacctggattaactgctttgcaaaagtgtagcatgttgcatgagtgaaagttgataactgagcaagcgtatcagtgcatatccatcatttccactagaatagtaatccaaggatatgccccactggaggaagttttcatgcatcatcttgggatgtgatggacatatgcataaagtcatatcatcgaggatgtagtgatgaagaataaacatgttggtcacaggtacatctcatcaacaaattctactcattgattctctctagctaaattattcagaaagttattttccatagaaattttctaatctagtgttttctacttaattcacttgcctaccctatctttgagtccattcttttgctttcatatccttttatttttctgctaatttcttgggtccattgtagaaaatatagataatttggattgagaaactcagttattgctattgcaactgtaaacatatcctgtactgattcccttttaaaaaagacccctagtttcaatattctaatttaagcaagtcaatttgaacatatcaggtttttctaaataaatgaattataattggtaggtcttagataaaagctaaataaattgattagcagtattttgatttattttttcctctgttaaaacaaacaacagactaggttaaggacttataaaagagtattgcttctaattgttttctcttcattgcagtattattttgatgttctgattggttaagctacttattcattaattcactcatttgataaatatttattgactccccctaagcaacagatacttttttatattccagggacagagcactgaaaaacaaaatccttgctttgtcatattggtagtctagaaaaaaaaattatgtttgcttaacataaattaagcaaataaaaaataaagaaat

SEQ ID NO: 27191 - DNA, 1116 bp, Homo sapiens
gcatatgttgaatgattttttcctcacactaatatgtcgtttcagacccttaccaggtctcttaaatcttttcactttcttcttttttcatctacctacaaggcaacttatgtgtagtccatgacttgatctcttttatttcctttgtatgaggagaaattgtgcctggatggaaaatcatgagtcttcctctctctgagcactcttgactctcctgtcttggggcatcattctttgtaatatagatttttttttcataatttcccacagttgccatagacagatgcaaaatgaaaagagggtattgattctctttcttttgtggggcatagactctttcagataacttcagttagaaaaaacaggatgtaagcgtgtgtgtgtgtgtgtgtgtgtgtgtgtgtgtgtgtatcagtgttggttctcaaccctgatttttcttttggagtaaatcagtgttggacccaaaaagcaaaaccaaatagaataaacaaaatgaataaactaacaattacctaatagctaagaacatgaactctgtaatcacatgaggtcacataacatgtataagtttgaaaatacctatttggaaaaatctggtgaaaacttggttctaatttagaagcagtagttctaatgagttttgtgtataagaaataggtgtgtcttagtccatattttatgacatagccattgttgtctagagcctcgtgaaactcactttccatcatgtccgctaaaaccattccctacttcttacaccatgtcagaccttccttgtgttgttcaagggatcttatatttctatttctaagttacaggtaaatcacgatgcttgctggtatctcttcacagatgttccactgccacatcaattcagcatataacacagtgaactgattacatactcccttaattttacttcctagatacttgtcaacctgtctctccccttctctacttttaatgcctttgtttggatttttataatgtctcatttgctctattgcaaatgcttctggcttagtttttctgtctctagtctcttaccctccaaatctattctccgcctgtgtgagccatctgaaaaaggcaaattcactatgatactttttc

SEQ ID NO: 27192 - DNA, 1022 bp, Homo sapiens
ccccaggtgctctgggatggagcttattaattacactcccttcagactaccctgacttgaacagagggaaggaaagagagaaagtcgatagggaaggtgagagaaggaagaacttgggaatcttattaatggtatctttgttttctgaaatgagaattggagaaaacaaggcatacggtgcattcattgttttagaactgagaaacaagctcctattcgtcttgccaaaaattgcaaatgtgtgtgattcctctccattagctcacagcaatattggaaatgtatttgactaaactggaacacaccatcagcccaagatgcccagaggcagctcaatacagccatccatatgcttctctgagttaatttggaatacagagaattcagtttccaaactgtccccatgaacatttgtaaaatcctgcccatgtgagtggaaggtgatctgtaccaccacatgcaagctctcaataatgccggaggactgtgtcatgatagaatgcaaaggaacgacgggaggtattgagacctgcaactcttaactgctactgttttcattggtttaaacatattgctttatagaatttctgatttctcaatgctttattaaaggatcagcaggggttaggcagttgtagtgtaaattatataattgcagccaccacaaatgtatataatggccctcggtcgcttaccagccctctcaggggatacagattgaccatagttactcaactcacaggcaggaagtcccagaacatgctattacttccttctatagcatcatagtctgtgcattcttctacagattatcccaggcaatgaattgcatttaatattgctgtgggtaatatttcttcttctgtctcccttttgctagcactcctggaaatagctgaagcacagtacaaatacttacattgcaaaattatgttaagaatttcacttaacgtaaactgctccctagctcatatatcaaacatgaagtgggtagattgaacttccgtttgctgggcaacctc

SEQ ID NO: 27193 - DNA, 1057 bp, Homo sapiens
aaaacaacaacaacacaatatcttgaacttcagatgttttaatagagacagtgtgatacatgtgtacatagggaagaaactagcccacggagttcactattacataaaacagcatggtttacctaccattgcttttattaaaagtttttgtttttccatgttcatgttgtttttggaaatatattgtaaagtaatattgtcaagtaaataattttctcaagggaaaaataacaattagaaaagaggtaagacccctttgctctgatacccttaaccaagttaattgaggagagaagtagaaataggaagagaagaagagaggaaggacagaaaaaaagaaaatatatgagggtaaaataacatcactgcaggagatgttgcccgtgccctgttcacattggaccttaacactttactatgctccacacaatttttagcttccagtatctgcaactctgttgcaggggttcttttccattatagtggaaaccttcctggtcagcagaagactactctgcacatggcaggctgccagtgacaagaaattaacatcccttaaaacctttccctcaatcagtgattctctagtgtatcaataccccagctcccctcctcttggctgccataattctaagctttctcttatacaccacatctcagagcttctctgtagcagtaagctccagtgacccattgtagtagctggcttaataattcacccattattgattgctttgcctctctgtgttacttcaccactctttccatgctccctgggatcacctcctaaataaaccatttgaacttatatcctagtcttaacactatgcccctggtggaacacaaataagataactactatttctgttcataacagtttgtccttggactccattcattagaattgtaatggcttctattattaagacctgtacaaactttttcatgatactgcacttacctgggttatgcattctccctgctttcttcaatatccatcacaggtgtttcataaatattttctgagtgtagactaattccaccagtgcaaagcttt

SEQ ID NO: 27194 - DNA, 1045 bp, Homo sapiens
agttaagaaataagtaaacaaataagataattgcagattttatacgtattatgatgaaaataagggaatgagagagtgactatctggagactgccaatatagatttttctcacacacttgagttaatctataaaggataaaactgtatttcccatttcccagtgtgacgtgagtgccaggataattcagttggggggagaatagtgttttcaacaaatggtgctggcacaattggatatccgcatgcaaaagaacgtatttggatccctgcttcatactgtatgttgtatttaacttaaaatggatcataaatctaaatgtgagcactaaagctatgaacttctagaacacataggtataaatctctgtgaacttgtgttaggcaatttttgttggtagttttcctggcctttctaggcaatgacaccaagagcacaagtgacaaaaatagataaattggacttcattgtattcaaaaatgttcatcaaagaacaccatcaaggaaatgaaaacacaacccacagaataggaaaagatgtttgcaaatcatatacctgacaaggagcttgtgtgtagaatatattaaaggacttacaactcaacaatcaaaaacccacttgtttgggcaaaggatttgaatagctgtttctctaaagatgtgcaaatgactaataagccaatggaaaaaaatgcagaacatcattagccattagggaaatgcagatcaaaaccgcaaatactgctttgtacctgctaagacagctataatgaaaagattattgtagcaaatgttggccaggctatgaagttggagcacccatacattgctggtgagaatgtaaaatggcgcagtaattttggaaaatagtttggcagtgcctgaaaaaattaaacttgggagctaccgtatgactcagcagtttactcctacctacatatccaagcaaaatgaaaatgtatgtccacacaaaaacttgtacacaaatgtgcatagcattattattcatagttgccaaaagtgataataacccagtgttcatcagt

SEQ ID NO: 27195 - DNA, 1091 bp, Homo sapiens
caggtgtgagccaccgtgcccagccaaaaaaataatttttatagttccagtcaacttatctaaaagttgctttcaaataagcaattatccagggaaaatgaagaagaaaaaaaaagccttcaaagtagcccatgccatgaccgacagtcacaggacagcctctcattcacctatgatcctggtgtacttggtaagtcagttaccaagcagtcatagcctggcgagccctggattaaaggaggagaggcctggaacaagaaggaaaatgccagctgtcagtgaggggaggacagaaaactcaaaacacaaatgtggtcgggtcagcagggcgatgtttcagagcaaagcaatctagggctgcatggcagggacaagctggcccgtgggcctcagcagctctccaagctgtgccagcaaaccacctgacaacaggcgatatctgtaacaatccttacaacacttttcttttttttttttttttcaagaaacagggtctcatatgctgcccaggctagactcgaactccagggctcaagtgatcctacagcctcagcctcccaagtagctgggattacaggttagtgacaggtgcctggctaatttttttttttttttttaatttttattttttttattgatcattcttgggtgtttctcgcagagggggatttggcagggtcataggacaatagtggagggaaggtcagcagataaacaagtgaacaaaggtctctggttttcctaggcagaggaccctgcggccttcagcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcgacaggatcccaaggcagaagaatttatcttagtacagaacaaaatgaaaagtctcccatgtctatttctttctacacagacacggcaaccatccgatttctcaatcttttccccacctttcccccctttctattccacaaagccg

SEQ ID NO: 27196 - DNA, 1049 bp, Homo sapiens
ttgatttgcctacccagacctttggactgtgctatgtgcttgatatacagagatgaagtggatgaggtctttgttcttggtgttcacagactgtggaaattagaagagaggaagcatgtgatggtacaagaattttgacgaggggttgagatgacttaacaatgaaagggcacaggagagatcagagatttgggattaaaatgtgctcctaaggggctggcttttggaatagaggcagaagacttccgcctcttacaaggaaaagtaaaagatgttgatcctgggaaaacttgagatggagtaaaatttagtatgacagatgatctgacgtcagtgaagtgatgtttgaagggtttgggtagggatggattagagcttggctttggaccctaactgaacatcaaatgttcccggaaagtttttacaatgtgactaaggcttggtccccaccccagaccatttaaaccagaatctcctggggatggggacctggttcaacaatgttttaaaagtaacccagagaattttaacacaggactaagcaccattgtgttacagagtggaaaagtggttatttggaagttagagctgaagaaccaaaataacgtgtgtgtgtgtgtgtgtgtgtgtgtgtgtgtgtgtgtgtgtttattttttttccttttatgtccggttcttcattaggggcttacattgtattaatagcagtgggaaagactaggacaaatgattagcacagtggatgtgtcggaaggttcaaggaagcaagaaattaaataatgaatattgattcctgaccgtctaccacataccaggcagtgtattaagcactttatgtatatcatctgtaatcctcacagtaacctagcaaaaattaagcagtgctacatgaggagccagagttctaggtgttagggttggaagaataaagaggtctttagtgattagtaaggaaagttgttagaaaggtagttcagtgagggtcacaggaaggatgtgtgaggcaatcagcatagaccttgaaacctagaggaagatagcaaatgatg

SEQ ID NO: 27197 - DNA, 1032 bp, Homo sapiens
gatgcccccacaagccttgtttcatggtaagagtttgtttgctttgctcttttattttgggtatgggccatggtataaatgtacaagttttcaccccgtgggctgtgtgctctgcatttcttccttcctatgtcttgatgacactgttttgtactctgcacagatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccaggtgaatgcaagcacttgctgtaaagcccttgggggcaggagtggaggtggggcaggcagcactaggcattggacatggttatgctgtgaccttttaaatcctgagtaatttgggaagagaaaagtaaagtgcaagggaaaaaaatacaaaaatcgctgggctttatttttcagaattgttcattgtaagtacacctgaatacatctgagtttttcttttcctttaggcattcaaacataacctataagttttcttcatctgtctctcttgtctctctctctctgaggatagatatgcatg

SEQ ID NO: 27198 - DNA, 1050 bp, Homo sapiens
agtccctgctgagtgtttgcgaggccactggaggagtggttcatctttgcaggtgggcaccttcccctccagccagaccatacccctgagggcccaaacataggtggcgcacagtcgctggcactcaatgatggccacggtgagatcacgtatatttgcaatctagcaaacaccaatatgaccccacaaaatttgctttaaaaactcacaaagtgctcttgtccctggcatactggtaagtgctctcttgtcctaaaaatgcctatggatacacatggaagttaagcagagaaagcaggtagctatcagatgactgtcaacagaggagttcttagaggcctgagagaaccatgggttataaatctcaaggactctatcaacttcagtatttcagtgccttctttattaaaaagtaagttcttaaatgatatgacttttgggacaccttactctgtgtagctgattaaagaatctaaggacttgccttgtgttgatagaatgattgttactcttttcccctaagattaggtcaaagctgaatgtagaaatctcagttctaagaagctaattctgtcagttttagagagacagaaggtggactttgggattcagaaggtctatacaagggcctcaggttttataattacattcttaatatttcatgtttgtgcatgtaatttagcaggcctagtaaaggaatttttacaggttttggggaggtacaagataacatctagttttaaaaagcaaaacttattttgttttgtatttattcaaggttatcatagtgttaggtattgaaatgtttgacatatttaaaggtaattgagttgtaaataataaagctgacaataacaatatccccattgaccctttgcttcaaagaaaaataaaaaacacccagaatactatcagtttccttggtcttgtgaatgttttgatcagcagcaaaatgtcattctgtttccagctgttgctaggtgttgcaatgtctcagcctcagtctctgatttctccggtttccataactaactgcctacacttaaaagc

SEQ ID NO: 27199 - DNA, 1056 bp, Homo sapiens
gccacttaccttttgcatttcgaaccatgagtgggtttcttttgctcagctttgacgtctgtgttctacaatgtcccatccagggatcagggccccagctggttccttcaggaaactaggcttgttttaagagtgatcattttcacagggaatatttttcagagctgatgctctcattcattacacctatattcttcccctacattccttctttcagtatttgttcagactgctcattcccagggcttgtcaggtcctgtgaagttgttaacattctgttcttctgtcttccaatactctcacttactcttttccctgctagagttttggcagcaaatcccagttatatcatttcacctgggaacacttcaggaggcatctctaacacataaggacttctttttttaacataaccacaatttcattgttatacagttacattgttacaattatattttgttatacccaacaaaattaataacttattaatatcatttaatatctagcccatattgttttcccccattgttaaaaaaaaaatcttttttttccaccagtcagaacagccctggtcagaggcaggagagggaaaagtatctggaaacagcatcccagttttccctatctctgcctcatttctcctcctatttcttctgatcttgctgatctgtgttgacagccttataacttgatataagctggacctctgagttttccttgcatccttgtttccaaacttacttcccattagaagttgtgtcctcctggccgggcacagtggctcacacctgtaatcagcactttggggggccagagcgggcagatcacctgaggtcaggagttcgagaccagcctggccaacatggtgaaaccccatctctactaaaaatacaaaaattagccaggcgtggtggcacacaccaataatcccagctattcaggaggctgaggcaggagaatctgtcgcctgggcaacagagcaagactccacctcaaaacaaaacaaaagttgtatcctcctattccacctgtgcattcttctcgattccttttctt

SEQ ID NO: 27200 - DNA, 1025 bp, Homo sapiens
ttgtcttcatttatcatataatattgtctttttctttgatttctttcaaaagtttgttgaaatctttttgtttctttactttttttgtccatttctattcttagtttttgaatttttaatttatgatctcatatttggggtatatctcatatcccaaaatgtttgtttgaagatatttaatgtagcttaatgttacggttttttaaattttttttctgtctcaccattttttttttggtggaattttctttagttgaattgtttggattctcattttcattttttttaatagactacaactgtttgcgtgtctgcatttctgtaaacagaactgtcagattctagtgtttttgagatttccctagttcaggaaaatgcttctggcagtgtagcaaagtacagtttctttactggattgcaggggaaggagaggtggtgcatcctttggggtttctttgttgttgttttttgtttttctcttttgttttggaagaccctggattactctctcttgcttgtttttccttttcctttgctgtttccaagcagtatcttttccttgctttatactttccccattatgccactgcgcccccagttgtggggttaaagagcaggccctgcttcactcatggggagagcatttctacctgacaccctcccatttctgttttccttacccagatctaccttctgagatatcatccttcttcagggagataaggaaaaaaagccacagggtcccggagagccaggggaatggtgagtgtttcctgtctccattactggctgtaacaggatggacacattcccttctcttaccctgactgccttattggtgcctagtagagttcagctccaattcctcttacttgctcccctgcctcagcatcactttctgcaaaacccatgacacagttattcacctagtaaactgaacaacacacaattctacagtatgagatagagtctgcatttctttgttcagcttcaaaagttctgctgcctgagagtaacgtcacagt

SEQ ID NO: 27201 - DNA, 2551 bp, Homo sapiens
ttgatatatttgaagtgctaaaagaaaacgaacaaacaaaaaagcctgccaatcaaaaattctgtatctggcaaaactgcccttcattactgaggcagaaattaagacattctcgataagttggtggagattacaaccactagacctaccctacaagaaatattaacaagagtctttcaggttgaaataaaaggactttagacagttacatgaagccatataaaaaaattaagttctccattaaaggttaatacacaggtagtaatataagctagtattactgtaactgtgctttgtaacttcactttttgttctctatatgagacttaggagactactgcatttaaaaaaaaatagtctatgtttttgaccacacagtgcataaagatgtaattttgtgacatcagtaatgagttggagatggagctgtataggaacacagtttttatatgctattgaagttaagctgatgagttcaaattcagtttttaaagtttaggacattaagtgtaatccccttggttaccacaaagaaaatatctgtaggatgtagagaaaagcaagtgagatgggaatttaaaagttgcattgaaaaaatcaaccaaagacaaaaaaaggacagtaatacaggaaattaagaataaaaatctgcaagacatgtagaaaacaaaaagcaaaatagcagaaatcagtccctccttatcagtaattattttatatgtaaatgctttaaactctaaaacaatttggcatagtggatttaaaaaaacatgatctaactatatgctgtctacaagaaactcactttatatccaaaggcacaaatagtttcagaagaatggaaaaagacgtttcatgcaaatagaaaccaaagaaagtaggagtggctacattaataccagaaaaaatagactttaaattgaaaaaggttacaagagataaggaagacattaatacaaaaggtttactacagcaagaagatatagaaattatacacatatacctcataacagaccctttaaatatataaagaaaaatgggcagcattatagggagtagagttttataataataattggagatttcagtaccccactctaaataatggatagaacaataagaaagacaataagtaaaaaaatagaagacttgaacaaggtgtaaatccaatagatataatagacatattccgaacattgtacccaacaaaaatagaatacacgttcttctcaagtacacatgggacattttgcaggatagactaaatgttaggccacaaattaagactgatatcataagaagtatcttctaccacaacaagatgaagattgaaaccaataactgaaagaaaatttaaaaattcacaaatacgtgaaaattaaagaacatactcttaaaccagtaggtagaggaataaactacaagggaaattagaccatactttgagtcaagtgagaaagaaacacaacataggaaaacttatgagatgaagtaaagtgctaggcaggaaatttttagctgaaatacattagaaagcaaaatctccaaggaacaacctaattttacaacttagggaaccagaaaaagaagaacaaactaaacctaaagctagcagaaggaaggaaataataaacactggagcagagtcaaataaaatagagaatagaaggataatagcagaaagcaacaaaacttaaagttggttctttgaaaggattaaataaattgacaaacctttagctttattgactaagaaaataagaaaactcaaattactaaaatcagaaatgaaagtgaggacattactattgtttctacagaagtaaaaaggattgtacaagagaactataaattgtatgccaacaaatcggatgccctagatgaagtgggcaaattcttagaatgcaaaacctatcaagactgaatcataagaaatcaaaattttgaataagtgtataactagtgaggagattgaatcagtaatcaaaaccatcctgataaacaatcaggccctcctggacctgatgactttgctggtgaattctgccaaacatttagagaagaactaacactagttcttctcaaacttctccaaaagtattgaagaggagggaatactgcctgactcattctgtgaggccagcattactctgataccaaaaccagacaaagacactacaagaaaattacatcatttataacattgatgcaaaaaatttcaacaaaatactagcaaactgaattcaacaagcgtttgaaaagaattatacaccatgaccaagtggaatttattcctgaaatgcaggattgttcaacatacaaaaataaatgggtatatggccgggcacggtggctcatgcctgtaatcccagcactttggggggccgaggttggtggatcacctgaggtcaggagttcgagaccagcctggccagcatggtgaaaccacatccctactgaaaatacaaaaaaattagccaggcatggtggcacgtgcctgtaatcccagctactctggaggctgaggcaggagaattgcttggacccagga

SEQ ID NO: 27202 - DNA, 1023 bp, Homo sapiens
ataactagaaatagaaggaaaccactctataataaggccatatgcaaaaatctcacagctaacatactccatggtgaaagactgaaagctccaacatcagcaataaggcagcaatgcccacttttgccacttatagccaacagagtattggaagtgttagccagagaaaataagcaagaaaaagaaacaaatgccatctgaatgggaaaaagcgaagttatctgagtttgcaggtggcgtgatcttaaatgtggaagaccctaaagactaaacacacacaaacctattagaactagtatatgaagtcaacacacagaaatcagttgcatatctatacacttaacagtgaacaatcctaatagaaaatgaggaaaacaatttcatttaaaatagcatcaaaaagaaaaaaatgcttaggaattaaccaaggagatgaaagacatacactgaaaactacaaaatactgctgaaagaaagatgtaaataaatggaaagacatcacatgtttgtagactggaaaactatttttttttttttttgaaacagagttttgctcttttgcccaggctggagtgcagtggcatgatcttggctcactgcaacctccaccccccaggttcaagcaattctcctgcctcagccttccaagtagctgggattataggtgctgccaccacacctggctaatttttgtattttttaatagaaacggggtttcgccatgttggccaggctggtcttgaactcctgacctcaggtgatccacctgcctcggcctcccaaagtgctagggttacagatgtgagccaccgcacctggccagaaaacttaatgttaaaataataatactactcaaaccaatctacagagtcaatgtaatccctataaaaataacaatttttttaataaatagaaaaattcatattaaacttgatatggaatctcaagggacactgaatacctaaaacaatcatgaaagagaaccaagttggaggacttacagttccttatttcagaatttac

SEQ ID NO: 27203 - DNA, 1028 bp, Homo sapiens
tgattcctcttaaagtaatttcccagaagaattcgaaagcttagaccgtcttctcatgcttcccgggtacagtgatgctatatggcaaggagaagtagcaggcagaagaaattttaactgttaacaatttgttaagtgtaattttttttttttttgtgcctgagatagtgacctatttcttttaaatgtgggcattatttgaaatgatttttaaacaggtagagagtgtcataaaatttttatatgagggaacattttttacttcattctcattgcttttatttaatgtgcccatatgtgaatgcatagccactggttattaattttctaaatgtagaaaataagggaaaagtaactgaagcattatcttgaaccaatttgaggaagtgaaatgtgcttgcccaacttttcttaaaatgggctaagtcaggttaaaaatctagaagcattttcctgtgtgtgaaatatgcttttaatgttggaatttagtagtttcacatagccggacaataaagatgttagaaaaaaatcatgaagagtatgttaagataaaaggcaagagagaaataatgtataatttatataaatcatgacatttaaaaaattaggaaattggaaaagagaaaaagatttagtatttcttcactgtggctgtttgatggaaattgtggtgtacttagccagaattctaactgcggtgaacgttttgcatactcatacttatgcatacacatagaaacacttacttgtgtgatttactgaacttgaaatttacaaatgaacgctttctaccttaaaaataaaaattttattttaaaaataaaagtggtacctacttataatatttatctttctcacagtcaggttgattatcgagcaaaactttgggcctgtaatttctgttttcaaagaaatcaggtatgtgaattatttttaaaaaatgttatatgttttattttagttgtattatgaaaaaaattaagttaggttgaatttgtgtttacactggcagtgagcagtttctgctg

SEQ ID NO: 27204 - DNA, 1013 bp, Homo sapiens
agaaaaggtgacattgtttcttttttttaaacatttttgggctcttttttttttctttttctttttttttttttcttctgagatggagtcttgctctgttgcccaggctggagtgcagtggcacgatctcggctcactgcaagctctgcctctcgggttcacgccattctcctacctcagcctcccgagtagctgggattacaggcgcctgccaccacgcccggctaatttttttaatatttttagtagagacggggtttcaccatgttagccaggatggtctcgttctcctgaccttgtgatccacccacctcggcttccgaaagtgctgggattacaggcgtgagccaccgcacccggccacatttttaggctctttattgtcctttgagattccgtataatttgttggttactttttctatttctaaaaaaaaaaaattgttaattgaaaagggattgcattgaatctgtagttcactaggcagcatgaacatcttcacaatattaagtcttacaacccttgaacatgagcatgctcaaaagtgagtttaatttccatatatatgttgatatttttgctttcttctgttattgatttctagttttattccatttttatcggaaataattatctcatgtgtccgtgtgaagagaccaccaaacaggctttgtgtgagcaacaaggctcttgatttcacctgggtgcaggcaggctgagtccgaaaaaggagtcagcaaagggtggtggattatcattagttcttataggttttgggataggcagtggagttacgagcaatgttttgtgggcaggaggtggatctcacaaagtacgttctcaagggtggggagaattacaaagacccttcttaagggtgggggagattacaaagtacattgatcagttagggtggggcagaaacaaatcacaggtggaatgtcatcagttaaggctattttcacttcttttgtgaattttcagttgcttcaggccatctggatgtatacgtg

SEQ ID NO: 27205 - DNA, 1048 bp, Homo sapiens
atttttagcagagacaaggttttgccacaatggccaggctggtcttgaactgacctcaagtgatctgcctgcctcagctcccaaagtgttggaattacaggtgtgagctaccacgccccacctgggaatttcttttttttttttttttttgagacggggtctcgctctgtaccccaggctggagtgcagtggcatgatcttggctcactgcaagcttcgcctcctgggttcacgccattctcctgcctcagcctcccgagtagctgggactacaggcacccgccaccacgcccagctaattttttttttgtatttttagtagagacggggtttcaccctgttagccaggatggtctcgatctcctgacctcgtgatccgcacgtctctgccttccaaagtgctgggattacaggcgtgagccaccatgcctggccggaatttcttgaaataaggcaacaatgaaatttgctgcatcagtcgactcttccttccaggaaagatttctctgtagcatgcagtgttgtttgatagctttttacccacagtagaacttctttaaaaaatggaatcaattctcttaaactttgctgctgctttatcaactaagtttatgtaatattgtaaatcttgtcatttcaacagtgtcacagcatctgcatgaggagtagattccatctcaacaaatgactttctttgcttatgcataagaagcaactccatatccattaaagttttatcatgaaattgtagcaattcagtcccatcttcaggatccgcttcttcatctttttaattaaaaaaaataggccgggtgtgatggctcccgcctgtaatcccagcattttgggagattgaggcaggtggatcacgaggtcaggagttcgagaccagcctgaacaacatggtgaaaccccgtctctactaaaaatacaaaaaaaaaaaaaattagccacgcatcgtggtgcacacctataatcccagctactcaggaggctgaggcaggagaattgcttaaaccaagtgatggaggttgcagtgagccgagat

SEQ ID NO: 27206 - DNA, 1062 bp, Homo sapiens
ggggttataggcccatgccaccacgcccagctaatttttgtatttttagtagagatggggtttcactacgttggcgaggctggtctcaaacacctgacctcaggtggtccacctgcctcggcccccacaaagtgagattgggattacaggcgtgagccaccgcacccagcttttcttttcccttccttttcattccttccttcattattggggttggagagagtggatgtaattcttaccttagttaatttctaagactttaatgactgctttctaagttaataattcaggtgttctttttttttttttctcttaatggtgataaagtagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaactatctgcgttttcttttttttttttttttttgagacggagtcttgctgtgtcacccaggctggagtgcagtggctcgatctcggctcactgcaagctccgcctcccaggttcatgccattctcctgcctcagcctcccgagtagctgggactaaaggcgcctgccaccatgtctggctaattttttgtgttttcagtggagacagggtttcaccgtgttagccaggatggtctccatctcctgaccttgtgatccgcctgcctcagcctcccaaagtgctgggattacaggtgtgagccacggtccccggcctactatctgcattttcaagaggtgttcctctgtatttgcatgagtgaaagattgctgtgaaatttcacatagagcttccataagcttgatttcctga

SEQ ID NO: 27207 - DNA, 1050 bp, Homo sapiens
tctgtatctataaaaaaaaaaaatatacaaagtttccatacaacaggttattaagtactttgatctatgttcttaccaaaatgtatggctcatttaatttaatagatcaaattacagtcacatgccacataatgatgtttggttaacaatgggatccatatatctatgcagtggttcatctatatatccacatgatgctggtcccataagattataatattgtttcttttctatgtttagatacacaaatacttaccattgtgttacagttgcctacagtattcagtagagtaacatgctgtattagttagttctcatgccactacgaagaaatacccaagactggttaatttataaaggaaagagatttaattgactcacagttatgcatggctacggaggcctcatgaaacttataattgtagaaaaggcacctcttcacagggcagcaggagagagaatgagtgccagcgggggaactgctagacatttataaaaccatcagatatcatgagaactcactcactatcatgagaacagcgtgggggaaagtgcccccatgattcagttacctcccactgggtccctcccatgacatgtagggattctggagattacaattcaagatgagattcgggtggggacacaaagccaaaccatatcacctactgtacaggtttgtagcctaggagcaataggctacaccacatagcttaggtgtgtagtgggctttatcatctaggtttgtgtaagtcacttggtgatgttcacaagacgatgaaatcacctaaccatgcatttcttggaatgtgtcccacagttaagtgatggatgactgtatttattttttcaacaatccttcagaacagaattgtttctgtgaacagagttcatgttgtgtatgtccttttcactctttttttccaaaaatttttactgtgcattcttatttaagacctataagaaggaataatacaatgaatgcctggtgtattcacctctgagcatgagaaagtgttcttcccactcatagagtcttctaggatgttc

SEQ ID NO: 27208 - DNA, 1021 bp, Homo sapiens
tctggtgtttcacacttgtgcatgcgctggagtaattctcgttcgcccttgagtaattccatatcaagccccccaaaagggcaggaaagggaaggagaaaggaactcacatttaccagctcctagctcctacttgccgtgcgtttctcttgtttttattcttactgcctcccaccccctaaaaagaaaagaaacaggtatttcctatacattattcaggtgacaaagtaattaatcatttataaataacatacagctgaataccttctcttgtgaactttatgagcaagtaaatattttcttatttgacgcttttgtttcctctgcttgaatgcaagagctttacaacccttaacagcccaagtgcatttgaaatggtttgagttttcactgtgttgtttctacagaccgaaagaaaacatgcacaagtttttccattgagtagataacatgtcacttttttttttttaatggactggagctgtgactgttcaacttgttgctgaagaatccgtgttctcttgtgcagctctgagttatgtagggaacagttcgttgatgagatgctcctagtttatgttgctgaatttttttcttcctcccagagctgttttctcttatttaagaacacttgacacagagaactggggaggggtgatcaaaactggctaacatgcctctaatgcccatcctgtgctgagcagaacgctttgctctgatgttggacgtggtggaaatctgctcccagggaatgcttttcataagccatgggtgttcaacaaacactgattaatgcagatgtttactttccagagtgtctagaaccttccaccgatacagttttattaaattccccccacacctgaaaggagaactgtttcagtttactgatgcagaggacacaggacagagaggccgggtcagataagaactaggtcccgaattccctcttatttttctctctttacaaacttctatccaaatacaactgcaaagacaaagttcgggactatctacacaat

SEQ ID NO: 27209 - DNA, 1057 bp, Homo sapiens
cagcaattataaaatcaattatatgtttatattctaaaaaatgttttgagtaatgctgacatcattggaaaagtgcatcacttagaaaatgtatctgtgtgtcaattttgtttgttcaaaatcagtttcattaatttgtgggaagatacaccttgtacattttacctaattaaaaaaaatattgccagttgagtatacttgtgatatattcaaagataaataaactttttcaattttagatattcatatgtctttgggcctttgtttagttttgtcctaaaataggaatgcttttatatgggccagattcctgcagtgatgatatctgggaaggaagggagggcatgatctttgttctatgtgtttaaaagtctcaaatgagttactgggatgtaaaaaatatattcgcacatgagtttggtacagttcggtgatttttttttttttttttgaaagaaagaaaggtttccaaggcttgacactgtcctgtgggtgtggtcaattaattgcattattggtcccgactctttacacctaccctttgccatgtagcctggtagtggcctctcactatgacactaggatttcccatgtgatgttctttggccaataggtgcaagcaaaggtttgaagagcactggggagttgggattgtttgctcatatctctgctttcatgatgacagtgtgccttggttagcctggggagaatgagtgtcacatggtccaagcaccactattgccacagctgatgataagtcagataactgccagatttaagtgggcccagaggagaccagaagaatcacccagctgaacccagcctaaattgctgacacattaactcatgagctaaataaatgcttattgctttaagccactaagttccggggaggtttgttgtgtagcattattgtggcaattcataaccaagacatctttaaagcattagggacattttgggaagggctgtaagagttaaatatgttggctttataggcagttgtaccttacacagtttaactcagaagttactcagtaatcacccatttatgcat

SEQ ID NO: 27210 - DNA, 1058 bp, Homo sapiens
ttgcctccattgctgccacactacagtagctgtttggttttcttacctctaaaagtccaccaaagacttgtgccacctggataaagatatgattaattaaacaatgccatcccaggcctctttccacagcagcaaatgccacttgactataggaacccattaacgcagagcatctgagcagggtaggtcctgagtgaaataattagagtctgcataatggtgataacagtaccaataaccatttgttgatcacttgctctgtacaaagcattgtataagtatgtcctatgcaatatttgtaattaatatttaatcttcatgataactgtgaatgcagaactattttcatcattttaagctaaggaagctaagacttggcaagggcatgtaacttgtttataatctcacaactatttaataggaaatagatgagctaaaacatgaactcctatttgtccaaccccacagctggtgctctaaaccataatggctattgatttcttttgggaagaaagttctgtgagaaccagtgccagggtagaaaacctgaactgtaactgatgaactgatgggagctcagtgtggataagtctgagaactaaaaactccagggggatccagatatgagaggccttcatacttttgtaaattttacttcctggaactctactagattcttacagtgaagattagagaaaaaaaaatcttgagtttctggcatgggtagtcagaatgccagagcattcacttctcaacaaggcctgccctcaagaggaactgttttgccagagcctaacctattggtgtttcatgagagatgaattgacctaggggaagacaaatgccccaccccagctttctttagccatcctgtaccaccctgggggtgaaaaaaacctgagaagcacttgtaaagtgtacagtcaatgattatagtttatatataagtgaaataaatgagagcaatggtataaaggacaggagggagggattaagaatattttattattatgaagtactcacactacttgtgaagcagcatagagttatttgaaaac

SEQ ID NO: 27211 - DNA, 1081 bp, Homo sapiens
ttattaatggcattatgttgaaaaaaagtatttggcattattgtatagtgaacagggagttagaaagtgggttgttcaatgagaacacatggacacagggaggggaacatcacacaccagggcctgtcgggggtgggggtctaagggagggatagaattaggataaatacctaatgtagatgacgagttgatgggtgcagcaaaccaccatggcacgcgtatacctatgtaacaaacctgcacgttctgcacatgtatcccagaacttaaagtataataataataaaaaaaagcaggtcgtaactagctatgaccttgcacatataatttagggtatttgtatgatagattctccctctgagtagaagaccactaagctctcttcccttccagtttctaagccttcattattttagactagttgctaagatttaagtaatcttcatttgtaggcatatatatacatatacacatacatgatacatatacatatgcttatatacactatatacatgtatacatagtgcatacaatgtatacattaaaaatagaaaccaaacaagtagaggagaagaaaaattgaatgatagaagtcaactccaaagaagagaaaaaggaaattaaaccagcaaaacaaaatgcatgaaataaaatggtagcccagaatccaaatattgtcagtaattacaacagtaaacgttaatggacttaggactttatttatttattattagttttggagatggggtcttgctctgttgctcaggctggagtgcagtggcgtgatctcagctcactgcaacgtctgcctcccaggctcaaatgattttcctctctcaccctctgagtagctgggattacaggcgcccaccaccatgcacggccagctatgatgactctatttaaaagacaaaggctgtctgtattgtttacaggaaatatgtgtaaaatatattaaaatatttttaatacagaaagattgaaagtaaatttttaaattaccttgcaaattctaaccaaaagaaagttagaatacttattaataatagttatagttgaataattattaccagcataaaaa

SEQ ID NO: 27212 - DNA, 1738 bp, Homo sapiens
tattaaagtagccctgataagtggagcgataaactatcactggattagaggatacagtaaacaggtaatcgaccgcagttccaatgtaattgcagtcaaaatcccaagcattttttatagtacttgttaagctgactctgaaacatacagaggaacagaaagagcaaaaaagagacaagatattcttgaacaacaacaaaaatgggtgatgtgcccctccaggtatcagactgtaaagagtgagactatatcttagtgctgtagttatctagaccagtgttacagaatttgagaaacagacccaagaatatatggactttaacataccacagaagaggcattgcacatcaatagtatgaagatagacttttcagtaaaggtggttggacaattggatgtccctatgggaaaaaaaaatttcccagattaccattattccatacacaaatcaactccagatttattaaaaacctagatgtgaaaccaaaactaagaagtcttttgaatataatatggcagagtgtctctgtggcctcagtgtagaactttttaaaaaggccataaaaaggctaaggaaaggattcatatattcagcttcactgaagtgaagtaactttttatcaaaagataacataaggataatgacaagacaaaccacaaattggaaaaagatacttgcagacattacacagtattgaatattcacaatacatagagaactgtagcgggggaaaaattgtatgaaagatttaagtactatacagaaggagaaatctaaatggccaaccaacagaaatatattcagcattgttagtaattggaaatacaaattaaaatctgagatatagttacactgtaagattggcaaaaataaaaacatgtgatgcaccaagccttgttgctgtggaatggaggcttactcacttctgtgcaagagtaagttggtacaagccagttggaaaaacagtttggtattaactaatgaagatgtgccctgtgacacaacagtgagactcctagctatagaccttacgtgagacactcaacagaagtattcacaggagcatcgtttgtatagtaaaagccagaaacgtatcaacaggaccgtgaatgacttgtgcacaagcccagccactcttgaagctgactcttacaatgttagtcgactgagagaagcaaaagacaaaagaatatatgattccatgtatataaacttcataaacaggagaaactgtaataggtggtgaatttgtagaacaaatgccttgagtttatcttttaagaaaacgtgttgcttttgaaatactagcatgcaaacataaagtcatgttcttacactgcaaagtaattgtcataaatcctaagtaatacaaatttctattaccatgtaatcagctacaaggtcctattactaccattctgagtagtagtcaaagcaaggtaaaaacacgttttaaaaaaaatatgtatctattactttctagggtttctcacattctaacattttccttttttgtttttcttttaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatggtaagctcccttccatggcagtatccccaagaagtcgaaacagttacattctttctacagat

SEQ ID NO: 27213 - DNA, 1048 bp, Homo sapiens
tagttgatccaaagataaatgtagcgcttccagtgcctcttctcctgaatgggtgggacattggcaatggccctttcatagacttctctcacggcttcagcttctgcgtcactttctaccaagcgcaagtaatcaaaccatgcatcataattgtgtggattcgcctagaaagacaaccagtttaataaataaaaaacaaaaccaagagctgcacttgccaggttaagcaagctgaaaaaaggcatcaggctgactttctatattttagcaccttttcttctaaatgttacatgttctttcattttaaaaacaccatccctgagactgcataaatagaaaagaaacaggaatacagaggatagattactggccaggtgtcccacagcaaggactccttcatctatagccatcactctcacgacagtcaataattagatgcctattcttgccaatgcatttgcttaaatatgtgactatgtatcattatgtctgtaacaacagaatcgtatcatgctcacaattgttaaacttgcctttccaattaatagcaattcatctttaacatatcttgctaacctaccaccacatttaataacagacttagtcctttgcttggaggtatcttaattaacttgactaaggaagagtatttttaaatacacaacagaatactgaaggaaaatgacactctctttgaattgaaatcaaaatagtacattacagaaaaagagatgccgatggaaccctgtctagcatacatcttttgttcaggcagttaagctcaaaggtgatgtgcaaaacaggtttttggaccaatctctgactcttccaccttcttccaacaatgagctcgaatggattccacatttcttttgctccagttctacatacagtcaacaatcaacaaaacgacttacaacatgtaagtggcagagcaaatccaagtgttgtttgcttgccttttctatcagccttgtttattcctacttgtctgaaatagctgccaattggatcacgggcacatcatcacgagagtaatcactagtag

SEQ ID NO: 27214 - DNA, 1035 bp, Homo sapiens
tgttatgaagcttttcccctatgttttcttctaggagttttaaaacttcaggtcttatatttaaatccttaattcattttgagttgatttttctgtgtggtatgagagtccagtttcattcttttgcatatggatttccagtttctcccaataccgtatgttaaaagactgtcctttcctcatcatatattcttgatacccttgtcaaagatcagttgactgcatatgcatggattgatttatgggctctctattctgaatgttccattggtctatatgtctgtctttatgccaataccatactgttttgattatggtagctttgtaatatattttgaaatcaggacgtgtgatgcctccagctttttcttctttctcaagattgtcttggctgttcagggtcttttgtgattccacatgaattttagtcttgtttttttatttctgaaaaaaaatgccattgaaattttgatagcaatttcatagaatctggagattgctttggtagtatggacactttaacaatattaaatcttataatccatgaacatggaattctttccatttgcttgtatcttctttaatttctgtcatcaatgttttgtagtttttagcatggaagtcttgtacctccttaattaagtttatttctaagtattttattcttattggtgctattgtaaatggaaatatttttctaatttcatattcagacagtttgttgttagtgtatagaaacacaactgatttttgtatgttgattttgtatcctacaactttactgaattcatttattaattctaacagtatgcatctgtgtgtgtatgtgatctttagagttttctatatatcatgtcatctgcaacagggacaattttacttggatttgaatagcttttatttcttttccttgcctaattattctggctagggctttcagtactgtattaaacagaagtggcaagagtgggcatccttgtcttgttcgtgatctcaaaggaaaagctttcagctttcaccattgagtatgatatt

SEQ ID NO: 27215 - DNA, 1064 bp, Homo sapiens
ctgctataaacttctctcttatactggtcttgctgcatcttctaagtttcggtatgttgtatttttgttttcatttgtctcagatgttttctaatgtccctgttgatttattttgtgatccattagttgttagtgtgttgtttaatttccacatgtttgtgaattttacaattttgcttctgctattgatttctgatttcattccatttcatcagagaaaatacttggtatgattcagtctttttaaatttgtaagacttgttttgtaagctaacacgtgatctgttctagagaatgttttgccagcacttgagaagaatgctattgcgtttgggtggagtgttctgtatatgtttgttaggtccatttgaccagtactgttattcaagtttgttgtttctttgttgattttgtctggttgttctatttattattgaaaatggaatactgaagtctcccaccagtattatattgctatgtatttctcctcattttcaaactcaaaaatctgtgagtttttggtttgctctttgctcctttttttttttttttaataaggaaattcaggcagttttttaaaaagatgatgacgatgacaactcttttcctagaatttttttcaccattttatatttaagtaaattatgacattttggggcagtctcccaagtaagtgttaaggtgccctacccccactctcttggagccaaataagtggtagggggtggggcgagggacgggtgcaaggggaggaaaagtcaggaaggctactgagagcatagagccgacttcagcctctgttgggaagggaaccagcagtcaagccaaatcctactacgggtgtagcaaaactcaacttctttcaatacgaatttgagatctaagagtagtttattctggtggagcaggcttacccatggtttcagaagttagagaggagactctgagagtcaagccctggttgttcaagacccaaataaggcaggagaaagcaggacataggcaggtttccaagaaaatgagcccaatagcattcaagcctcagtgacaggccaggtataggt

SEQ ID NO: 27216 - DNA, 1033 bp, Homo sapiens
ctccccccacttcacccaccttctctctcttctgctctttctctcttttccctcttctcctcaaacttccttccctcccccctttcccttagagggaagaaataaattattacaaacatagatacagccccccgtatgcctttcacagatttcatgccccttttcaaagataacctagatctattccttctttgctgatgaatgtagatcttttttgtttgttttttcgagacggagtcttgttctgttgctcaggctggagtgcagtggtgcaatctcggctcgctgccaccagggctcactgcctcctgggttcaagcaattctcctgcctcagcctcccaagtagctgggactacaggcatgtgccaccatgcccggctgatttttttgtatttttagtagagacagggtttcaccgtgttggccaggctgatctcaaactcctgacctcgggtgatccgcgcccccatcagcctcccaaagttctgggattgcagatatgagccaccacgcccagccgatgaacgtagatcttaagaaagatactgtttgggttttattgtccctttgagttagcactgtcttgtaacaacattatttcccatgcttgttcactgcaagtacatcacattcaggcattttaagggtgaaataagtgttgatcgactgtcctttgctatctaatatttttttaaatgatattgtttatattagaaaacatggtccaagtcccaaacaaccaatctactcaatttttccaataatgggagggggtgctgtccagctaatatctaatgaatcaaattatattctgtttcccctaatagatctttgttcctttttaaatcattctgatctcattttagtgacaatcataaaaagtaccaatagattaatgacaaaatctatccttaaaaatggaaataggctggacgcggtggcttacgcctgtaatcccagcactttgggaggccgaggtgggcggatcacaaggtcaggagatcgagaccatcttggctaacacggtgaaa

SEQ ID NO: 27217 - DNA, 1044 bp, Homo sapiens
tgtaagtttctctcaccttggattaggcaacagtttcttagatatgaccgcaaagccttagatgtggttgcaaaagataccaccaggaaagttaaggccaggtgcagtggctcatgcctgtaatcccagcactttgggtggtcaaggtgggtggatcatttgagatcaggagttcgagaccagcttggccaacatggtgaaaccccatctgtactaaaaatatataaagccaggcgtggtggcacgcacctgtagtcccagcaactcaggagtctgaggcaggagaatcacttgaacccaggaggcggaggttgcagtgagccaagagagcaccactgcactccagcctgggtgacagagtgagactcccatttcaaaaaaaaaaaaaaagagtgaaaagacaatctatagaatgaggaaagtatttgcaaattatacatctaaaaatggacttgtatccagaaatacataaataactcttatgactcaataatttaaaaaaccccgattttgaaaatgggcaaaggatctgaatagatatttctccaaagaagatatacaaatggccaataagatgcatggcatcattggtcttcaaggaaatgcaaatcaaaaccacagtgaggtaccccttcatgccctctagcatgactggaatcaaaaagtcaggtaacagaagtagtgaggaggtggagaaatcgctggcagggatgtgaaatggtgcagcagctttgataaacactctagtagttcctgaaaaggttaaacatagagggattatgacctaatgattctactccaagagaaacaaaaacatatccacacaaaaacttgtacaggaatatttatagaagaattattcataagagccaaagagtagaaacaacccaaatgtccatcacttataaatggataaacagaatatccatacagtagaatatcattcctcaataaaaaggcatggagtactaatccatgctacaacatgggtgaaccttgaaaacattattctaagtgaaagaagtcactcacaaaagaccacat

SEQ ID NO: 27218 - DNA, 1016 bp, Homo sapiens
tgtacaatgttacatgaagagggtttattatttacaaatagacagtaaaggacaacagaagcctaggattcattctgaatgggtcccccatggctcaggaaacatgcccggggcagatagagtcttgactgcaggggccacacttacatggcgggagaggaaccctgaaaggcagcccactctgggttatacacctcagggtttatgtgacacactgagctaatgctttaaaaaatgtcctgcttccaggggtgaaaggaacaaagcccaccttgtcccgggcagttgcgccctcactcaagatgttaaattcctgggagggacaggagcaaggctggacattttcaggcagttcttccctatttcaggatattgcattaccatcacattctacagtcacttttgagaactatgagcaagaaaaggaactgagttagtccaaggccagccaaagaactatgccacacttgccaacacttgttatctgacttggctttagccattctagtgggtgtgtgacgtggtatctcctgtggttttgatttgcattttctgatgactagtcgtgttgagcatcttttcatgtgcttactggccatctgtgtatcttttggagaaatgtctatttaggttctttgtctcctcttcccccttttttttgagacagggtttcactcttgttacccgggctggagggcagtggcacaatctcagctcactgcaacctccatctcccagggtcacgttatcctcccacctcagcctcctgagtagctgggactacaggcaggcaccaccatgcctggctaactttttgtattttgggttgagacagggttttgccatattgcccaggctggtctcgaatcaactcctgagctcagatgatccacctccctcagcctcccaaagtgttgggattacaggcgtgagccatcatacccggcctctttgcccttttaaaattgggttgtcctattgaagtgtaagagttttaaagaatgtattctgaatat

SEQ ID NO: 27219 - DNA, 1026 bp, Homo sapiens
gaggatattttctaatatagcattcaaatttttttcttttcttattcagtggccagttactagaaggattctaaattcattagtaattttttccactatatattttttcaaagtcattgttctagagcttaccctatgtatcttgctagaatcaaattcagatttatacttgcttagtttcagtaatacatgctaaaatttattgaactttactgctatatagttcagttcccatcccccctttgtatattattgttatatatattacatatattgacataatccaacaatacatttttttaagagttactttaccgtctgtagccatttccttagcccactgcaactttgtttccatccacccctttttgctattagggcaaatatattacacatatattacattctgccttataagctcaacattatactatgtaatatttatacaattgctttttaattcaattaagagaagaaaggagggaaaatatacttgtgcttattgtttgcatggacttgaattaccatctagagtcacttgctttagtaactttagtaaactttttgtaactttatagcttgaagaacttcgtttagtagtttttgacagtgtggtctgttagcaataattctctcagctttttattgatctgagtctttatgtcaccccagttttgcactatagcttttctggactgagaattcttggttgacagggttcttttgttgttgtttgtttgtttccacttctttactgctttttatgttatcccactacctattggcatcatttatttatttatgtatttatttatttatgtatttatttatttatttattttgagacggagtcttgctgtgtcacccaggctggagtgcagtggcacgatctcggcttactgcaagctccacctcccgggttcacgccattctcctgcctcagcctcctgagtagctggcactacgggcgcctgccaccacatccggctaattttttgtatttttagtagagacagggtttcagcg

SEQ ID NO: 27220 - DNA, 1050 bp, Homo sapiens
ttcatttttgcagttccccaaagccttaaaattcctggtggctacatgggtaggaactgactaagcctcagagaaaaggaagatcagggagtgttgatgccagttgggactggttctctcctaccacacctgtgtgtgaggtagggtatggttgtagcaggtttgtttggtgttctgctacttaagggggtataatagaccagaaaagccacagtgtcttggctccggataattgcactctgcagttgaaaaaggatgccatagtatagccagctcaggcctgcaattacaataaattttatattacttgaattttgctggaagtgtacaagtatatagttcctttagctgcaacttgtaattaagactctaaaacctgtttgtatttataacaatgtttctgattttaagaatgtcttttttttgaagatgtgatgaaatatacttgtttcttgagaagcagctaatagtgatagagaggaaaaaataggatttttatattcctctacctgataattgtatttcttatcctgtaaagctgtgatgaactcggcattttaaatttcatttttcttaggcacctttattttaggaactgttatcaaaaaatatggcctctaactggtgtgtgtgtgtgtgtgtgtgtgtgtgtgtgtgtgtgtgtgtattctcttacagagtgaagaacttcataatttttatgtaacaatataatatcttttgtgtaccatatattgttttacagtcttattaaaacataatttaaaaggctgagcacgatggctcacccctgtaatcccagcattttgggaggccgaggacggcagatgactggaggtcaggagttcaagaccagcctggccaacacaatgaaactgcgtctctactaaaaatacaaaaattagccaggcgtggtggcaggcgcctgtaatcccagcttctcaggaggctgagacaggagaatcgcttgaaccccggaaggcggaggttgcagtgagccgagattgcaccactgcactccagcctgggtgacagaatgagactctgtct

SEQ ID NO: 27221 - DNA, 1030 bp, Homo sapiens
accatggctacaatttggaaatgagtagggggaaagaatcaacgtgggctggaccctctcctgtgaattaaattggcccagagtagtaagccgtgcatacacctcaatttccttcctttttttccatcggattgatatttttggaatctggccagggtgagggataatgtttgcgtagagtcccacttctctcttttctccattgtgccatgcatgctatagaataagagccctttttagataacagagtctaattaaattgtcttgctgatttttttaaaaatggataccttagttattaactaccttcaactaaaccttaagaattgttgagttgtttattttattttattttattttttaacttacttgtatcttctccatattgacagcctgtttgctccaggataaaaccaagggtctttgtaatggctttgcattttcctaaaatgattcaaaagctttctgaacagaattaccaagatcaattgaattgtatctaaattcagtcttccattgttaagttctgataagcagcattttgaacatatagtcttattgcctggtttaatcatgtacctagatttctggggtcgtcctttaaaacttaagttgtctcccaaatcattcctggtaatgcttaactctgacatttttgtgtaattatttgacagaatatgtggattttatacttttaggacagttttagaagacgacagaaagaaaaaagaaagagaatgaaggtgagttttaattaatttcatgagattggcaatagcgtaattttacaatttatgaggaagatgttcattacagtagctttattccttgtccagtaggacttagtcagggacgtaagtgtccacccagttacctttttacctgtagaaagaacactggtgtcgatttaaagaaggtcctctaggctctgatgtctgaagggatacacttgggaggtgagaggtgggtggcagttagctatttgaatggtttacagcaatcaagtattgttttttaagtaaaaatggtc

SEQ ID NO: 27222 - DNA, 1962 bp, Homo sapiens
tggttctgcacatttttctaacattctttgatttcagatccatgtctacttgtgattgaacatttactctgtatatctttagtttctatcctctactttctgtactttgggttttcctcttacagcatgtctttggttttgtttactatgtagccatcatgatcaatactagtttaataggtaacttgatttgtttagtattttattgtttaatcctagaggaaattgtttaatcctagaggaaatcattgtttaatcctagaggaaatgcctctaccaagaaatgcttggggcttttagcattttttcattaaccttttctgtaaaatagtgataatccaccttatgaatgggggatatttctaattgttattctgtgactcctttgtgttgtgggaggggcagattaaaattgatatggtatattctgaaacatgactgcaattaatatgtgaaatctggcacatggaaaagaggcctaaatggagaatcatcttgatgttcttgatctgttctgatgtttgtaaagtgttatttggcttctttatgttccttaaatgttaaatcttagagaataagaaatggattcttaaaaaaaataatacattggatgaaaatgtggttggtcacattgtattttcagtgatgaatgataatttagtggattcattgacctgcttctagattttaccataacatacatatgtttgtgtgtgtgtatgtatacatagatatatagagatatagaatgtgtatgtctctctatatatatctctatctcctttccttaagccatcaacaactcttagctgaaagagggataaggcccaagcaaggatagagagagtaggtatacacataatttctgcctaatgtctagattattcttttataaactatttttttacatttaaaaaagttacctgtgtgcgtcttaagtaatttagttgactttctttgtatggtttaaatatattttaacaaactaaggaacttgaactatttaaaatatcttcaatatttgaatcttaaaatgtagctttagaattgtacaaagaaacatataaagtagtattaaaatttgagcaaatgtgttctgtatctttttcaataacatttttgaaaatgtggttttataatggtcttaccagaatcagtgattggggtgtgtttaactgtctttaagttgataataaatcctatgaaattagactttttagaaatagttaaatgaatctgtgttagcatgactgtttaactctttcacatttcccctgggtattaaatataaattgatttggggtataaattagtagacagcctgttactgaaggtgtgttaattcagcataaatgagctgtgcctggttttaggttatgggaagctggctggaagcagcggtactacaagaacaaatttgatgtggatgcagctgatgagaaattccgtcggaaagttgtgcagtcgtacgttgaaggactttgctgggttcttagatattattaccaggtacaaaaagaatattttcctctgaatttgtagttaatcatttaagaaaaatagtaatttctttttttttgtttgttttttgtttttgagacggagtcttgccctgtcacctgggcgggagggcaatggcgtgatctcaactcactgcgacctctgcctcccaggttcaagcgattctcctgcctcagcctcctgagtagctaggattacagagcgcaccaccacacccggctaatttttgtatttttagtagagacggggtttcaccatgttggtcaggctggtctcaaactcctgacctcgtgatccgcctgcctcagcctcctaaagtagtgggattacaggcatgaaccactgcgtccagcccagtaatttctgtaataatagtattattgagctggatcttgaaaacaaacccaggctcattttttaaagctccctattcagaagtcc

SEQ ID NO: 27223 - DNA, 1005 bp, Homo sapiens
agccttaccatttcatttactttcccaacgttcccatccaagatgtgtgtcgaagactgttgcttaggctctgttggtgacctctttatgggtgtccctctgctctctcgcacactgctgctgggttgttctttctgaaattatctttgatcactttcacgtcctcattgactacttgcaaaggcatcacattatactcacacaaaccctccatgaccataacccacttctgttacctttcttcctgccccacttctgctcaaatgcgtttttactctaatttagcccttctcaactggagttccatgggagaattctgccttgagatcttaaagcatctgttgtatgtatcagattgtaggtagcagtttgtgtcctgtatctctagaatgatactagctatgttttttccttgggagaattgagaatgtactcactcatcattttttgtagggcttaattccctcccacatccccattgagaagggctgctccagtaaaactgtactgttccttggtcctgggaccctttccatatctttgttccatttgtttcctctgccaccctgtgaccaatcctgtctcatcttaaaccgcagcctcttggatgatgttttccttggtcctcaggtgaaataattccctccccgcagtacacacatagctttagcccacactgacaaagatgtttatatggaaggtgtatacacacacatgctttgactcagcatcttttctgtgcctgttgttgcattttccactttcttccttatttcccttattagaaggggaggcaggcttgatgcctggcggtgtgcataacctccctcccaccgtgaaccgtgcatgcgataggtattctaatagtttggcaaagtgctaaaaacgccctgctgaaacacagatacctgcttcaaaacactttatttgcaagtcttgctttgttacttgactttttatctgcaaagccctaatgagcacaaatacttaactaccattttctct

SEQ ID NO: 27224 - DNA, 1102 bp, Homo sapiens
tacactgattgattttgaaatattaaaccaacatggcatttctggagtaaacctaatttctggaatatatcatctttttatatgtcactacattctatgtgtcagtgtatggtgggatttttaaaatctatgtattatgagagagattagttttatttcccttttttggacgttctggggtagggtttttctggccttataaaacaaattagaaaatattttctacatttttgttctctgtatgggttatcgttagattgtcgtcatttcttaatttttagaagaattcagtggccaagccagttgggcttagagattcctttatgaaaaggttttcaattatagattcaaattttttagttctggcttttcagatttttcggtaattcttatgttggttttggtaagttctttttttttttttttttttttttttggtgggaatgtgcccattctaaaatttcaaatttattgccagaaatttttcataagatttttaatgactgtaagacttcaaaattaagtgctgatactggtaatatatagtcactcttcttttcttgattagtgttgctagaatctatttaattttttttttttgagaacctatttaattttattgtttttttttcctcccattgaactaacctttagctttgttgatatatagatatttgttcttttccctccatgtacatttgttttctattgatttctgcttttgtcttcattattctcttctacttttttgggggattaaattggcattctttttccaagtttttgagatggagacttaggtaatttatttttggtcttttccaatatatgcacttcagtgttacagatttctctctaatcactttagccttatcccacaaagtttggtctcacatatttattatcatttagttcatggtattttctgatttttattttttattatgtacccatggattatttagaagtatattgcttaattttttttttaatttatagggcttttccaataatcttttaaaaatatatttatttcttaactgcaggctaaatttctagaaatggtattgctggatcagaaggtatggtgaatttctagact

SEQ ID NO: 27225 - DNA, 1038 bp, Homo sapiens
aagtgatatattagaaatgtttgctgttttttaagacatttctagttgtataggttagacaactagttgtataggttagacaattatttcctcctccaaaaaaagcatttacacttagtaaactttacattccagttctacttagaaatactgctgtgcttaatctaagaatagcatgtttgagtctaatgaatatatattatgggtggtgatggcttcatctccattagcacagtttctaggacaaaatatacaagtttttttcccatctttatttttcttaaaacattagattgtttctgaaggtttctcttaatgtagctgtatctttgtattgtcttcattcgattttaaatttattagggagccactgtggaagctttcgtaagtaccatggagaatgtgtatcctgcgattataccatacataaaaagacaccaggcaagcacaatatggaattaagtcctaatggtaaaaaggggtatgtttccagggtaaccgcagtgattccaggggatgtgaagtagaggggtccggatgaatatttgctgtatttcttttgacttctgttacatttgcaaattttgtatatataagggcactaaaatgaaatacttctgggaacattttaactgattctcactaaactaattttgtacatgagctgaaaaagtggctcaaacattgattttactttcagtagattactttctcacaaatggtaactcattgaaattcatatatgtaaatgtatcttaagttttcccatagaaataaaccatacaaatgaaatgattgctattattgtaagaacttcttacttttatctcttcagaaaattgattttctgatagtgtatagtctgtagtaatgactcagaacttactctgggcgtagggtggggaactgtcttcctctgttttctgtggagtgtgtagtagtcagcatcctccacattgttactcggtttgactgctagtagtttggtttttaagaaataaaaaaggaacttaattccaattgactaaagataccacc

SEQ ID NO: 27226 - DNA, 1069 bp, Homo sapiens
ttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctttccctgtctgatgtgtttgaccaggttgtgagggaggaggagggctaaaggcagaaagcataataggaagcacccgcacaggggtgaggatcagggcttagtacctaccccaggcaccagtgtgcacatagttggcccacctggagctgtgattcacagccccatgcacactagaatcccttgggacactgaaaattacctatgccaaggccatactccagacccaaccatgcttgagtgtgtgtgtgtgtgtgtgtgtgtgtgtgtgtgtgtgtgtgtgtgtgtggtggtgggtaggggggttggttttgttccaggctggagtgcagtggcataatcttggctcactgcaacctccatctcccgggttctaacaattctcgtgcctaagcctcctgagtagctgggattgcaggcacatgccaccacacccggctaattgtttgcctgaatctttgaggatacggctgggcatgggcagtttctaaaagcac

SEQ ID NO: 27227 - DNA, 1074 bp, Homo sapiens
ttcattcagccgactgtgatataggaaaatggaaacatgacaaagcaattgtttgagacacagcagatgacaccagtgctgcacccgtattcccttggcactcatggctctaactgcaaatacctgccctgactctgttggaggctttctccactcacagcggggtgcccagccatgtgcaggggagggccagaaatgtggggaggtgaacacacgggagcagccctcaagcagtggtggaggagactggggctacataatccagactccttgctcctggaggggagcccctgggaatactcttccagatgtctgcagtggggctgacacagccaccccctgctcattaacccgccctgcaacagctcctctgcctccctatctcacctctctaccttcttaatggcacttctgggatcacctccaaggaagctgcttgtctccctacccttgtctcagagtcacctctggaccccgcctaagctggaaagacattaagtaaaaagggatcagtttctagtggcacttgaacatgtgtgttatgtcacctccttcataaaatctttatttaagttatggtaaaagaataagatgtgaaaccatgaaggaaaagagaatggacgtggagcaacaagaaacagagatgtcagcacgttttggaagatgaaagcgcacggaggagtggtgatcatgcagtgtggctgagtctgcaagcccccatgacaacagcagcaggaatcagccagtccactccaccaccaccgtgaggaggcagggctgggagctccaggtgtgaggcaagacatggcgaagacatccacctgaaagcagtgcatttctaagttgtaatcggtaaagcacccagtcctgtgtcccatcttcagggcttagtggcagacgtttcttaatcccagcaggagaccagtcagaatgcctccagccttggtgactcagggcacagtgaggagtgagagcagaccaaagtccacagcatggtgagcagcagggcccggcccctctaatgcccaggccccagtgctccttagcccccctggctcttaccccaaggcagga

SEQ ID NO: 27228 - DNA, 1051 bp, Homo sapiens
ctgtgaatctgatcatgtagaatatggttcttagactaacataggacatgataagatttgattatgggccaggtgcggtgtctcacacctgtaatttcagcactttgggaggccgaggtgggcagatcatttgaggtcaggagttcgagaccagcctggccaacatggtgaaataccgtctgtactaaaaatacaaaaattagctgggcgtggtggtgcatgcctgtaatctcaggtacttgggaggctgaggcaggagaattgcttaacctgggaggcagaggttgcagtaagctgagattgtgctacttcactccagcctaggtgataggtgagagagtgagactctgtctcaaaaaaaaaaaagtcttgattacataaagaggattttattaaacgtattcacagttgtagggtgttactattgctttttgtcctcattattcatccctggagtgtttcagaactttctctagaaatattgtaatttaattaaacatttgatgattacttagaaacctgaaactttgggttatagtctgctaaggaagggagggctgttgtggtatgggaggtgctactttggaacggacattcctagtgccacgtctcttctcccagtctcagctgacgttgccttaatgtgcatcattcccagccccaagcctgtcacctctcatagggtccgtcctatttctggaccagccccaaacctgtcacctctcatagggcctgtcctgtttcccactgatgtcccgctggcatatcaaactcagcatgtcaaaaacctgatcactgctgcctcctgccaaatggccccttcccagatgacctgtttcagttcatggccatcacccagtcctgtggcatctatgatgcctgcatcttcctcctactgcccgttttccccctcagtacactgctgagccatcagcagacccccttcaacaggtgctggctgagcagctgctgggatctggttttgtgttgggtgctggaggttctgggatgggggctggtccctactcctggagtaggcgtcatctaacca

SEQ ID NO: 27229 - DNA, 1059 bp, Homo sapiens
tgtccttggttccacagagatgtcacctcctgctgcccttctgtaaagcccgcatgtggcacgtgctttccctgcagcctgttctgagcacattgaatccccacagtcacgaggggctctccaatgagcagccccaccttgcagatgaaactggcccccttgaggggcatgttgcccactgtcacacgtagctgcgggcagagccggtgccacttccagcccggcatcctcctgatccctgctcccctaggagtggccactcaccaggaccgactgagagagtgagggagggacaggctgatggacgttccccaaggttgggggccctagagtcggcccacacttcttgtcctttgaagcctcaggttcccacatgctgcctcgcactggagcagccaatgaaacttgaacaaatgctttcattttgggtatatcgaaccaaaaacaatggcacccagtgaatttattttgctactctagtagaatttttgtaggctttggaagtacacagacattattttctccttggcaggaatgggctatgtgaatgaaaaaaggtatccgttatgaaacttccagaaaaacgagctacatttttcaggtttgtctggggctctcagtagttgcccaagggacggagtttaaacctttcgaaaagtaaattgcctgaatagaagtataactgaggattgaaagactgaatcagatacgcgcttctgttcccatgaacagtttgggaacaccatttacatgtggcttcttttacataaatcgccatgtgtcccaagctggtgggaccctcccttagaggagccagccactgtggtctgtgcaccaggtcagcagctgcaatgtgtgcgaccttgagcaggctgtcctgcctttataaacctcagttcctcttctgtaggatggggatcacaccttctggaataattatgaggctcaaatgaagcttctgattcctggggggaacacggagcagtttcaggttgaacattttgtccctgggcctggggacgtctgactctccttggatcctagcaccctaacgtgctt

SEQ ID NO: 27230 - DNA, 1030 bp, Homo sapiens
ggactggaaccaggcctgggcagccttgtgggttggaatggggtgagctcggtaatctgcagggaattgtgagacttttttttgtgtacgctgcttagaagaaaatcactgaagatgcctgcttcacgcagggaggggtacgaagctcagagatggagatggagccctcgaagaaggctctgtcttagaggttcccacacctcccttggagaaatttgcttgggttgaagttgacagagatcatcttactaattgttactttttatatcttgcaaaaatttgtttgagtagtgaaacaaagtcactgattgtccccgttactcttaaccatgtttactatgggcctgtgttcttgctgtgtttttggtattcctaaatatacatacacatttttaaaaagtataatgcacatacagttttttagattttctgtttcattcgtaaacatttgtaactttttcactgataaacagctttgcaggtcaatggataggatggtagttttcagtttgataggtacatggtagtcttgcacagccccctgttgccagttttttgttgttgtcgtttgcttttaaactcttgaccatggagaattgtctttctactacactaacgtagagggagaactggtgaggaaaagacacacttccagacctgaagccacttggcaaagattttacttgcagtgtacatctaggcagtgagcacttgctttatggatggtattttagaatatttttgtagggcattaagatatgtttaatacggtaattgctaagagattgactgcttttccaaacttattctgggacattcttttttctaaaatggagatggtaaaagggacagatttgttagaataccaactggggctcttcatatttggtatgcaaaacatagaagtggcaacgaatggccaaaacaggttataacaagggcttgggatgactttgccaggaaaagcagccaagaagcagtggctcccccagaattccctgctgttgggagagttctgatgcacagcacc

SEQ ID NO: 27231 - DNA, 1056 bp, Homo sapiens
atttcttcaaaaattctctctgcccctttgtctttctcttcttggtttgcttgatggtgcccttcaggtctctcaggctctgtccttttcttcggtctttttttatttttgttcttcagacttagtcatttctgttatcctgtctttaggtttgcttgttcttctgcctgctccaatctgtctttgaatccctcaagtgaatttttcatttcggtttttatagttctcagctccggaatatctttttggtctttttaggttttctatttctctactatttccattttgttcatacattgtttccataactttctccccatcttcctgtagttcttagagcatctttaaaactcttgttgtaaagtctttgtgtaatagatctaccatcaagtctttttcagggaccatttcttatttttctttttcctttgaatggaccatacttttatgtttctttgtatgtcttgtgatttgattgtttttgctgaaaaccagacatttcagtctaataatgttataactctataaatcagattctcccctttcccccagggtttgctggttttgttactgtttttgtttttttggttgttgtaagctgtcgctgtgcttagaatcaacctgaggtataaccttaaggttttctcaaatctttattgaacctgtgcctttccttggtcactttctaatttttcctgtatacacagttgcttttcactgccctagtctttaatgtctggctcctgaaagggggaaaaaagaaaaatgaatagaggtgggaaaacggtgctagccctttaaatcccctggaattcacttcagtggaatgcgggaggggcttgcagcctttgagaaggtgtgacaaaaatgtctgccagcctcatcatttgcacctctgtgatcagaaacagcaatcagcagtgaggagcagggtgctttttgcacactctgcaccagcaacctgtgtacaagctactccaagaacacatgcactgtggcctgccacaaagctaggaacaggggatggttagctgctgctatgctaagaggcaaaat

SEQ ID NO: 27232 - DNA, 1121 bp, Homo sapiens
ttttgcagtcttactcaagaaatctttgtccacaccaatgtcctggagtgtttccccaatgtttttttctagtagttttatagtttcaggtcttagatttacctttaatccattttgatttgatttttatatgtggtgaggggattgctttagatttcattcttctgcaaatggatatccagtttttgcagtgccatttattgaaatgactgtctttccccaatgtaagttctttgcacctttgtgggatataagttgaactataaatgtgtggatttatttctgggctctccactctgttccattggtctgtgtgcctgtttttatgccagcattttgctgtgtggattactatagtttgcataatttgaagtcaggtaatgtgattcctccagctttattacttttgttcaggatggctttggctattttggatctttcatggtcccatataaattttaggattaatttatctatttctgtgaagaatgtcattgatattttgattgggattgcattgaatctgtagacaaggtggaatggacattttaataagattaattcttctagtccaaaaacacggactatctttccattttttgtatccttttcaatttctctcatcaatgttttatagtttttgttgtagagatcgttcacatctttggttgattttattcctagctattttattttatttgtaacttttataaacaggttactttcttgatttctttttcagattgtttgttgttggcatatagaaatgccacccatttttgtatgttgattttgtatcctgaaactttactgaatttcttaatcaattctaatgttttttggctgaagtctttaggtttaactaaatataggatcatatcatctgcaaacaaggataacttcacttcttcctttctaatttgaataccttttatttctttgtcttcagtaattgctctagctaagatttcctagtactacgttgaataaaagtgtggaatgtgggaatctttgtcttcttccagatcttacaggaaaggctttcaatttttcagtatgatactagctgtgggtttgtcacatatggtttttataatattgaggtatattccttttacacc

SEQ ID NO: 27233 - DNA, 1040 bp, Homo sapiens
agatgtcttgtaactagcatgcttgcggcctgggtggccactctgtaggggatccctggatgattaaacagggagaaggaaatgtggaagagcgagttctgaggttccaacagctctcctggggctctatactgaagactcccttatcccttcagaacccctgtgcagcactttgagcacaaacataattgcctccctccagataatggagccactaaatgtaaacttacaaacccctttgcgaggtacagctgggggcttgaggtttctcacctttcccccacagctgcagaaactagaatgccactagtattgtctgagactcttcctgactgtcccccgactcaagaagggtgagaccaacctccagaagagacgcagggactctggtttcctcacagccactggcaaccctaacttcctgtttctctttgtatttctgcctcagatattctcccaggagtacatcaacctcctgctgtccatgtatttcttcgtgctgggaatcctggccctgtcccacaccatcaggtcagaaggcatctctctgcaacatttgaagcagctttctcgggaaccagtacagggtcttggatgagaacatgacttttggcatcattcagagccaggtttgaatcctggctataaaactcaagggactctttcccctgcacactgtagatgactaggacaagaacaatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctg

SEQ ID NO: 27234 - DNA, 1484 bp, Homo sapiens
gccgggccatgcccccacagcccgtttcagtcagtgcatctccctatctcttccccatgtacctcttcctcctgtggctccccagcctggtttccttatcctcaattgattcatctggctgtgttcatcctgcccaggtcccggcccctggccacttggtcgtggtgcagcatggcgtgaaatgagccaaaatgggagcgagcatggaggggaagtgtttaacccagcccggggggcacgcgcaggggctttccaggagagaaaacctctaagccgagacccctcactggggtccccttggcacctgagtgtcgggtgctgtctatcccgtgcctctcaaactgccttggttttgttcttcagtgtatccactgtttataagtaatagaaaatccacctacaggttgagcatctctaatccgaaaatctgaaatccagaatgttccaagacccaaaagtttttgagcactgacatgacaccacaagtggaaaattccacacataaggacttaacacatgtgaactgtgtttcatgcaggaaatagcattttaagattgtataaaactctttaggaggctgaggcgggaggatcacttgaggccagcagttcaagaccagcctgggtaacagcaagaccctatctctacaaaaaattaaaatattagctaggagtggtaacacacatctgtagtcctagctacttgggaggatctgaagcaggaggatcacttgagcctgggagttccaggctgaagtgagctatgatcatgtccctgcattccagcctggatgacagaatgaggccctgtctttaaaatttatatatgtataaatatatatgtgtgtgtacatatataaaactaccttcaagctattatgtataatgtgaatttcatatttaaacttaggttttatccccaaaacatttcattatgtatatgcaaatattccagaattcaaacaaagtttgaaacatttctggttgaaccatttcagatatgggatactcaacctgtataactgtctttaaacaagggggaaattttgtcatctcacactacagcaagcccaggggtagaaggctcagagtgagttaatgaccctctcttcaccaagagccaaggttacttcaggactcccaccccagcattctcagcatgtccacctgccccttaggtcatcccttcatggtcccaagatggctgccacagctcccagcactgactcctcacatagctgtgtccagaaaaagaaaggggaaattatgtctcagggagggatggtttttcccaagtctcctgtgcagtctccctcatactttattggccaaaactgtgtcacaggcccaagtctaaaccattcaccagtgagggggataggaaacatgattggcttagagtttaagctttagactagtggagaatcacctgctggtattacaaggctcagagaggggaacagaatccgtcaggcatgctagcaa

SEQ ID NO: 27235 - DNA, 1057 bp, Homo sapiens
gcacaagcttattcagaatccctgtgcacgcacctctgtgtacctgttgttggccagatgaaggttgcagtgagccaagatcacaccactgcactccagcctgggtgacagagtaagactccgtctcaaatatatatgtatatatgtataaagaaataaaaattaaatggccaggcgtggtggcttacgcctgtaatcccagcactttgggaagctgaggtgggcagatcacaaggtcaggaattcgagaccagcctgaccaacatggtgaaaccctgtctctactaaaaatacaaaaattagccaggcatggtggcgcatgcctgtaatttcagctactcagggggctgaggcaggagaatcacttgaacccgggaggcagaggttgcagtgagccgatattgcgccactggactccagcctgggcaacagagcgagactccatctcaaaaaaaaaaaaaaaaaaatgttggccagagctgaccccctacctgcaagtaaggaattcaaggaacaggattttcctgattggcttagtcttgcaccacacttatcacctgggaaggctgcctaacacaaaaccaggactggattagtaaagaaggcatgaggtagcagttaactgtgtacaaatcatctaatcttcactatcaccctgaggggtcagttctgttgtctacccgtttcacaggtgacaaaactaaggcaggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaatctgtatttatccagacaagctgtccagcaagatttctgagtgaggggctttaaggaagcaatctgcgggtgtgtagccttttctccctcagcaaatacagaaggagcttatagcccgggctcaccctgcttcagaacaagggccaacatctgtccatacccctgttatagtgagatgg

SEQ ID NO: 27236 - DNA, 1051 bp, Homo sapiens
tccttctctgcacttccagagcgctctctgttaatgccctcttgcagcaaggatagccctatattgtaattgtttgcattcccccattcaattgtgcgttcttggagggaagagatttttttttgttgttgttgtttgagaaggagtctcgctctgtcccaggctggagtgcagcggtgcaatctcggctcactgcagcctccacctcctgggttcaagctattttcctgcctcagcctcccgagtagctgggattaaaggcacgtacccaccacgcccgctaatttttgtatttttagtagagacgggtttcaccatgttggcctggctgatctcgaactcctgacttcgtgatccgcctgccttggcctcccaaagtactgggattacaggcataagtcactgtgcccggccgagattttatatctctatctctgtctgtctgtctgtctgtctgtctatctatctatctatctatcgttttagtcttcgctttttggaaacaaaaatgggctataagacacgatggatggcattgaataggcagtttttagaggaacctaattggttcatagcatacaggataggctttttccttgggtctttgtaggaatattggtcattaatagctatttttccatgcagaatatttctagttttgcaagaatctgaagctgtggtagattcagataattttgaaatgtgaagctgattctcttgcttggcaacttgatttgtttgggggaatgtggttgacgcatgtgccttttttttttttttttttttggtgagacctgttgacagaaattcaatcttgattaagggacgcaggaaggcatccagttcccaccatgcctggggctctctcatttaaacagctgcctttggctctggcctgttccatttcccactaggccctgtggactttaattttggaagatttcacatcctcatatttattatttctgggggaggtagtgtcgtgaaaccgaaattacccagtagttagcttttcgttttcttgatgtacttgtcctatcagccttaattg

SEQ ID NO: 27237 - DNA, 1030 bp, Homo sapiens
cgcggtggctcacacttgggaggccgaggtgggtggatcacttgaggtcaggagtttgagaccagcctggccaacatggtgaaatcccgtctctactgaaaacaaaaaattagcaaggtgtggctgtgggcgcctgtaattccagctactagagactgaggcaggagaattgcttgaacccggaaggcagaggttgtggtgagctgggatcatgccactgcactccagcctgggggacagagtgagactccgtctcaaaaaaaaaaaaaagacaaatggctcattgggtttcattggcaaattattggccactgagtgtggcctttaggctatttatcagattactttcagctattttattaactagattaggcttgagtaggagctgactttaaaccttcacaggtttccacaagatagagtgcaaaacttcgtacgcaggagtagggaggggcctatttaacttgttcccttatccttgcttctgttcctatgctgcatgttgtgactcttacgtgtatttcaaagttgtcgtctttatactcagaaatagtattttttgagaatatttctaagaaaagacaacttatatttgacaaaactgtgttgaactcttactatgtataatgcactgtgttaagcaccttgatggttggatggatggatggatggatgaggtatacacaagtgagtaaaatctatctttgtttttaggaacttcgagtctactgggagagacatttacatagttaatataaaattggatgataagtgttacagtggagatataaacaaagcacaattggctttggagaggcaacaattttgtatgataggtggaaattgggaaagagttcatagagatttgacctggactttgaatgatggataagattttggttggtaggcataaaaattagtggtgtattttagaaattgggttattcagggcagagagagaataaattgggctagaggaggctagaaatgagaaaatggtaaattgagggaaaataatgacatggtgaat

SEQ ID NO: 27238 - DNA, 1013 bp, Homo sapiens
gatggagtcttgctctgtcgccaggctgtagtgcagtggtgcggtctcagcttactgcaaattccaccttccaggttcaagcgattcccctgcctcagcttctcaagtagctgggattaaaggcatgtgccaccacgcctggctaattttttgtattttagtagagacggggtttcaccatgttggccaagacagtctcgatctcctgacctcatgacccacccgcctcggcctcccaaagtgctgggattacaggtgtgagccatcgctcccggctggttacagttttctttaagaggaacatgatatatttagggagtagataaagccagttcatatttgtatgaccctaaatgtgtaccaaacaaagataaggagttattcacaatgcagaatctgtacttttccttttttataatacattgttcaatgttgccagtttttagtgattgttcttatagtctatctcggatgtgtaatgtgtactttttcttttgattgctagaactttgcttgtacttgccacatgagttggaagtgtactggtagggagctttagtttgcattttaaatgcgtgatagtgatttgttttgcttccttgctgatcagacaatgatgatcttcccttttcacagaggagaaggccaatttggagaataagttactggggaagaatggaactggagggctttttcagggcaaaactcctttgagaaaggctaatcttcagcaagctattgtcacacctttgaaaccaggtaagaaaacatcttagaaaaaagctccttgatagaatggtgggacagtgttttagaagcctgaggttctgggaaaattacctaaatgctctatctctttgtttattattggtgaaatgggctaattcatttcatgataaatgtaaaactaatgatgtgctacacttaaaaaaaaatctcttggagcttaagctaacatagaatttttttttttttttctttaagatggggtctggttctgtcacccaggctgg

SEQ ID NO: 27239 - DNA, 1079 bp, Homo sapiens
cattttgcagttaggattaattgccagatttgtgatagaatataaactctgtgtgaatcaaaaaatgctgtggaacaactctctaaaatgtgttagttttaaattatgtgcacaatatgatacatgtcatttattccacaacgatttgaaatgttagcagtgttttaaaatcattaaggaaaaatcttcagggtagttgaatgtgttggaattatgagatataaggctgggtacagtggttcacgtccgtaatcctcacactttgggaggccaaggcaggagattgcttgaggccaggaatttgagacccatctctacaaaaaatgattagctgggcaaagtggtgcgcgcttgtagtcccagctactcaggaggctgaggtgggaggatcacttgagcccaggaggcagaggttacagtgagccgagattgccccattgcactccagcctgggcaacagggtgagactctgtctcaaaacaaacaaacaaataaaaggattatgagatgtagaaaattaaatttctctcttaattcaccctcaaagagatatgagagttgacaatttggtgttctttcccttttatgttcttttattttctgtgcttagattaattatattttaaaaactcaaaaatatcattctaggccatgtgcagtggctcacacctgtaatcccagcactttgcgaggccaaggcaggaagattgcctgagcccaggagtttgagaccagctgggcaacatagtgagaccctgtctctacccaaaggggaaaaaaggatttaatcttctcatacagcttagtggagatcattttgtgatatctaattgagttgcttactcctttcagggtgttcctgaaaagaaggtacttccaatcaccgtccccaagtcaccagcctttgcattgaagaacagaattcgaatgcccaccaaagaagatgaggtgattccctgggagtaggggggttctttttccttctatatagtcagtcaatctaagccttatcatttattaatcttaatggagttcaaaggcaaccactcttttttggacttgtctttaagaatgggtat

SEQ ID NO: 27240 - DNA, 1066 bp, Homo sapiens
tatcattcattgcgtgtgctaggagatacaaaagcatctggattctgcccaggctagtcctaggtaccatatatgacctgaaacttattttatattcatttttttattcagtgagcatatatgaatctcttatgtacaagtcattgtagtcccagcattaattgacaaagcaagatggtgtttctcacagtatgatttgcagatcctggtcctcctgaacccccataaactgatgcgtgaagagtggagaatgaaggggtgtcctggaaccaattctccacggatactgagggatgactgtgtataccttagcactgttctagtctctgggaatacgtcaatgaacaaaaaaaaagaccttgccttcatggagctaacattttagtaggagagagagacagtaagcaaataatttaagctcttgtgtaaggtgacagacgtgctgactgctatgtgaatagatgggttgggagtcgggggcatgtgaaattgtaattgggaaggcgaggaggttctcggctgttgtgcaggtgagagctgacagtgacttgggttagggtggtagcagtggcagagaggagaagtggttgggttctgaatgtgttttaaagttgtaactaacaagacttcctaacagattggatttggagagtgaaagaaaggtgggcacctttctttcttatagagggcacccaggtgtcagccccaaacagagacagggtccatcccttgtactgtgagaaatccagttctaccctagtccttttatttcttgtgggttcacagcagcattcattttttttctgatttcctcttgtttttttccacttctgcttatctcttgatctctgtgtctgttctttgtagattttctctctactggtatcagcatttctcctctatcactatcattcatgtatttccatctggaatcattttttcatataccttgtctggttttgttcgttgttgtttcaggcaggggaataaatccggccctcagattgagggttttgggagtgttactgagaattatggatgtgagggatccttctgccccatttgc

SEQ ID NO: 27241 - DNA, 1052 bp, Homo sapiens
agacctggacacgaataatcgtaacacaagatgggatgtgattcagtaatgtgagacagagtgctgtgggagtttagggattgtttttgaaagtgaggttgcagtttgtaaaggtttttttttttttttttaaagtaaaatttgcaaaagtagtactgccttttggaaacaagtaaaatgctactaactgtatgaaataaaacacgaaagtctccttccttcccctactcccacgtcccagtgtaacccatggttcgcaataggattcttccagaatgttttctctgagcacacacatagagcattttttttaaaagaaataagatagtagtagcattatgcatttttaaaaattttaatttgttctttaaaaggttatacattcacatagttctgaattgaaaagatacaaacgtagagtcttcctcctgccttttcttcccaactgctcagctcccctccccagagatagtgctgccagtttcttaagttcccttgcagagactgtttcttcctatacatactcctacctaccctccttctcttatttttttacacaaatagcatcatactttacactctgtaccttggttttttcatacatgttgtgcattttaaagatgtagttcaggtgccacctcaggcatgtcctggcttccttcctgacaagtatgaagcctcttatgacaatctagtgacatggaggcagacctgcatgatgtcctgggtttgtgacctgaggtcccaaggactagagggcaaggtagcagcacctggtcctcatctcctcctggcttaattgagctttgggggcttgcgtattgtcttgagtgtttggttgaacctgtatatcctgttggatcaatcttgatattgcttccttttcatttctctcgatgaaggccgtcttactgaatcttgtctgctggggaagttcctcattgctgagagcagcagttaaaaaagctgttagccacgtggctgggctcctatttctgcagaggcaggctgagttacagcttggtggtgtggatccaggtaggaattggtca

SEQ ID NO: 27242 - DNA, 1026 bp, Homo sapiens
attccaggtcacctgtatctttgccagtgatggcgtgttagattacagcacaaaaggcttctagattgccatcaccttgttccttgatatgctgcctttgaggtctcttttgctacttggaaaccaagtagcaaaagcaaaatgacgttgaatgggctggttcacatctcttaggactctttgcatggctctgaacatgcagaagatgattactaaatatttaattgacttttcagactgaacctctcatgggagttaatgaggcaatcaattaaaaattaaaagaaaatttaaaggaatttcctaagaagcaggtactttgctttttccttacagaaaagaactgcaggccaaacatcctctatcaggctatcaggaatatagaaggtgatgaagtcatagaatcataaaaagttggaacagtgtccaggggttttaccagaaacccatgaacttctagtccttgattctctgtgtattggaatattttttccgagatcagtatctgtagctttgataagtttctcagagggatttgtgacaccctccccaagattaaaaattgctgatctgtctgcttacccacatacctggtgccagaatccgctctgcataattcttaccttagcccactttctgcacatcttctgtggaactcatcccagtattttcagaggcaacccatttccttcacttcttaaaatataaatgaatatatgtctttaattttttaatttttttagagacagggtctcaccctgtcacccaggttggagtgcagtggtggaatcatagctcactctaactgcagccgtcggactcctgggctcaggtgatcctcccacgtaattataggtattagctactatgcccagcctaaatgtatttattttgttgtatttatttatttatttatttatttatttatttatttatttatttttattttgagacaaggtctcactctgttgcccaagctggagtgcagtggcgtgatttctgctcactgcaacctccacctcccag

SEQ ID NO: 27243 - DNA, 1114 bp, Homo sapiens
tctgtcatctgtgctagagtgcagtggcacaatcatagctcgctgcaacctcaaactcctgaactcaagtgatcctcctgcctcagcctcccaagtagctaggtctgcaagcccacttcaccatacccaactaatttttaaataattttgtagagacaaggtctcactattttgtccaggctgttctcaaactcccatctgtcctcaagtgattctcctgccgaagtgctgggattgcaggtgtgagcctccatgcctggcctgggtaggtctacattttaatgtttagtaaaactagcctgccttcattatttctcttttcaaaatcatcccgaagtaacggacaaataccaaattgactacaatggtttgttaaaagaaaggctttgaattgggggagagacaagtgagacaaacaatcagaggaaaataattggaaagggatggtcaaaggagaaaaataagcagttcatctgtggcagtacagttcttcttgaacacctctaatcgtgacctcaaactgtccctaagcatggttcccagcctggtgatagacctctgttcacttggctgtgccagtctgggtggaactggacttacttcactttgcagataacttgctgtgtgaccgtgggtctttcagtttccctctctgaccccctggattatatgacctctgaagttcttttaaaaactttttttttttttttagatgaagtctcattccatcacccaaactggagtgcaatggcacaatcttggctcactgcaacctctgcctcccaggttcaagcaattctcctgcctcagcctcccaagtagctgggattacaggcgtgtgccaccacgcctggctaatttttgtatttttagtagagacagggtttcaccatcttggtcaggctggtctcaaactcctgacctcaggtgatccaccctccttggcttctcaaagtgcttggattacgggtgtgagccaccgcacccagccctacaaattgtctttttaaccccatcaaacccaacttggaatggaactttgccttgttttgttttgttttacttttacgttactttggttgataaaatgtcaaatattctcaagggaattatg

SEQ ID NO: 27244 - DNA, 1042 bp, Homo sapiens
cttttcttttttaaaataaaatttaggaggtaccaagtgcagctttgttacatgggtagattgggtagtggggaagtctgggcttttaatgtaaccatcccccgaataatgtacattgtatgcagtaagtaatttctcatccgtcaccacccctacccttcagagcctccaatgttattattccacactgtgtgtccatgtgtacacattatttagctcccacttataagcaaggacatgcagtatttgacgttgtttctgagttgtttcacgtaagataatagtctccagtttcatccatgttgctgcaaaagacatgattttattcttttttatggctgaagagtattccattctgtgtgtgtgtgtgtgtgtgtgtgtgtgtgtgtgtgtatacatttatacagtgtcccaagtcctaggtctccctgaaggcttagaaagaaaaggtgggaggtgctgctggaaaggcactggggccggtgggtggaagttcctccataccaagctaggattactctaacctcagtgttcagaacagtgatgttttcttttgcctcatttattatttaagtggcatacatactatataatcatctaagaaaattagaaaatatagatacacaaaaaaggaaaaaagctcatcactaagacattttgcctcctaaatatttttccaaagataaaaaaaaaaaggaatcctgccacacagtgttctagctcctgcttttactatgtaaatctaaagcttgaacattcctactcaagaaatgtatcggccaggtgcagtgactcacacttatatctcagcactttgggaggctgaggcgggaggattgcttgagcccagaagtttgggaccagcctgggtaatatagggagacactatatttacaaaaaatcaaaaaaattgcggtgcatggtggcgtgtgcctgtggtcccagctacttggcaagttgaggtgggaggatctcttgagcccaagaggttgaggctgcaatgaactgtgattgcaccactgcactccaccctggacaacag

SEQ ID NO: 27245 - DNA, 1024 bp, Homo sapiens
tacttacatttggattaaaattttattttttgtaacatttcgatgggttctattttgtctgtggtttccagagctatattctgtgtgcttgtagcatttcctaaacattcttcttcattgtcttaaaccttatttttttatggctttaccatatttaattgaaagaatatatcatagtttattgataaatttcccattgcaggagctttgagttgaagttatttttcatttttcctctcttctctcattcagcaaacatttaatgagtacctactttgtgcctagctctaaagcactggagttacagaggtgaccaaggcacacgtggtccttgtccttatagagcttaaatcttagatgctaatgggagaaactgattttttaaaaaacagggaaactaattaacattttatcagatatgctatgaagtaaacagttgaagactgacagtccagtggataccggggagttcctttagataccctggtgaggtaaggacacaggcaaggggagagctgagacctgaatatgaggagaagccaggcgagcacacaatagggcagaaaggagcagtaggtcaaagcctgaggcaggagagagcttgactgactcgaggagctgaaggaagaagatcactatggttatgaataaggagtgaacttcgttgctcctaaaatgctttttttccttatttggagttatttccttaggaaagatgcccaaaagtgaaattgctgtgtcaagggatagtagcatgttcaagactctcacaatgtattgaatttggttgtgattctcaactatatctgtagtgtagtctaaaatgaatgaaatgtgaaataattcagaattgtgggcagtacattatatagtgtactgctgtcatttctgctaattcgtttgcctattagttaatattaccaagtgtactaaagatgtgtgggtaccagggaggattattggtcatcttggtttctgctggattcccatcaggctgtgaagctcaccagctctcgaacccagc

SEQ ID NO: 27246 - DNA, 1022 bp, Homo sapiens
cgcctcagatcttgatatctaagtgcccacttgatatatccaaactgaaaatgccttcgatgtaaatttgctgttcttcctattttcccacctagaacctggttgtagaaacctcagagtcttcctaatatgcaccatccctcactcatgccttgtttacagtcagcactgcttcccctggatttcacctccttggagctcctgaatctgtgtactcttctctaccctcaccagcacctgttccagtcaccggtgtcactcatgcatgactgactgccatcactgccccccaccaccaccactgctcaccgccagttccttgcatcctctgttttcttcacaaaacagccagaatgatctttctggaaccagactcagataacgtctttctctacccctgttagaaaccttcattggattttgttgctttctaggtcaaactggtcaagatcaaactgtgtgtcccacaggccccctgagtactggcccatctctgcagctcatctgagccttctgcactgtagccacacaggcctttcaggttcagtgcctcccccaccccaaaggggcctttgcacatgctgtcctgtctggaatattctcctatttctttgctcagttaacatctctcttcctttcaagtaccccttcctcagggaagctgtcctagacccactcccctgtgtctgcagcaagttatatattctcattttgctgattattcagcaaagtctatcttcctgctaggccatgcactctatgagtacatctattcaactttgcatctttagggcttggcatgtagccagtacccagtacatgttcacggatgaatgaatgaatgactagatgactagggagagtgccctgtcgagcagatccacactggaggaaaagtgcgagaccaagtgcatgtggaggtgttaattagtcttcatcttgtccatcaattgttgaacagctcagaatgaaagcaccatggggtttgcttgatagtccctaactgctcagtgcctgttagg

SEQ ID NO: 27247 - DNA, 1024 bp, Homo sapiens
agaaagggaaccaagctcctggcaccaagtgggcatgtcagtatctctgggccagacaggccgtctatctcagcaacagccccagccccagcccaggactggtgattcacctcacagccatttacagagcccaccatgtctcctccatcaatgaggcaacacatcattgctgtgagcttggcctccttttgtagtcagaggccaagtgacctgcccaaagtcagtaccaggattaggattgaaatcaaatatttttttctttaacaaaaaccccactaatatatagtaattttagacagctttggagtcagtctgcctagatttacatctcagcctcatgcctccaagctttgtgaccttggacaggccacttgacctctgtgagcctccgtttccttatctgaaaaatagggaaagtaatcaccctgcagagttggtaaggtggattcagagacctggcatttgtggtgccctcagcccagcacctgactcactgcaagtgctctgtggaccgaaagctgcggttgagatttggccagccaaggcccagcagctgctgcacccctccgaaccccaactaagacccagtcttcccctgtagagggtaggggactatgctgttgagaagacaagggagggggagcctcatctgcccagagtcctcctgtcagcctgtccaaggtgggcctggggctggggctggggctagaggcctggtgatcagccaccctgcctttctctgcccttcctccctccctccctccacagttgtagccatgcttgggatgctgtcgccctccagccggggagctctcatgaccacagcctgcttcctcttcatgttcatggggtaggtgtgtctgagtgggctcccgggggcggcacaggcctcctccacaccagctaatgggtccccttggtgtggatccctgccattttcccacagggtgtttggcggattttctgctggccgtctgtaccgcactttaaaaggccatcggtggaagaaaggagccttctgtgt

SEQ ID NO: 27248 - DNA, 1033 bp, Homo sapiens
cacaacccaggtagtctggcttcagtgctgcctctcaccccatcaaggggctcccttgtcatgcgatgctcaccggcccccagttccttgcttattctttgtgtcttccagtgaccttgtgtcgttgttcatattgtatctcccggagcctggcagtaggaacttaattagtatttgatgaattgacttaataattttccaatagacatcagaaataatacttagtgtgaacaaaacacttaatttcattcttacaaccttttctctgcatagattttactttttcctttgcatgccagtatttacagaggttttgagcagcagtcaaaagccagagtaccagagatcatagtctgacttgggttcttactagttgcatggcctggacagggtactttacctctttgtgcctcagtgtcctcattttaaaaataagctggtaatgattcttgttaccctcttgtggtaaggactgaatgtgtcagtggcagtaacacgccttcagtgttgtcatatgccgcctccctcttagaatcaactgagcttatcaacgtacagatcctagagtcctcagttaatggaaaccattgatgttctgataatttcgcactcactatttttttttttttgagatggagtcttgctctcttgccaggctggagtgcagtggcacgatctcagctcactgcaacttctgcctcccgggttcaagcgattctcctgcctcagcctcctgattaactgggactacaggcgcaccaccacgcccagctaatttttgtatttttagtagagacagggtttcaccatgttggccaggatggtgtcaatctcttgacctcatgatgtgcctgccttggcctcccaaagtgctgggattataggcataagccactgcgcctggcctcgcactcactattacagtgtagacattgcccatccatctccctctggcttgcttgcctctgtctccttgccttctcagccagttgtctttccaagtccccacttccttgctttctgtggcttacta

SEQ ID NO: 27249 - DNA, 1103 bp, Homo sapiens
cttaccatcaccagtgtctagtacagtgcctgacacttagtaggcagtcagtttgttgaatgaggatgtagagagtgggctctggggagagatccagtatagtggaggagttaatagcagagactctggagtcagagaacttgaatttacccactctgcagccttgaaaaagttatttgacctctctgtgcttctgtttcctcatctataaaatgggactgaatagtacctatctcatagggcagttgtgaaggtcagatgtaaagaaattgaaacagttcctgctacaaaataagtgctcaataaagttagctatcatcagtagtagaaattggtggctgatgaatgaaggaaaggatctttgtgcttagcaaactgttgaagaagccgtgaatagtgagtattcagtacatgagtaaatactagaatgttcttggtcagtgcttactatatcagtgaagagtaatactcaggcaatgagtgagtacgtattgataaaatgactgaattagtattaagcattccataggactttgtaggatgagtgaaaaccgtaaatgctgtgcaggccttaagaggcagacactgggtaccgctggctttatatcaagggcctccccttctctttcaccccagacacaggaagctccagtgcagagaggaagtgctaagtcagcacattctaatctcctccccacctactgaacagaaaatcagagctggggctgggcacagtggctcatgcctgtaatcccaggccaaggcaggagaattgcttgaggccagaagttcgagaccagcctggcctaacatagcgagacccccatctctatttaaaaaaaagaaagaaagaaagaaagaaaagcagaagaaaaatataattaagagaaaatcagagctgagagatctcaggggttgtctaacccaacccctctattttatagctgaggaaaccaaaattccaagaaaggatagagtttacccaagcagtcccagagctaattataatgggcatgacacagagtgggtaagtttcagaatgtgagtggaattgtttgggggattttggccatgattaaactggtattatttctttgctacaa

SEQ ID NO: 27250 - DNA, 1030 bp, Homo sapiens
tttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattct

SEQ ID NO: 27251 - DNA, 1049 bp, Homo sapiens
atttttagtagagacagggtttcaccatgttagctaggctggtcttgaactcctgacctcgagtgatgcaccctcctcggcctcccaaagtgctgggattacaggtgtgagccaccgcgcctcgcctcattttttttttcttgagacagggtctcactgtatcacccaggcttgagtgcagtggtgtagtcagagctcactgctgcctcaaactcttaggcggctcaagcaaactcctgggctcaagtgatcctcccaacttagcctcctgagtagctggggccacaggcatataccaccgcacctggctaatttttaaaaatttttttgtagagacaggatcttgccatcttgtccaagctggtcttgaactcctaggctcaagtgatcctcccacctcagcctcccaaagtgctgggattatgggtggtgaaccacctagcttggtccttgtacatttcttaacagttggtttgtttgaatcaagatcaaaaaaggagctggacgtagtggctcaccatggtggctggtattacatgatggacctgtaataccagcagtttgggaggcctaagtgggagaatcacatgaagccaagagtttgagaccagcctgtgcaacaaagcaagaccccccccaacttctacaaacaattttaaaaattagtccaggcatggtggctcatgcctgtaatcctagcactttgggaggctgaggtgggtggatcacttgaggtcaggtgtttgagaccagcctggccaacacggtgaaacctcgtctctactaaaaatagaaaaaaaaaaaaaaaaaaaaaaagaaaagtcgggtccagtggcgcacgcctgtagtcccagctactctggaggctgaggtgggacgattgcttgagcgaggagttcgaggctgcagtaagctgagattctgccactgcactccagcctgggcaacagagcaagaccttggctcttgaaaaacaacagaatgtgaagaccttgactcttaaaaaacaatagaatgtgtacaacagtcctacctctgggagtggatcc

SEQ ID NO: 27252 - DNA, 1063 bp, Homo sapiens
acgcctgtaatcccagtgttttgggaagcggaggcgggcagatcacctgatgtcaggagttcgagaccagcctgaccaacatggtgaaaccccgtctctactaagaaatacaaaaattagctgggcgtggtggtgcatgcctgtagtcctagctacttgggaggctgagataggagaatcgcttgaacccgggaagtggagattgcggtgagttgatatcgtgccactgcactccagcctgggcgacggagtgagaaaaaaacacaaaaaaagaaatagccctgaggacaggtccttctccagctcatctcctgccaccccatgttctgttcattcctgaaaaagtcactttccatctctggatcccatctgttaactgaatgacttcatcaggtgatctccaagttcccttctaaccctaccttctcgaagcttttaaagattctggtcttacatctgtctgatgataagagggaatattttattaacttgactttttattgtgacaattttctgaatggtataataaatacccaagtacccatcacccagattcaaggattaacaagcttttgccatctatctttcacaaaaatattttaaagcaaatcttaacctcatgttatctcactcctacatacttatatatatatatatatgatcacagtggttttttttttttttgagacagagttttgctctatcacccaggctggagtgcagtggcacaatcacagttcacagcagcctgtaacttgtgggctcaaacagtcctcccaccttagcctcccgggtagctggaactacaggtgtgtgccactatgcccagctaatttttaaaaaaaattttatagagatagagtctctctatgttacctaagctgatctcaaactcctaggctcaagcaatcctcctgtttcagcctcccaaagtgctgggattataggtgtgagccaccacacccagcccacaatactgtttttaaaaaagcttaattgagacatacttcacataccatacaattcacatatttaaagtgtacaaatcagtccgggcatggtg

SEQ ID NO: 27253 - DNA, 1041 bp, Homo sapiens
ctgaagcaggagggtagcttggagatggaggctgcagtgagctgtgatcacaccactgctctccagcctgggccacatagcaagaccctgtctcaaaacaaaaacttagctttgtaacctgggagggatttaacccttctttttggtggaatatgcatccctggcattgagtcagtccttaataaatgatagcctttatgatgatctgaggtttatcattcttaattgcctgttaatggcatttttctattaatattatctattttttgagatagggtcttgttctgtcacctgggctggagtgcagtatcatagtcacagctcactgcagccttgacctactaggctcaagtgatcctcccacctcagccttctgagtagctaggacttcaggcgcataccactatgcctggctaattttttgtattttttgtggagaaggagttttgccatgttgcccaggctggtctcgagctcctggggtcaagcgatccactggctttggcctcccaaactgccaggattacagacgtgggccactgcacctggcctattattttttaatttaatattaatttatatttttagaaacagggtctcacactgttgtccacagctggagtgcagtagtataatcatagctcaccgtagccttgaactcctgggctcaagcagtagtcccacctcagcctcccgagtagcgtacaccatcaccccagctaatttttaaattttttcctagagatgaagtcttgctatgttggttaaactggtctcaaactcctggcctcaagtgatcttcccaccacagcttcacaaagcactgggatggattacaggtgtgagcaaccatacctggccctctattatctcatatatagcttattgttacatatgctgtaattatatatagttataattatttaatacatatatgtttattacaaatatgcctgttaatggtatattctgtttttaaaaggaaggataattacttttttctatgagtaccttaagggcaggaactgagttttatttgtg

SEQ ID NO: 27254 - DNA, 1050 bp, Homo sapiens
tatataatatataattatatgttatatattttatatttataaaataaaaataaaaaattgcaattattttcaaatagtaaaaccacgtagataaaatataattctggccaggcacgtggctcatgcctgtaatcccagcactttgggaggctaaggtgggtggatcacctgaggtcaggtgatataatatacaacagatataatatgtctattatatattatatataatgttatatagatatctatattatatataatatattaatagatatattaatataatatatattatatattatacagatatctataaatatattatatataatatattatagatatatctatgtatattatatcacctgacgtcaggtgatccacccaccttagcctcgcaaagtgctgggattacaggcgtgagccacgtgcctggccagaattatattttatctacgtggttttactatttgaaaataattgcaattttttattttattttttggttctggaaacatttgtgtggacttacctatgattgtcaggtttactgatttgctggagattttttgggcatgacaaagggtttcttctttgataaaagtttttctgggtaatgtgatggtacaggttgagtatcctttatctgaaatgcttgagacatgaagtgttttggatttgagaatttttagcatcttggaatatttaccacatacatagtaaggtaccttgaggatggggcccaagtctaaacacagaattcatttgtgtttcatatttatcttatatgcatgaaacaaagttgtttgttttcttttttttttgagacggagtctcactctgtcgcccaggctggagtgcaatggcatggtcttggctcactgcaacctccgcctcccaggtccaagcgattctcttacctcagcctcctgcgtagctgggattacagacatgaggcaccatgcccggcaaatttttgtatttttagtagagatggggtttcaccatgttggccaggctggtctcaaacccctgacctgaagtgatctgcct

SEQ ID NO: 27255 - DNA, 1047 bp, Homo sapiens
cgcgcctggccgcctcttatcaaaatcttaaacttgttaattcttgtatctcaccttgcttttatatcagtttttgttatagaatgtgctttctttttaggttatttttcttctgctcagcaagttaactttgaagaatcttttttttcttgccttttttttttttttttgagacagaattttggttttgttgcccaggctggagtgcaatggcgcgatctcagctaacggcaacctccacttcccgggttcaagtgattctcctgccccagcctcccgagtagctgggattacaggcatgaggccaccaggcctggctatttttattttttattttttatttttattttttactagagacagtgtttttccatgttggtcaggctggtcttgaattctcgtcctcaggtgatccacccgccttgacctcccgaagtcctgggattacaggtgtgagccagcgcacccggcctcttgccctctttagagcagttctacataaatctgtggaataatctgctgacgttagaaataaacctttctcagggtgtggccataatctggttcgttgtaattgctgaaggaaaaaactgaacccttaggaacagtttaaacattctaggtggtttttagatatattattcctgttagagttttgaactttgatcatcttgttagaaaaaagaggccaggcactgtgcctcatacctgtaatcccagcattttggaggctgagtcgtcaggaagtcacttgagcccaggagtttggtaccagcctgggcaacatatggagacctcgtctctacaaaaaaaaaaaaaaaaaaacaaaacctgttagccaggcgtggtggctcatgcctgtgttcccagctactcaggaggctgagatggaaggattgcttgagcctgggaagttgcgactgcagtgagctgtgattgtgccactgcactccagcctgggcaacagagtaagaccctgtctcaaaaaaaatgaatttttgcattcatttaaaaatgaatggtagcaacattttagataataactta

SEQ ID NO: 27256 - DNA, 1025 bp, Homo sapiens
gttggttttcttttttttttttcttttgagacggagtctgtctctgtcgcccaggctagagtgcagtggcgcgatctcggctcactgcaagctctgcctcccgggttcacgccattctcctgcctcagcctcctgagtagctgggactataggcgcccgccaccatgcccggctaatttttttgtatttttaatagagacggggtttcactgtgtttgccaggatggtctccatctcctgaccttgtgatcctcccgcctcggcctcccacaagtgctgggattacaggcgtgagccactgcacccggccagttgttggttttcttttctgtgccagattgagtgatatatggtggtactaagagcactggaataggagtcaaggactgaggtacagcatagcacctcatgtattacttggtatctccacttgtctctaacactgaagaggtataattggttgtttaaaaactgtgggtgtaaaacgctagtatcccatgaaatggaactgcagaatataagtggatgactctgaaactgcttttgaaacaagcatgagggctcagtttctccatctctcgtgggctccaccatcactgtctgacatcctgatctcctaaggcatctttcctccatcccagagctctgttgaaaatctcttgggctaaaaaccagtacagaccttctgatactcacgttctagcctttttagattgttgtgtgtgaagagtaagtcagctgtggatatttttctttcctattttgtgaggcatttggtatttactggaggctgcctgttttgttgcaaaccttgttccactgtgtactataggaggtctgctcagaaagcctagttagtagagcagtaccatttgctttggtcaattgtagcagcagtctgttttttttttttttttttttttttttgagacagagtcttgctgtgttgctcaggctggagtgcagtggtgtgatctttgctcactgcaacctccgcctcctgggttcaagcgattctcctgcct

SEQ ID NO: 27257 - DNA, 1036 bp, Homo sapiens
agtatctcattgtatagatgtaccacattttgcgtattcattcttcagttgatagacatttggactacttcctccttttggctgctgtgagtaatgctgctgtgaataaatatttgtgtgtaagtttctatgtggacatacagtttcattattcttgggtagataaaccttggagtaattgctgggttgggtggtaatttctgtttaacttttaaagaaatagctaagctgttttccaaagtggcttcaccatcttaaattcaagtttttgttttcgttgtatttgaggcagagctttactctcttgcccaggctggagtgcaatggcaagattatattatagctcactgcagcctcgatcttccaggctcaagcgatcctctcacctcagcctcccaggtagctgagagtacaggtgtgtgtcaccatgcctggctaagttttgatttttagtagagataaggtctggctatgtttcccaggctggtcttgaacttctgagctcaagcagtcctcctgccttggcctcccaaagtgctgggattgcaggtgtgagccaccaagcccagccaaggtttttgtgttttagtaaaatttctgctcttcctggcaatacttttttctgaaatttactttgatattgatatagtcactccagttcttttcagtgcttagtttttgcatggtatattttttccatccttttgtgttatactgtctgtttcattatatttgtagttggaccttgattttttttttttccctaattcttttacttgggatgcttggacctaatgtgtgtctagtttttcctaatgtgtcttttacttgggatgcttggaccatgtgtatttaattattgatatggttgggttaagtccaccatctagctatttgttatttatttatttttagagccaaggtcttgctgtgccacccaggctggggtgctagtggcatgatcatggctcactgaagcctctaacttctgggctcaagcagtcatctcactgcagtctcccgagaagctgggatt

SEQ ID NO: 27258 - DNA, 1811 bp, Homo sapiens
atctatatggggaaaaaaaaaaaagttagccaggtgtggtggcacatgcctgtagtcccagctactcaggaggctgaggtgggaggatcacttgagcccaggaggtcaaggctacagcgagccgagattgcaccactgcactccagccagagctactgagtgagaccctgtctcaaatctattccctaatatatttacctaattatttaatcacccactcttcactgttgcagccctttcttcatgcagatgtcctctttactttgcttggactccaacaccctgtgttgggttggctccactctcatcccatggatgagttcactcaagctctgaccagtcacatcagggtgttctcccatatacatgcccttctcaacccgcgtgggcttcaatactctgtcctttgtcattccctgtttgggcatttcactcatcttgatctccaactctcacgtcataccacactcagatacacacagataccttctgtgctccactcaggctctgactctctactcttgtctacctagcctcaggcctccacttttgtatggatgcctaccttgctgtgtaccatgtaatggaagggaagactagtttgggggaagagaagggcagctcttcccatttaaaaagattggtttgtctttttgttttaggtttatagaattgaaatatataggtgggcttggtggctcacgcatgtaatcccagcactttgggaggctgaggcaggtggatcactttggtttaggagtttgagattagcctggtcaacatggtgaaaccccatctctactaaaaatacagaaaaattagctgggtgtggtggagggtacctgtaattccagctactcagaaggctgaggcacaagaattgcttgaacctgggaggtggaggttgcagtgagctgagatcgtgccactgctctccaacctgggcaacagagctagactccgtctcggggggaaaaaaaagaattgaaatatatgtatacacacacatatacacactctggatacatactgtatcccgagtatgtgttttgcaaatattttctcccagtctgtggcctgccttttatttcttttcttttttttgagacagggtcttcctctgtcacccacgctagagtgcggtagcacagtcacaactcaccgcagcctcaacttcctgggctcaaagtgatcctcccacctcagtctcttgagtagctgggactacagacacgtgccaccactcctggcccattatgtctgttttttgtagagatgacgtctcactatgttgcctagggtggtctcaaactcctaggctcaagtgatcatcccacctcagcctcccaaagtgctggtgagccaccatgcctggcctggcctggcctgcctttgcatttttattaaagtgtcttttgattagaagtttttttgttttgaggaagtctgttttatccacattaaaacaatatgtttttaggaacttttgcctatctattaatagtgcacaaaaatattttttggctttatatttttggctcttaggtgtgcgatttatgtcaaattaatttttatttttgagagggagtctagctttgtcacccaggctggagtgcagtggcacaatcttggctcactgcaatctccacctcccaggttcaagcaattctcctacctcagcctcctgagtagctgggattataagcacttgccaccatgcctatttttctatttttagtagagatggggttttaccatgtttgccagcctggtcttgaactcctgacctcaggtgacctgcccgcttcagc

SEQ ID NO: 27259 - DNA, 1164 bp, Homo sapiens
acctcgtgatctacctgccttggccttccaaagtgctgggattataggcgtgagccaccatgcccagcctcagctatttttattttcgatgctattatacatggaatttgttttaaaaatttgtttcccagttttttgccctagcaggtatatagctgatttttcaataacttgtaattttgacataatttcagacacgattgtatttgctttataattctagctacatgttatttttttcatgtactaaagtgcagacataatgccccctaacctctaaatagttattaacaacaagtacattctctttcataaccacattgcaattatcaatgtcagaaaattaatgttgatatggtactgcttgctgtctaatgtgcatactttgagctgggcttggtggtatacacctatagtcttagctactcaggaggctgaggtgggaggatcgcttgagcctaggagttgaaggctgcagtatgccatgatcaaccctgtgaatagccactgtactccagcctgggcaacaatagtgagatccctatctttaaaaaaaaaactgcatattttactgaaattttacctattcttttctaatgccaattataaagcaaaattctggttgaggatctcatccttgatcacatggtacatttgtttgtcaaatctcattttctttaatctgaaaaagttctcacaaacattgtcttttatgacttaattttttttaaagtacagaccatttattttgtattaatagtaagttctccaatatggatttgtcttgatgcttttcattattaaagtaatgtttttgacaggaatacctcagcatgtcctcctcagtacattttatcaggagacacgatacctgtttgtctgatttctgataacgataacttcaaacacttggttaaggtggtgtctgccttatttctctcctataaatagtaccttgtagagagatacagtagtcccctttatctgctggggatgtttcaagaccagtgggtgcctgaaattacagatagtcccaagccctatatatactgtgttttttcctatgcatatgtacttttgataaattttattttattattcctttatttagtttttagaaatacggtcttacaccgttgcccagcctggtcctgaatgaacttc

SEQ ID NO: 27260 - DNA, 1048 bp, Homo sapiens
gatgtgttcaacgtatttcattcttctttctgaatgtttgttcctggagccatcttttttcctgctctccgcatggacagtttgtggtgtaaggtggccagccatcctggtttgcccacgattgaggggtttcccggggtgtaggactttcagtgctaaaactggaaactcccaggcaaactggggcctgttggctactcttttcacgtgcatgtggctgttttcctcggactttccttatatgtaccttgggaattctcttcactttctcctggtatgtcctgcctttcctagatctcacacaaatctcatttattgttactcctttagttgtgtgcgcattctctacacaatacatttatgtagagcagattgacgtagagttgcttctagagaacaggtgcctaggaggtaaattgaggccttacatgtctttattctgtgttccacactagattgttggttgggctcagaattccagaagatgttactcttactactacattcttcagagctgcttttgagaaacatgccattgtgatttctggatatcgtgtgttttttttgaccggaagattttaggatctgtttctctcctgtgttttgagatttcatgataatgctgtggaatgggtctttttcattcattatgctgagtgttttgccttattaaactcggaaactggagtcttctcatttggggaaaatttcttgtattatttctgtcttttggctttcttcctctggaccttctatttgttggatgtgggactctcttaatggagcttctttttcttttttttttttaatcagttctctaggagataatctgttgtttttggcctctcatttttaatttctagcagattgttcatgttctttaatgttgctttatttttttaaaaaaatattctggctgagctgtagtacgtgtctgtggtcccgactactggggaggccaaggtgggagaattgcttacgaccaggagtttgagtccagcctgggcaacatagcaacaccccatatcttattttaaaaaaagcactc

SEQ ID NO: 27261 - DNA, 1028 bp, Homo sapiens
agttcatgccctttgcagggacgtggatgaagctggaaaccatcatcctcagcaaactaacacaggaacagaaaaccaaacaccccatgttctcactcataaatgggagtgaacagtgagaacccatggacacagggagggaaacatcacacaccggggcctgttggggggtggggggaaaggggagggagagcattaggaaaaatacctaatgcatgcggggcttaaaacctagatgatgggttaataggtgcagcaaaccaccatggcacatgtatgcttatgtaacaaacctgcacattctgcacatgtatcccagaacttaaagtaaaatttaaaaaaaaaaaaacttcaaaaaaaaaaaagtgctcaacatctttagacattaggcaaattaaaatgaaaatcattgaaatctagcactctgaattaaaattaaaaccacaatgaggtaccattatactcccactagaatggctaaaataaaactgccagcttcaaataatggtgaggatttggatcaactggaactctcctcaagtgctgttgggagtataattttttttttaataaagttagctttcatccatcttatgactcggcatttctactcctagatagttattcaggagaaatgaaaacgtctccaaaaatttacaagaatgttcataatagctttattcataatagctagaacctggaaataacccaaatgtccatcaagagagaatatacaaatggttgtatatgagaatattagtctgtaataacaaataatgaactactgatgcatgcaacaatgtagatgaatagcataaacaggctgagtgaaagaagccagatacaaaagaatatatatgtatgagtccatttacatgaagaccaagaacaggcaaaagtacgttatggagatagaagtcagaacaatgattgccttcgtggggtgagaggggtggtttcttttcttttttttttttttttttttgagacggagtctggctctgtcacccaggctggagtgcagtggc

SEQ ID NO: 27262 - DNA, 1028 bp, Homo sapiens
cctgttgcccaggctggagtgcaatggcatgatcttggctcactgcagcctgcatgtcccgggttcaagcgatcctcctgccacaacctcccgagtagctgggaatacaggcatgtacaccacacccaactaatttttgtatttaagtagagtcagggtttcattatgttggtcaggctggtctcgaactctggacctcaagtgatctgcctggcttggcctcccaaaatgctggaattacaggcttgagccactgcacctggccaagcccaggactttgagaccagcctgggcaacagaccaagaccctgtctgtacaataaaaattatgcagtattagaatagcaaatcttactcttaaaagttttgttttccttgtctttttactgaaaatgcatggctttagaaacttctgggtagtttgaattgcagacaaccaggccctattcctgtttgtttaactaatgagatttgtaaacagtacttggtttccccagactctaggacctagaggaaggaaattttgatttagctcttggtaaagcatttaacacctaatttttctttttcattgttattttcttgatcacagaaaacaatacatgttaatagtagaaaatacccacaattgaaaagaatataaagcacttactaaaactctaccacctaggctaggtacggtggctcacacctgtaatcccagtactttgggaggctgaggtgggtggatcacctgaggtcaggatttcaagaccatcctggccaacatggtgaaaccccatatctactaaaactacaaaaattagctgggcgtggtggcagccacctgtaatcccagctgctcgggaggctgaggcaggaaaatcgcttgaacccaggaggaggaggttgcagtgagccgagatcatgccgctgcactccatcctgggtgacagagcgagactcttgtctcaaaaaacaaacaaaaaaactgccacctagagatggtggtggccaacagcttagtaagaatttctcttgcatttttc

SEQ ID NO: 27263 - DNA, 1047 bp, Homo sapiens
cctaccccccactgccccttcccagtcacagccccattcttccagctgaaggtaacttctgtcttgactttatgaaagttattttcttgctttcctttagattacctacccgtctttgcattcctaatgctgtagtttagttgagcttattttgaacttttcacaaacggaatcatcaactatgcattattttgtatctggctttcattcactattttgtttttaatattcatctatgtcgttagtagctatagttcattcattttttgttgctgtataatcatccatttattgaatgtactacaatttgattctgcctttggcagccactttgattgtttataatccagatttcaaatgctgcatcatgaacatgtgggttgtgatttgtgtagatgtgcatgtacttctctaaggaatccaagcctaggagggacgttgctgggtcagaggatgtttgtatcttcaactgtaccagataaggccaaattgtattctcaaatgcttggatctgttttcagtgtacttgttctactcctaattaacactacttgatattgtcaaactttaattgtagccattctgatggatgtggtagtatctcattgcggttttaatttgcattattttgcattttccttattgttagtgagattaaatacccttttatatgttttggctacttcagtatcctcttgtgcagtgcctaattcacatcttttatttttcttctgagttgccttttgcccattgatttatatttgttccccctctctccccgcccccaagaaggagtctggctctgtcacccaggctggagtacagtggcacaatcttggctcactaacctctgcctccttcgttcaagtgattctcctgcctcagcctcccaagtagctgggactgcaggtgtgcgccaccacgcccagctaatttttgtatttttagtagagacagggtttcaccatgttgaccaggcttgtcttgaacccctgacctcaagtgatccatccgccttggcctcccaaagtactgggattacaggtg

SEQ ID NO: 27264 - DNA, 1051 bp, Homo sapiens
tgggagaaatgagcttgtctgagagccatgggcgcggcttggtgatacttttgaccagtggaatgctgtgccttcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtgagtggcgtggcacttatttctctgcctgtaaagggggcccctgcaggcctagtgagaagatgatgtcttctattccaattcctttaccagtttatttttacttcttgggtggccctctattttttgtttatttttactttgtaatttgcttatttcatttgtagctctctgctaaactgtgagaactcctttcaggcagagatgatgccatactgtttctcgtatgtccctgtaggcctagtctatgcctgccttgtactgcatagtaagtgtttgagtgagtgaaaactgcttctgagcttctcagtgaagaattccaacaccccttttctctcttcggtagcatgttgccacatttgttcccaacatctgtagtctgtatcagacgctcccttttttacaacctagtcagtatgttgagtggaagcatgtgttgaattttggggatgcaaacaaattcagtagtgctattatctatacctcccacccctcaccccaccccacccccattagggttatttgcaatattagtatgctctttgctatttcaggatttaattcttaatgacccacatgctggttttttttgtagatgaaaccattaagaagacaagcttttgcttctgagaattagagtaaacctttgcccatgtgagaactaggtttgctgtcttgctgcttttccagctcatcagcagtgctcaatctaaggtctcacaggtctctagtcctagtgagtttttcagataaaagtaacatttgctgaggcttctgtgagaggtattagcatctcagttggctttgaacagtccttagta

SEQ ID NO: 27265 - DNA, 1989 bp, Homo sapiens
agcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttaga

SEQ ID NO: 27266 - DNA, 1064 bp, Homo sapiens
ctcaaaaaaaataaataaataaaaaattaatagaggaacacaaaaatgtcttctattcaactttgttaattaaatgacgggttggctgggtgctctacaaaaagaataaaaaactagttgggcgttggtggcacgtgcctatagtcccgctactccagaggctgaggtgggaggatcacttgagcctgggaggcagaagttgcagtgagctgagattgtgccactgcactccagcctgggcgacagtgagaccctgtttcgaaaagaaaagaaaagaaatgataggttaaatgtatttagagatgtaaaaagcccagggagacagacgtcttagggaaaaaaatgttttttaatctagatcaaggatggatcttggaaattgcctcctgaagaggagggtatatctttgtgaaaaatcagaaaatgtcacttttgttattttcttttctgtattttaggcattcatttttgtttctagtggtcattttattgtcatgatgattaccaataaagaacaggagttttaaaattttgtagaaacactccttttctccttgttataggcttctgggttgcaagtatgttgtagaatatatggggtgaaaaccacagtcttgttacaggttttagaaattgacttcacatgaagttagtgaagcttttggtttttgtaggtctacttcacaattttaaaaattgtatttggtttaagtgggtctgggaagaagttcaccctgcttctttaattgtatttttctgttgccgttgttctttcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaagtaagtaaacgttatcttttattgtggttaatgttccttaatgatcgttactaaggaggtagatgctagcttatgactttggacattttcttttttttcttaatttatctagttaacttttctcagttaacacagaattta

SEQ ID NO: 27267 - DNA, 1052 bp, Homo sapiens
ctggagtgcagtggcgcgatctttgctcactgcaagctccgcctcctgggttcacgccattctcctgcttcggcctccccagtagctgggactacaggcacccgccaccacgcctggctaagtttttgtatttttagtagagacgaggtttcaccgtgttagccaggatggtctcgatcttctggccttgtgatccatctgcctcagcctcctaaagtgctagcattacaggcgtgagccacagtgcccagccatagctaacattttaaaagtgcttatgtcatgcacagtgtaagcacttaatttcactttcgcagcaaccctgtgaggttttacacataaggataataaggcttggagaggttaaataacttgagctaggatttgaacccaggtatacctgtctccagaacctagatcagtcagtccctgctgaatggggaattgaggaagaggttatttgatttatctaaggtatacagatgtttcttttccttgcacccacctttggaaactgtaagtactcaccagataatgactctgggcaaattgctgctaagcgttgatgagagtaccaaggcatgggagatctgtcctagacctagacaggtttgatacacttggagaagatggacttggtgcctgcctgtgttcaagtcccagatgagggttacggaaggcaagaaccacaactcttatgggggagagtgtgattggggtctgaggaggcttccttccctgagagggtgaccagaattagctgctttggatggtcggtgttgtagaacttcaacagtcgaggttgggagggattgtggtcttgaagaggcttataactctgttgcatgtccatcggtgctggggaacattgagaggctaagtttgcagaggctgaaggtcactaaccaggtgctttgttgatcctggaaggctgggatcaaatgctcatacccagctggttcaaccctgacatagaagtactgtgtttggcctgcacagagttttatttatttatttatttatttattaaatataaaggatttgtctccagg

SEQ ID NO: 27268 - DNA, 1438 bp, Homo sapiens
aataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccatt

SEQ ID NO: 27269 - DNA, 2099 bp, Homo sapiens
ctaattgttattcttacttccatttagccattccagtatttatctagtgttcctccttgatgtgtgagatccttgggggaggggtggcttctctgaataagaacaataaaattttaattgtttttcattattgtaattataatagccaacatttttttgagcaccagacattttgcattctattcacttaatatttattaaatcatatagtaagtttaaaaataccattccaggccctgggaatacaataaacaagatagaccgaactggggttttgagtttagttaggagagggagagacatagtaaatgaggaaacagataaacatgttttgcatgtttttttaattgtttaatcttgatgacatcctaagtaagacattatttgaggatgcccattttgcagaggatgaaactgagtaacagaaggtactctgagtactagtctcagagctgatgtccttaaacacgtgaaagggaggctttacgcttctttttttttgcacccattaaatgttggattgaagatagaaaaagtagatacacccagcttgcagttactgcttttgatggtttgatccattcctcatgaaatttccaactaaagaggcggatagtgattactcttttaggcttgcaaaggtacagcatctctgtaaaatgaaaggcttttttttttttgagacggaatcttgctctgtcgcccagactggagtgcaggggtgtgatcttggctcactgcaacctccgtctcctgggttcaagctattctcctgtctcagcctccggagtagctgggactacaggcatatgccaccacgctcggccaattattttattttattttattattttttttgagacggagttttgttcttgttgcccaggctggagtgcagtagtacaatatcggctcactgcaacctccccccgccccaggttcaagcgattctcctgcatcagcctccagagtagctgcgattacaggcgcctgccaccacacctgactaattttttgcatttttagtagagacggttttaccatgttggccaggctggtcgtgaactcctgaactcaggggatccatctgcctcagcctctcaaagtgctgggattagaggcatgagccactgcgcccggccttaatttttatatttttagtagagacagggtttcaccatattggtcaggctggtctcgaacccctgacctcaggtaattcacccacctcagcctcccaaagtgctgggattacgagcgtgagtcaccaagcctgaccagaaaggactttttatttgaaaaaattggggggctcttctgcctatgaagtagtcttcctttgtttctttacttccataataaacttgctttcacttaaaaaaaaaagattgtgtccaaatttcttttgtgtagtatttagtttaaaatatgcccaaaagcacaacttttgcttctgttacgtaactacatttttgttttcttttttcctttttttgagacagtctctctctgtcacccagactggagtgcagtggcgtcatcatggcccacagcagcctcaacctcctgggttcaagtgattctcctgcctcagccacttgagtagctgggactccaggcgccaccacacccagctaatttttttattttttgtagagatggggtcttgctttgttgcccatgctagtccggaagtcctgggcttgagtaatcctccttcctcagccatccaaattgctgggattaaagtcatgagccactttgcctggccttttttagtgtttctaagagaattctgtattacattcctagacagtacacttggtgtagtactcagcctcctgaggagctgggattacaggtgctcaccaccatgcctggctaatttttttttgtattttttgtagagacggggtttaaccatgttttggctgggctcctgacctcaagtgatctgcccgcctcagcctcccaaagttctgggattacaagtgtgagcctctgcacccgcccttgattgaagttttggttttttttttttttttttttttttgagacggagtttcactcttgttgctcaggctggcgtgcaatggcat

SEQ ID NO: 27270 - DNA, 1010 bp, Homo sapiens
tacaggcatgcaccaccacacccagctaattttgtatttttagtggagatggggtttcaccatgttggtcaggctggtctcaaactcctgacctcaggtgatccgcccgtctcagcctcccaaagtgttgggattacaggcatgagccaccacgcctgtcctaggtatgttttataacatacaaaaatagacattttacagaaggataaggtaaaataaatggaagtagcagttccaacgttgtctttctacacccagtggtgaattttaacaatacctcctggggtggagatcattgatcttgtagtagtaccttctcaatccattaggtctattgctctgatgaaatctagtttattcggtagaagtaaaatgtaatggctgggtatggtggctcgcgcctgtaatcccaccatttggaaggtcgaggtgggcggatcatctgaggtcaggagttttgagaccagcatggccaacatggtgaaaccccatctctactaaaaatacaaaaagaagctggctgtggtagcgggggcctgtagtaccagctgaggcaggagaattgcttgaagccaggaggcagaggtggccgtgagctgagatcccaccattgcactccagcctgggcaacaagagggaaactctatctcaaaaaaaaaaaaaaaaaaaggccgggcacgatggctcatccctgtaatcccagcactttgggaggctgaggtgggcggatcacgaggtcaggagttcaagaccagcctggccaacattgtgaaaccccgtccctaccaaaaaacgtacaaaaaaaatcagctgggcgtggtggcgggttcctgtagtcccagctacttgggaggctgaggcaggagaattgcttgaaagaaactgcggaggttgcagtgtgctgagatcgtgccactgcactccagcctgggcaacacagcaagactctgtctcaaaaaaagaaaaaaatgtaatggttaagatttaaattctaaagttttgaaatttaa

SEQ ID NO: 27271 - DNA, 1878 bp, Homo sapiens
tgtatatcctcttcatctgtgtttaggattttgaaatgcatttttgttggattattgccccactagaaaaaacagttcagatctgttgcagtttcacatttgaaactactttcattctggaatccttatccttagaccttcctaataatttctgtggtcacactggacctgatctcttcctgtgctaaacaaaagcacacaatcacaaaactgtgtaggcataaatgagaggcatatgggagtggtgtaaaaggaactggaagagtcttaatatgcctgggtgggcgagctaaactaatagctcccagcagtttttctgaatcagacattgtggagccaggagtctagcatttggaattccactgcctgtgcaaagggtctgtcttttatcctccaaaccaccatttgttaactggttaatgacccagtggacccgttgacaacaaaggagggaaagctggtaaagatcaagttaaaaggaaaaagaaaagttcaaaggtaggaaagtaagaacaagaagggtttaatcatatcttcacctactctttattttttaacaatttattgtggggaattttgaacatacacaaagtagatggagtaatgtagtgacctcccatgaacctatcccctcagccccaataagctgcagttaccagacttaatgaaaggaaaccagaactctggtgaggcttaggtttggtttccagacctctctaggccttgtcacctttggccttatcccatcaaacacctcttttccccatttttagctcctggtgtgcacagaacactgcgtttaggctagtgatgagtatgacagtacttaacctctaatagattaaggaaataactgttattgttcaagtatggttttgagagcagaaaagtgtaattctgtcaaaggtacacaacgaagagggaacttaggaaggcattattgagaagttgacatttgagtttacagcagaaacgttgggcaaggggtagggaatgatctctgagatagcagcatacccgatctactagctctttttcaccaggctatttagagtttgacatttatgttacatttataacaaggtacatttcaagtgtagctttcctttttgctttaagcaactgagacatgtaagtcaatttcagttattttctgctaaactgtgtgtctctttgaatgttcactatcaaggtgaattatacaaggtgtgttagatccttttaacatttcagagcaaccaaaaccaagtttgaatgtctcatttaacactgtgagaggatgtatcttgtctgcatcttgtgtttcagttgtatttatcggtaaaataagccaggggagtattctgacttgcagtttaaaagctgacaggcctaggggaatgttccacaaaatagtatattttgtatatggcatggtattatagataaatgagctattgtgctgcctggcactgtcttctcccttgtgctgtcttctgctgtttctcaaggagtgattcctctctgtgttttggaaccgtgtttctcactgcctacagatgatgtccatttggcttatttcactgtcatctcatacacagctgtttcaaactgcatggaatcctcagagaactacacgccccttcctgaacaaacagtgcttcttcctgcattttcttcttaaacttttatcacttttccccccttacatatacttttgttttattctttcactaaaaaaaaaatgaggtttaattgacttacaataaactacacatatgtaaagtgtacagtttgctcaggtttggcaggtatacctgtgaaatgatcactgcaatcaagatagtcaacatatcattcactccataaagtatccttgtgcccattggtaatctctcc

SEQ ID NO: 27272 - DNA, 1047 bp, Homo sapiens
cttcctgtcaataattggcatttctgtttaccattgcaacttattctagcctaggtcccacttaaaattatagttggggagagagcatcagagttgaggttcggaaatttggtttgaattcccattttgctgcttagtgtctgtataatcttgggcaagttttttaactgttaggcctgtttgcttatctgtaggaagagagtaacacaagaactttacaatatgtcatgtgaattgaaagagagaacatagaaatcatagccatgtgcctgcaacacagtgtgggtagtctgtaaatatttagtctggcactagtgtgagcaccaagtgaaggaatgaatgcttgtttgcatatcctatttctgcactgttgcttatgctgttctccaatctcttttcaggccctctgcatcttcctcatgtttcgaggtcaatgaagcccatctttattactcatttcctatcattgtttacatccctgttgagttgatatcttactaaacttagggactgggagtatatctttggaaaatatttgttttcctcaaaatgcctaccataaatgtattataggtccctaaaataattggttgattgtatagttaatttggaagcagtgcatcaaaatactttgtagggtgacagcgaagtaaggttttttttgttttttgtgttttttttttttttggtagaagacagtctttgtctgtcactcaggctggagtgcaatggcatgatcacagcttacttcagcctcaaactcctaggctcaagcaatcctcccacctcagcatcctgagtagctgggactataggtgcgtaccaccatgcctggataatttttttttttaatttttatttattgtagagatgcagtcttgctatattggctgggctggtttcccaaaggcctcctcaagtgctgggattattggtgtgagccaccatgtctggcctgtttgttttttggtcagatttaggttttaggagtgaagtaagttgaattttacatgctacagtggaagtggcagaaatgtttttgtttga

SEQ ID NO: 27273 - DNA, 1050 bp, Homo sapiens
aggtgtgagtcacttctcctggcctgttccatcaacttttaaaaatcttctatcactattaagtttaattcttgatttttttttcctttttctcttcttgccctccctgccctttttttttctgcttacgtaaaattcttgattttaaatgatggtccacagctgctgtagtctgacttgtgtcccataagggctgatgactcaaacatcagaattgttgttcagttttaattttcaagatcacttttgagtttgattgcttccctggtttttttttttttttaagttgacaaaattttttccaagctttgtaatgctcagtgtgtgaagcaaatacacaaccatttatgaagtctttaataactaataaaactggaatctacacattgtcatataaattggaaaattagaatatcttgtttgtggagagcattttcaggttatttgacttaacaatgatgttatgagactacatggaagaataattggatcttgagctgtttaaacatgtgctaaatagaaagaaacaaagcttcagaggacctcaggtgacacctggtcctgtcttctgatttttgacagatgagagttttagggatttagataattggcttagtaattgaatcagtgaaacagctactccaggctctttctgctgaattgtaaggggaaatcagtgtctcttgaaatgtttgctgtaaaaaaaaggaagacactattttctgatcagttgtacatttcaaattctaaacatttttttgagcattgttaaacactgtcaagccgtgtggatgtgaaggtgaataagacagaatagtgaataagatagcctttgttgtcacaggagtttgcaagattatctaacatttaggaagtgagacaaatgggcttatgctgtcccctgcaccccagcaaatgtgtgaaatgtccccttgcttgtcactccacttcatcgtccttctgcacgtttaatgctgtccatacatgctgacttcctcctgcttctttctgctagtcataccttttaccatctcagggttcctatattat

SEQ ID NO: 27274 - DNA, 1046 bp, Homo sapiens
cctcataaattttagaataatatctgtaaagatggtggtagggtattaatgttaataattttggtaattatactgggcttataagtaaacatcctaactcttagcatttacacactgaaatatttaagcataagggagtgtaatgtttccagcttgctctcaagtggtttagataaaaatataggtagatagagaaaaagaaagtgatttttataaatggatgaattaattggtgaatttagctaaatgatattaacagaattatttgaatagtcttgcaaataaaaatgtttctaaatttgaataaaagaaagtactgagcccattaacaaaaaaatatgtatatgaaattaagtgttaatttaggactctctgaagaagtaaattgagctgtgtgctgaataacaataatgaaatagtcggtggatgtcagtgataagaatattccagtgcaaaggctcaatgatgggaatgaactcagtatgttcaaagaatagaaaaatggccgatgtagatataatgtagtggacgaagagaagagggtagagagacaggagacagaagttcatgtagagcttttaaagccagcataaagctttgtaatccaatgaatttggatttcattctgagtgatgggtaaccattgaatagttggggcagtaatgtgatctgatttatattgtataaagatcattcttcctgtcatatagagaaagaattttatagggcatggctggaagcagcaagaccagaagtgaaaagtgacaagtttggcccagctttatggcagtgaatatagtagaggacagatgatttgttatattttagaggaagttaagttttctgaacttgttgatagattgaatgttgagagggagaggggtgttttcaaataattgtcaaatctgtcttccttattattcatccattcatttgaatatttaggtgcctactgtgtgctaggcattattctaggtattggagttacatcaatgagtaaagcaaagcccctgccctcatggagattaaattctagtagaagagac

SEQ ID NO: 27275 - DNA, 1032 bp, Homo sapiens
agagtctacgggaaacccaaaataaatgtcagcctttagagcccaccaatctgtcacagaaggcgttttctacttgactttaaagaaaggtggtactcaattgtggatttagggaaactcaggtgattatgaaaagtaaatgagaaaatatatgaagcccctggcatgttttggtgggtggcgcaggaagggggtttttttgttttggatagacaggatctcactgtgttgcccaggctggccttggactcctggcctcaagcaatcctcctgcctcaccctcccaaagcaccaggattacaggcctgagccactgtgcccagcctcgtacttggcgtgttcaaaaaatgttaattcttcgtggagaatgagaatatttgtgattttgttctgtctttaactctttacatatatgtgtgctaggtgttggtcagagtgtttggttgtcaaattcagcctggctggatgtatgtactaggcactcttgtgtcatcactttcatttctcacagtagccctgaaagtgtttaccttaccttccctcctcctgtccccagcccaccattcaggaaaataccactcaatccaccatggcctggtggcctcctacaaaaggttttaccataccacgctgggttgtttccccttgcctttcagagtctgaagcagcagcaatccagagtacatccagcaaacctcagttattcccctcaaaatgttccagcacattcacccagtaactgagaaagtgccctatccaaaggcatagctgagtgacaggccatctgtgataagactcttcccacgcactctgagttcccaaatgttcaccacgaagaacaagtctcttacgacagacctagtatgttccattgaaggcagctattagtctctaaaagactgtaaggaaaacttgaggcaaagccagaattaatacagtatgtacagacagtgggagttaaaggctcacctttccccaccccacccacagcagcagctctggagccaaccatggaattacaaccattaggtg

SEQ ID NO: 27276 - DNA, 1049 bp, Homo sapiens
gatatatcttcattaagttctgctcattgctggagtgagggtggttttctcatgtttaataaagtctctctcaaacatgagcatatgtgaagacactgtaataagtttatagtcttatgagacaaagaacgtggctctttggttctctggaatcaagatctcaggttgaaaagcacagtgtcttaatggcgcatgtgccagcagtatctcttatcccagaggcccagggatagaaaactcgaaatccacccagggaagtgagcagtgggaatttccctcagtgacgcttaagtttcttgtttggaaaaatggttggctagattgagtttggtttacttcctaagacagatggagtaccagaggccctatgtgttggctatccaaacacactggttcctttaattcaaatgacaaatccttattttgccccatttggcagggagattagatatttttaattgcctgccagagtaggtttataatgtgatttgtaactcaagatagattttgtttggaagtttaactaaacgtgaagacctgtgagcaggactgttttgcttggagaaaccttgagttgtccagagttgggtttgagtgtggagcgaggtcttggagagcatcctatgaagatgtgtgcgagccagccatctccgaggcgtaaagccaggacctaatttgtttacagtggtccagagccttgacatgaagccagagcccaccaggaggaggggcagagctcttggggccttgaggaatttcttatgaaaacttagtcttcttgctcagaattattttgggttgtgccactgtctttaagagtgtgagagagaggatattagaaaacaactttagttggtcattttgcagatggatgattatatttagaaggggaaaatctgagcatagcaatgggaaactacagatctagctgtttgtagtactggcctgtttttaagctgtttggctcaagtcagcaatcatttattacgtttcttctaggtggaaggtgtggtgatgtgggcaaaagattcccagtttgaatgcagctt

SEQ ID NO: 27277 - DNA, 1156 bp, Homo sapiens
gattatggtttttagccccattttttccctttttttagaggaagaaactaaggctcaaaacaattaaattgtgaacctagaggcagagtcaaggctagagcccttcttgaggctccaagtctagtgcgtttctgccactctgtgcatccaccctggctccttcctgttaatgctgcatttcagattccccccagcttcagcaaggctgtgtcagtagtgggtgtggtcaggttgaggagcacaaggttggggttggggtgtgggggtcccaagagtgactggaccgtgttatacacagtgggactagtgccaaggagacgaccaagaggagactgttattacattctggaatggcttgacagcctttattcacttgtcttcattcattcaattcgctacatcaacattgtgcatttccctgccaggtttctatcttttcccgcaataagctcattttctctgtgacctctagagtagggtttctcaaccttgactgctgacattttggactggataatttttttgttgtgtgggactgtcttgtgtattgtaggatgttcagcagaagctttggcctctaccttctagatgttcttaatacctccccatccagttgtgacaacaaaaatgtctccagatattgctgaatgtccccaaaagggtggggggagggtggcagaagctcctaggttgagagccatggctctagggcttgtcaagccactgcaaatagagctctagagtgttagaggctggtctaaggataagggggtcataaagagcagggctgggtggagcctgctaggtacttttcattctacccttttgttgttctgctggggaaaccaaggtctagagacttagcccaaggccacctggctctgctttctagaggtctggctagggctgggaacttgacctgaatccctcccactcaggactctgatcaacccatagtccctagtcttttcaggttgaagaaaccttttctaatttcaaaaaatatcaagaatgggtgtatgataatagttgtacttttaatacccgttaattgagaagatcagatattaattcccttcaaccgatattcactatatacccaccgtctttcttccctaggattgtgtctgcgtaaatggtagatggtcacatggta

SEQ ID NO: 27278 - DNA, 1057 bp, Homo sapiens
catcaggaatctggaaaagttaaggcaaaacattaagaaccagtatatatttaatatttatgaaaacattgggttggttacagatagaagcaaatttctgtggtcagaaataaggttggcatggaggaagttttactaagtgtaatagtattcaagaagaatggcgttttacttgtggaagcactctaatacctctgagcctttagtttgccctgttacacctcaccaccggagccatgcatttgtaagatataggaggtggttcaagtgctgtgaatatttgtctacatctgtttctgcagcccagatgctgaccccatgtctattttcaaggtaactttactcatgaagcatgtttaggtgtttctgtgggggaaaattaatcatgtagcctttctctttggagttctaaactagttgagaaacacagacagcagatggatctagataagaaaaatcaacatcctggagagttcactgcgaagaggggaagaggctgtgtgaaccctgcaggcaggaaggggagtcctggggggataccccgggactgtccctcatactgtttgctcaggtcctatccccagtatgagagagcacaccttacagccaggtgcttgcgggaagtccctgttttatgggccaggaggaatgcagtggaaagatgctgccaaatgattgttctagcctgtgtttcagtaagacgtcaattctgtgggtcagaggtgcacgggagataaaatatgggtggatcccccatgaagaaccctggatagaatacatgaaaaccttgtaagacaaatgaaattgcaggttcaatttagtagatactaagcacttactgtgtatcagtcattgtgctggattgctgatctgcaaagatgaataatatcagcattatttcattcggggtggggatgggctcttggtttcctccctggtatatttgcgtatttgcttccagatcatttatttgggggattttagaagtgggaggtggaggtcagaggaagttagggttggcatacaaggagtcactgccagtggaaaatatattgga

SEQ ID NO: 27279 - DNA, 1062 bp, Homo sapiens
tagatttgtgtctcctgaaggttaggtcctttctgctggacctttgtgctttctgacccctgctgtataaccgagaaaacagcgtgcagctcttacctttggctctcaacaccagggttttcatgttttcacactggagttcgatggatgaatcgagttcatttcaaatcagcaaacatttctgagcattcactcgtgtgcccagctctgagccaaataaataggaaggcaaagatatgatcccctctcccagatgctcacagtctagtgcaggacaccagaggtctacatcagtgatgtgcagcagtgatacgttccccagtagaagctgctttaggatatttgaatcacagggtctggaacctggaattcacctccccgcagaccttctcagaggggtgtgtgtctccatgagcattaattaggtaggaggcatgaccgcgggggctgggattcccagggagggcgctcactttgtgtttccttttactaggatgagctcatggcggaattagaagaactagaacaggaggaactagacaagaatttgctggaaatcagtggacccgaaacagtccctctaccaaatgttccctctatagccctaccatcaaaacccggtgagtgcttctagagtcatggcacaccgtgaggtcatgtggcaggtgatcttgtggtcggttggctttggtttgtggtcggttggctttggtttgtggtcggttggctttggtctgtgtcctgagcttgcccaagattgagaaccagacaggatccattgtagtggccacagaggccatgtcacctggctttttctggtttctctctggaacagtgtttcttaatcttgacgctgtggacatggccagatacctctctgggccgagagatggagggtgggggcggggttgtccggtgcactgtggatgttcagcaccatccctggcctctgctagatgccagtagcaaccgccatgagttatgtcaaccaaaaatgtcttcagacatggccaaatgtcccttggtaggggttgggaggatcacccccagttgagagcctct

SEQ ID NO: 27280 - DNA, 1098 bp, Homo sapiens
tgtgaccctttgtagaggcccctccctgaccattttatctaaaatagacttcacccttaccttttgtcattctttatttccttaccttgctttgcttcccttccctccctctccctttccctccccttccctccccttcctccccccctttttttgagatggattctcactcttgtcacccaggctgtagtgcagtggcacgatctcgctcactggaacctccgcctcccaggttcaagcgattctcctgcttcagcctcccaagtagctggggttacaggcgcccaccaccatgcctggctaatttttttttttttttttttttgtatttttagtagagacagggtttcaccatgttggccgggctcgtcttgaactcctgacttcaggtgatccatccccctcggcctcccaaagtgctgagattacaggcatgagccaccgcgccaggcgtgccttatttttctttatggcacttagcactacttgaaattatatactgtaaataattgacctgtcttttgctaggatgcaaaatgtgtgagggcaggaattttgaatgcctgctgcctgttctgagcagcacccctaatggacttctctctctattgtaggtgagccctattcccagaggcaggtggtgctgaccctgtaacccaaaggaggaaacagctggctaagctcatcattgttactggtgagtgaggttgcctgggaaagctctgggcaagcttgggccaacatggagggtaactcgtttggggattgtttttacctttagtacagataacttacaagtgattatcttcctactccatgtctaaaagattggatgttgcacaggtaaccttctgaactgggagggttgagactgctctcctagaattgccacaagaatgtctgagatcatttgccatgaataaggcagagcaggtctgcttccttcttgcttctgctagctgctttctgctgggatgtggcaggtggggggctatcctgggacctggcggctatacctgtcctctcacaagctctttaacatgacctcacagcccttagagacttgttttttgagatggagtttcgctcttgttgccc

SEQ ID NO: 27281 - DNA, 1084 bp, Homo sapiens
ttttttcactctgttggccaggctgatctcgaactcctgacctcaggtgatccgcctgcctcggcctcccaaagtgctgggattacaggtgtgagccaccacatccagcccaaaaatatcacctttaaatttgcaagtttatatggtagattgttcaaagcacatctgatcacaacacaatcccgtgacatagaggttcttttccatgtatcatatgaggacgttaaggttcagaaaagagatggtgacttgtccagggtttgacggcaaattagtgatagacccttttcacaagtgcctagtgcaaggccaacatttagtagatgttcaataattttttttttttttttttttttttttttttttgagacaaggcctcgctgtgtcacccaggctatagtgcaatggcacagtcatggctcactgcaggtccaaccttctgggctcaagcagtcctcccacctcagcctcccaagtaactgggactataaacatgtaccaccatgcccggctaatttttaattgtttttagagacaggctcccactatattgcccagactggtcttgaactcctgagctcaagcagtcctcctgctttggcctcccaaagtattaggattacaggcgtgagccaccatgcctagccaagaaatatttattaattgaaaattttagtacattctcagggattaacttatggtctcctaactctttgcccagtattctttccattaagatagcttggtggggccagtggttgggcttcatctcagggtgaccagataataaagagagggagggctgaatctctgtcactattgatattgctgacaaggatggcattttctggcctttgctgctgtccttatacatactacccactacagaaagcccagattcagtagtctctgggctgcagactcaagcttttgttgcctttgctccctgtagtatactgaacaatgatgccagtgacccccagcttctcactctgccttctcctttattttctttctcatcagtgtcttacatctccttctattctgctgatggatgaggaatttgagctcatctcacaaacat

SEQ ID NO: 27282 - DNA, 1050 bp, Homo sapiens
gtgacagactgacctgtgttcgaatgctcattactagtaagttaatgaacttgtcaatcagtttctggtaaaatatgagtaatcatgacattaacttgtgggatcttgggattattcagtattgtataccacccttagccacagcgagtgcctggtgaggctttgtgttagtccattcttgcactgttataaagaaatacctgagactgggtaatttataatgaaaagtttaattggttcacagttctgcaggccgtacaggcttctgcttcttgggaggcctcaggaaatttacaatcatagtggaaggcgacggggaagtagacacgtcttcatatggccagggcaggaggaaaagagacagtgggaggtgctacacacgtctaaacaccagatctcacgagcagtcactcactatcatgagagcagcaccaagggggaaatgcatgatttcagtcaccatgatccagtcacctcccaccaggccccacctccagcactggggattacaattagacatgagatttgggcggggacacaaattcaaaccattatcgggcttagctagcatacccttttcaaaatggttggtagcaattcagacaggtctgtgtctggatcagactaagcagttttcttttcttttcttttttttttttagacagagtctggctctgtcgcccaggctggagtgcagtggcttactgcaacctccacctcctgggttcaagcaattttcctgcctcagcctcccgagtagctgggattacaggtacccgccaccacgcctggctaattttttgtatttttagtagagacggggtttcgccatgttggccaggctggtttcgaactcctgaccttaggtgatgcacccgtctcggcctccaaagtgctgggattacagttgtgagccaccatgcccggcccctgcaattttcatcatatggtggtggtctagagtaaacatcacttgcaaataccatgtgaccatggttctacattgaagatcttcaaatttagatcctgaatgggataacatttgagatg

SEQ ID NO: 27283 - DNA, 1027 bp, Homo sapiens
agggccgggcgcggtggctcatgcctgtaatcccagcattttgggaggctgaagcgggcagatcacgaggtcaggagatcgagatcatcctggccaacgtggtgaaacccccatctctactaaaatacaaaaaattagctgggtgtggtggcatgcacctgtagtaccagctacttgggaggctgaggcaggagaaccacttgaacctgggaggcggaggttgcagtgagctgagattgtgccactgcactccagcctggcaacaagaatgagactctgtctcaaaagaaaaaaaaaaaaaaattcgtgttagtactgataggaaatagtcatctgttttgttgttttgccactttctttcttgttgcctaagtctctgttttgggttttggacattggtttcctttataagaattaagacaaaagtatgtaaggtttttttttttgtatttatagtacttagccaaattctgggctcataataagcactcagtaaaggcatgttgacttttatggctgtaaatgatactggctttgagtcaatataaattagttagggggttcacagaattgaattgcagcattctctggttgggaggttggctttcagctaaaaacgttaagttggaaactatcctcacaactagaagcagttaaccagaagctgttcctgcctctatcctcctccagtctagcagtgtactgtccttgaaaaactgctgccagctcagcttttttgcttcttttcagaactgactatatccagatccttggtgtgcgttttcttttcctgtccctaggagtctccaagttgcagggactatcattatggtgacccttataggctggtgtatttatatggccatcctcattttgccagatagccgtcatactcagattggtgtcttcccataatacgtatgaatcattttccctcagttctttcttttgtcctgtctgctccattaaaaattgtctatcccatgaaatttttaaaagagactttgtgcttttagagtcgcaaggt

SEQ ID NO: 27284 - DNA, 1010 bp, Homo sapiens
gtgttctaattttttagtatatgtgctgctgaagcaaacacacagattatttttttctgttcttaagttttttggaggaaagctatttactataggtcttaattaaaaactatattctgtatatattgaaatgtgcagaaccctgctgctgctgtttttcgttacccagaatgttgcttacatctctctactatcatcttctctccctttgttttagcccttggggtttatgtttttttattcctttatttcatttttttctgaggttttggaagggaatggagaatggggtgtgttcattctgcctggctggttgattttatatagaaattgatgttttcatctctaagggacaaagaaaattaggaaaatatcctagttttatttttattgtggtaaaatacacattacatacagtttaccattttaaatattgttaagtcttcagttcagtgacattaagtacatttaccttgttatgtgaccattaccactatcggtctctagaactttttcatcatccagaactgaaacttgtacctattaaacaataattatccatttcacctcctccctgctctggtaactactattctgttttctgtctctgtgaatttagctattctaggcacctcatcgtaaaagtggagtcatacaatatttgtcctttttttttttttttttttagacggagtctcgctctgtcacccaggctggagtgcagtagtgcgatcttgactcactgcaacctccgcctcctgggttcaccccattctcctgcctcagcctcccaagtagctgggagtacaggcacccgccaccactcccggctaatttctttttgtgtttttagtagagacagggtttcactgtgttagccaggatggtctcaatctcctgacctcgtgatctgcctgccttggcctcccaaagtgctgggattacaggcgtgaaccactgcacccggcccccccccccctttttttttgagacagagtctcgctctgtca

SEQ ID NO: 27285 - DNA, 1080 bp, Homo sapiens
gctggtcttgaactcctgaccacaagtgatccacctgccttggcctcccaaagtgctgggattataggtgtgagccaccacgctcagccaataattctttttattattactattattattattattattattattattattttgagacagagtcttgccttgtagctcaggctggagtgcactggcatgatctctgttcactgaaacctctgcctcctggcttcaagcaattctcctgccttagcctcctgagtagctgggattacaggcacgcaccgccacgcctggctaatttttgtatttttagtagaaacggagtttcaccatgttggtcaggctggtctcaaactcctgaccttgtgatccgcctgcctcggcctcccaaaatgctgatattacagccatgagccaccgcgcccagtccttttttaaattttttttcagacagggtcctactttgttgctcagccgggaatgcagtggcatgatcatggctcactatagtcttgacctctcgggctctggcgatgctcctgtgtcagtctcctgagtagctgggaccacaggtgcataccaccatgcctgggtagtttatttttattttttgtagagatagtgtcttgctatgttgcccaggctggtgttgaactcctggtctcaagcgaccctcctaccttgacctcccaaggtattgggggtgggattacaggcgtgagccaccatgccagtcttgggcttgatagatttttttttttttttttttttgagacagagttttgctcttgttgctcaggctggagtgcaatggtgcaatcttggctcactgcaacctccgcctccttggttcaagcaattctcctgcctcagcctctcgagtagctgggattacaggtatgcgccaccacgcccagctaattttgtattatcagtagagacagggtttctccatgttagtcaggctggtctcgaactcctgacctcaggtgatctgcctgcctcggcttcccaaagtgctgggattacaggcatgagccactgtcactgtgcctggctgatatatatatgtgtgtatttattatt

SEQ ID NO: 27286 - DNA, 1112 bp, Homo sapiens
tgcagtggtgtgatctcagctcatggcagtctctgcctcctgggatcaagcaattctcagcttccaagtagctgggatcacaggtgcctgccaccacacctggctaaggtcctttgtgattattagcagagaatgggatctaaaaatgttcctgtgttccttctagctagtctttgctactgtgcccctagataatgggatctagtttttcacttgagtagtgtttttgggaacatgacagagtagccctgtccaagggagacatactactcggtatgtatttctaatttaccacacatgcttctgtattttatagtaagattgtttgagagtttgacttcattagggtttagttctctgaataccactatatactttagctctttgaactctggactttctgtcacaagcagtttttctccttagtttttttgtgtcttctgaaatgtcattttggtggattcttttaagaaaatatagggctatattaaattacttaaaggttttctaagtcacaatagatgtggcctgtaaaaatatctgattatgttgggtgtgttatttctgaaaataaaccaagcaaatttcacaatatcctgtttaataatttctctataaataagatacatatttaaaataaggctataaatgtttgttgcttaagagacaagatattactgaaattatcttctgaagtatgtctatccctttccacatttttgtttccactgccttttcagtaagatgttaaggttaattttacctctggcagtgttttagcaccttctttctatattgggcattctatctgtcacatttttctagtgtagtagtaaacattactcaaaataaatgatttataggccgggtgtgatggctcatgcctgtaatctcagcactttgggaggccgaggcgggcagatcacctgaggtcaggcattcgagaccagcctggccaacatggcaaaaccccatctctactaaagatacaaaaaaaattagccagatgtcatgcatgcctgtaatcccagctactagggaggctgaggcaggagaattgcttgaacccaggaagcagaggttgcagcgaggggagattgcgcccctgcact

SEQ ID NO: 27287 - DNA, 1050 bp, Homo sapiens
cgctccagaacaccccagcttgggtgacagagtgagaatctttctcaaaaaataaataagtaaataaagttgcttgggacatgttatatagatgctatttaaagctatctggataggtaatatcctccagtttataatcatctgtaccccattgcgtgatggggtgatcattttgtgatccaccccaccccaactcatgcatgctaacagttatgtatgccttttctccaatttatctgcctgcgttttgtcagacgattttcagcgaaccttcactgggcaaaggggaagtcttcttttggcccctgtattactaacaagcattgacttctaaatgggtaatttggtcaggtgtggtggctcacgctgtaatccagcactttgggaagtcagggtgggaggatcacttgagcccaggagtttgaaaccagcctgggcaatatagtgagatcctgtctctaccaaaaattaaaaaaattaggcgagcatggtggcacccacttatagtcttacctactggggactgggtaatatcctcaagggaatgagtgtagatagaatagggaaccaagaactaagatctaggatatgttagcgttaagataatggagaaaaggaatcatcagaggatactgagaaggaacaatctgtgtggtaggacacaaacctggagaatatatcttgggaactgaagggaagaaagtaaaacatggaggaggggatgaacagccatgtcagattttgccaataagttaggtaggataaagactagaattgaaaattgtgtttagtaatgtaaaggcctttgttacatggtcttcagtaataaatagccaggttagcactatttatatatgtttttaatgggaatttttgatgtttacagtgtctcctttgccatgttcaggttttccaacctattggtggtatgtctgacagtggatcacaacttggttcaatgggtagcctcaccatgaaatcacagcttcagatcactggtaagttttagaaacatcggctgctttactttatttttccccgtatgattaa

SEQ ID NO: 27288 - DNA, 1038 bp, Homo sapiens
ttttgaatcagctcttcgtttcttcttatcatttagccagggtctttaccttggatgtaagtctgttttcttatgtccttccctgtctttatttacctgtttcccatttaattatgcctatatataacctcagctattatactgaactcatctgtgtcttctttttttcttttttttgaccgggaaatttttttttaaattacaagctcaacccatttgttctgtttcaaaggtgcagtacttttcttcatttattagtgaaagaagttaagaaattaactttccaaaaaaatcagcaaatggcaagcaaatgtccttgaaagtcacagtcacatatagtgtctcctagaaaagaggaggggtaagacagcttccacctactttcacaagtttcatcaaatactggatctactcaagggtggagtaaaaaggcaactaactttctaaaaggagtatgttattaaatgaggcatttactatactccttcctaaaagccccagatggggaacatgttttctcaactagacctaggaagtagactgtggaatcaatcggtcctcctcaccttaagggccatccactggttaatgaattaaaaaaaaaaaaaagactgaaaaacaaacctcccccctaaaaaagaggagggggaaaaaaaaccactaagatgtcccagagtggaatcagggagcagcttcaacaattccaattagtctgttacagagtcatccacaagcatgccttgctttaaaaatacatatatatatcttgaaataacaaaactgaaactagtactaatcacttttctgacaatatacaattactcaaaattaactagtactgggctagggatacgggggggcggcgcatagctatgggccttgtctcacatgagtacatgtgggtaggtgcagtgcgtttgtcattatggcaaaaacgaattttaatttttaagctttagtttgacttaaacattgcttttagtatgatgccaacaccagctatgcagaaagggctctggagagatgttcctagcagca

SEQ ID NO: 27289 - DNA, 1051 bp, Homo sapiens
tagaggaattggagggaagaaggaattctaaatggaaagaagaaaaacaaaggtggtgagaaacacaggttgttttgtaggaaatctttaatcataatatttggctaaaggtgcagtaatttcaagggagaaatggcatttggtgattagaaagtagaatcagtcaatatatatttatttgcctttatatgatagacactatgctcaacatgtctattcttccttcagttagtccttaaacgtttatgagttaggtactattgtctcatttttataggtgatgagaaaacaagcttagaaagggaaaggaacttgcttgagttaatagcgttaagtgggacagttgaacctggaacagccttaccttcagagcctgagctcgtaactatcatgctttactgccacctgaagttgggatgatatacaagtaagtgcttagccattaataaatgttatttttattgttagataggttgggaccagatggaggtttgcaagtaaagacttacggaattttttttttttaaaggaaaggaatgtcttttaaaataatttgattttgttctgttttgttttgttttaagactgagttttgctctgtcgcccagatgggaatgcagtgacgcgatctcggctcactgcaacctctgcctcctgggttcaagcagttttcctgcctcagcctccgagtagctgggattacatgcgtgcaccactagacttggctaattttttgtatttttagtagagatggggtttcaccatgttggccaggcttgtgtcgaactcctgacctcaggtgatcttcttggccttcttggcctcccaaagtgctgggattacaggcgtgagtcaccacgcccagcctaaaatatttgaacaggagattgtatgatcagaactctgtaggaaaaaatattttgacagtggtatatagtttggattatgtggtggtgagtgaaggttgaaagtcctatatggaaatttgttacaataatctattgagaggtaacgaaggctagaactgaggcaatgatggtggaagagtaga

SEQ ID NO: 27290 - DNA, 1048 bp, Homo sapiens
gctctgatatagtaggtctagaatagttttgaagattgtgcatttctgacaagctcctgtatagtgctcgtccgtttggtttaaagaccacactttgaatagaaaggccctaaaggatttctgtggtacacagtttgaaaatgtcttttaaaatatgaggactggtacgcagtggctcgtgcctgtaattgtagcactttgggaggccaaggagggaggattgcttgaggtcaggagttcaagaccagcctgggcaacatggcgaaaccctgtctctacgaaatacacaaaagaattagctgcgcgtggtggcaggtgcctgtagtcctacctactcgggaggctgaggcatgagaactgctagaacctggtaggtgaaggttgcagtgagccgagatcacaccactgcactccagcctgggcgatggaatgagacgctgtctcaaaaaaaaaaggaaaaagaaaaaaactatgtgaggagagagagatgttaattagcttgactgtagtactttttttcactatgtatatcaaaacatcatgttatactgtttttattaaaaataaatcattgcaatacatgttttacagaaaaaaaatttaatacatggtactgcctctctgtttctttgtttgtttgagacagggtctcactctgtctcccaggttggagtgcagtggcgcaagctcagctcactgcaacctccacttcccagactcaaacaatcctcccacctcagcctcctgagtagcttcgactacaggcgtgccctgccatgcccagctactttttaaatttttttgtacagacagggccttgtcatgttgcccaggctgatctgtcactcctgcgcttaagtgatcctttcacctcagcttcccaaagtgctgcaattacaagcgtgagccacagcacccggcctctgttagttgaatctattagattttattttgttcaggcttattctgaaattcctaggagtatgggttagtactgtgtagtggtttggaggtagtacataccagagccttggctgagacatctgca

SEQ ID NO: 27291 - DNA, 1050 bp, Homo sapiens
gaccagcctgggcagcatagtgagaccccatcactatagaaagaaaaagaaattagctgggcatggtggcatgtacctgtagtcctagttaatcaggagtctgaagtgggaggatctgttgagcccaggagttcaagattacagtgagctgtgatcatgccactgtactcctgggcaacagagccagcccctgtcatcctccctgcatctgcccaccataattatgtattaatacatacccttcataatcctctctgtgaaatttatcctaaagaaacaattcaaaggaagaaacagtttgctacattaagaatattcattattttattatttatataacatcagaatattggaaaccaccctaaataaccaagcaggtagaaatcgtgaagtcattcgattcatttatgaattatgttcataatcaacacaatcaattctttcaaatgttttatttagaacatttgtatcaatgtttacttacatattttgtacccatttaaaatgataggaagtgggctgggcgtggtggttcacgcctgtaatcccagcactttgggaggccgaggtgggcggatcacctgaggtcgggagttcgagggccgcctgaccaacatggagaaaccctgtctctactaaaaatacaaaattagccaagtgtgatgacgcatgcctgtaatcacagctactcaggaggctgaggcaggagaatcgcttgaacctgagaggcagaggttgcggtgagccaagatcgcgccattgcactccatccagtctgggcaacaagagggaaactctgtctccaaaaaaaaaagataggaagttagttgtgttcttgcgaaaaattgtgtgtgtgtgttttgttttgttttttcgagatggagactcactctgttgcccaggctggagtgtattggcatgatctcggctcactgcagcccccacctcataggttcaagcagttctcctgctcagcgtcccgcgtagctgggactacagatctgcgccaccacacctggctaattttttgtatttttagtagagatgggg

SEQ ID NO: 27292 - DNA, 1029 bp, Homo sapiens
acccaaaagttagggttagggttagggttaggatgacttttgtatctattgctggattaaatattaattctgtatttaattttttgaagaaccaccatactgtttttcagtgtctgtgccagtttacatttccaccctagtgcagaagaattccaatttctgtacgttctcatcaactcttctgttttttttttcttcatcatcatcatatttttttttaaatagtcatccttaatgtcgtatttcattgtggtttttctttgtatttttctaatggtttgtgatgttgagtatcttttcatatgcttcttggctatttgtgtatcttctttggaaaaatgtctcttcaagtcctttgcccatttgttgttgttttttttttcttttgcgattgagttttaggtgttctctatatattctgggtgttaatcccttatcaaatacatgatttgcaattattttctcccattctgtggtttcctttttactgtagatagtgccctttgatgtataaaacattttagattttgatgtctgatttgtcaattttttcttttcttttcttttttgagacagtctctctctctgtcacccaggctggagtgcagtggcacaatctcggctcactgcaagctatgcctcccgggttcacgccattctcctgcctcagcctccgaagtagctgggcctacaggcgcccgccaccatgcccagctaatttttttttttttttttgtattttgtttaatagagacggggtttcaccacattagccaggatggtcttgatctcctgacctcgtgatccacccacctcagtctcccaaagtgctgggattacaggcgtgagccaccgtgcccggcctgttttttctttttttttttttctttctttctttcttttttttttttgagacggagcttcactctttttgcccactctttttgcccaggagtgcaatggtgcgatctcggctcaccacaacttctgcctcctgggttcaagctattctcctgcttcagcctcccg

SEQ ID NO: 27293 - DNA, 1047 bp, Homo sapiens
aggcatgagccaccgcgcctggcctgagagttctttaattttagctcttacatttagatcttttatccattttaagttaaattttgtatatggtgttgggtaagggtccaacttcatctttttgaatgtgaatgtccaattttcccaagcaccatttgttgaaaagactgtcctttccccattgcatgactgtggcaccattgtcaatagcattttaccatatatgcaagggattatttctgggctgtttattctgttggtctgtatgtctgatttgccaataccacgctatagctttgtagcaagttttcaaatcaggaaggtatgtgtcctccaactttgttctttttttcaagctgcttttgactattcagggtcctttgagattccatatgaattttaggatggatttttttatttctgaaaaaaagaagtcatttggattttgataggggattttattgaatgtacagaatcaataaaatccatattgatcaatacagattcaatatctgtatcaatctggggtagtgtggtcatcttaacaatattaagtcttccaatccatgaatgtggatatctttgtgttttctttgatttctttcagcagtgttttgtggttttcagtgtacgagtcttttgccttcttgattaattcctaagtattttttattctttgtgatgctattgtaaatggaattgttatcttaattttctttttatattgtttattcttagtatatagaaatggaactattttgtgttgactttgtatgctgctactttcctgaattcacttactctggcagggtttttcgttgtggaatatttagtgttttcttcgtaaaagatcttagcttctgaaaacagataagttttcttcttcccaatttgggtatcttttatttatttatttatttttcttgcttaattcctctggctagagcttctggatactatgttgactacaagtggtgaaaataggcattcttatattgttcctcatcttaaagaaaaaacttctaaccattgaatgtgatgtttgct

SEQ ID NO: 27294 - DNA, 1042 bp, Homo sapiens
tccaaagtgctgggattacaggtataagtcaccgtgcccagccagggaagtgtttttttgagacaaagtttcacttttgttgcccaggctagagtgcaatggcgtgatctcggcccaccacaacctctgcctcccaggttcgagcaattctcctgcctcagcctcccgagtagctgggattacaaacaagcatgtgccaccatgtccggctaatttttgtgtttttagtagagatggggtttctccatgttggtcagtctggtctcgaactcctgacctcaggtgatccacccacctcggcctcccagattgctgggattacaggcgtgagccaccatgcctgacccagggaagtgtttttaaatgaagagtacatctaatatattgaaataaaatgattattgtacagttattttaagcggtcttgtttccttttttcataggctctgttccatgggaaattcatagacacgggtttttctttaccattctataagcgtatcttgaacaaaccagttggactcaaggatttagaatctattgatccagaattttacaattctctcatctgggttaagtaagtttctttttccatgtaatttattaaaatatagttatatgcattccgtgtagtattgataacttatccaaactgtaggcacataattggtttattgtatttaaatgatctatatatcaaacctgtctttttattcaatatgataaattttacaaaaatacacccaagatcttcggcaataatatgaccttagaacagaatcttatttcttcttattttgatgttatagcttaatattaattatttaagaacatgggcctttcgttaaaaacttataaattatgattgaattggtggatataacaaatagtgctaatttcatttgtgcagggaaaacaatattgaggaatgtgatttggaaatgtacttctccgttgacaaagaaattctaggtgaaattaagagtcatgatctgaaacctaatggtggcaatattcttgtaacagaagaaaataaagagga

SEQ ID NO: 27295 - DNA, 1035 bp, Homo sapiens
agaagggacccaggtggtgggtcctagggcaaggaagttataatttggtcctgtgtatagactggtaagccttctgaggctaaatatgtctcagaagattaatgatatctgggcttccatttctgttgcagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactggtaaaaatatctatcttatacttggtggcagataaaaacactcatttgatacttacaacaacccagtagagtaagcaaagtgtcatcaacttaatgcctcaggtgaggaaaaatacctcaaggaagctacatgacttccttcagatcacataactagtatgtgacagagctgacattcaaagccaagtgtcctgacttctagtctagtgttcttggctttgtagttgaagagggagaaagggcattggcaaatggaagagaacaagactgagtagctttcttcctcattcttgctttggaagacaaatagtattgggtttttcaccaccactactaccactaccattatcattatcttttacagagctgtgtgccagaaactatgcttaagtgcttaacaaatactatctcctttgatgcttataataattatgaaagcactatttgttttcctcattttacataggtgaaaactgaaattctgagaagtcaagtgacatatctgaagtgaaacaactagctagaagcaaggctgagattcaaacctaggcagtataattacagagcttacacacaaccatgacactctattattcctctaattccttaccttggcctctcaacaggtttgtaaaataggaattcttagtttcattttataggtgaacaaatgaagcattgaagggttatgtagtgaataaggtcata

SEQ ID NO: 27296 - DNA, 1053 bp, Homo sapiens
agctgtctgatcttgggcaagttacttaacctctttgagcctcagttttctcaactgttaaacgtggataaaaatagcttttatctcatggagttgtcagttttgtaagattgaataggataaaaaaaaacatgtcaaattcctggcacattgaatgcacttaaatattagccaccacaattatttatattggaacagtgagaagaccaagcatgtttagagtaaaaggtttatgcagggaacaatttattcattcaataaatgcttactaagaacttattaagtgccaggcactattctaaacaaagttcttgccctcatggaggttatagtccagcttgaggagacagacaataaacatagaaaccagtaagtatatgacaggtagtgatgagtactatagaaaaatatagagcagagtcaggggaaagggaagtgacagtgcagagtgggagctgataaggaaagaaccttttgataaatatgacatttgagcagagatctgaaggaaagtatggagtgtgccacgcagatagttggggtagggaggggaaatgttccaggtaggtggagaacaaatgtgctgctgcctggtgtgtttgaagactagctaggaagttagtgtagctaaaatgtgtgagctagggaagagagagtagtattgacaccagcaggatattagatcatgtcacatcttgaaagccaatgtagactctggccttttattcatggtaaaatgggaaaccactagacaatcttttttttttttttttgagacagagtctcgctctgttgcccaggctggaatgcagtggtacgatctcggctcactgcacccgccatcatgcctggctaatttttatatttttgtattttattttatttttttttgagatggagtctcgctctgttgcccaggctggagtgcagtggcacaatcttcgctcactgcaagctctgcctcctgggttcacaccattctcctgcctcagcttcccgagcagctggtactacaggcgcccgccaccatgcccggctaattttttgtatttt

SEQ ID NO: 27297 - DNA, 1077 bp, Homo sapiens
aggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaacgcaatgactggctcacacctgtaatcccaacactttgggaggcagaggcaggaggattgcttgagctcaggggtttgagaccagcctagacaacatagtgagaccctgtctctacaaaaaaaaatagaaaaaattagctgggcatggtggtgtgggcctgtagttccagttactcaagaggctgaggtaagaggattgcttgagcccagaaggttgaggctgcactgagccatgatcgtgccaccacactgcagcctggcaacagaccaagaaaaaaaaaaaaagatagtgtatgtatagtcagtaaatacagcagtggcttctgatctccagacctctcatttgcattgattctttaaaatcatctctaccttaatgttctgtagacatttcaaaatcaacatgttcaaaatcaaatttattatctatctccccaaatctgctctctctacttctgatgtttactgttcattaatggataacagaataaccatcaaatcatgtaagtggagagaactcagtgttaacctttatttactccctcttatttatccccatctaccaactacagtatctataaaacacattcactcctttctaccccattgcttttgttcaagatatcataattcctctctttctttgtggtaaacatgaaggtgtaccatccagttctacctccaaagaaagacttcctgttggccgggcatgatggttcacgcttgtaatcgcagcactttgggaggccgaggtggggggatcacctgaggtcaggagttggagaccagcctggccaacatggcgaaaccctgtctctactaaaaatacaaaaattagccgggcgcggtgatgcacgcttgtaatcccagctactagcaggggctgaggcaggagaatctcttgaacccaagaggcagaggttgcaatgagctgagatctcgc

SEQ ID NO: 27298 - DNA, 1045 bp, Homo sapiens
cgcagggaccaatcccccagaggtgggaaaatgtggaggagccaaacctggatgagctgctggtccgattggaggaggagcaacagaggtgatggaccccaaactttctgacctgggtgattggccagttggtggagaaggctgatgggaaacttctgccctgagggctaatgtggacttcagccatagccctctaattcctgcaatggaaaatttcagtggttgccatcttactcccaggaggtccaagggttggactagacctttattttgcacccacttttacccctccccagtgcaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggaggtaggaagaacggggactggaactgtgagaggaagcctgtgtattctggatgctgccctggtcagtactggaaggagttaacttcaggacttggatgaaaactgagctgttgctgttaaagtccctgaccatccttacctgcgcatgctggcagcctcagccttcttgggccttcagcttagacctgccactacccgcctagtctaggttctgctgggaggtagcatgacactcagagcaactctgttcctgcagcagtgacgagcttaggtttttgatggatctgaaagcttactgattcctggtctggaggtcttgcatatctagatgctaaggaggtagatatgaaactgaatgggaaagaaagagctgttatgggccctggggaattttcaggtcccagctgaaggaaacaaatgtttcctgcatttttgctttgtgctcagtggtttatgtatatcattgactcctccttagaaaagtctgtggtaatagatcccatttgttaagcagctaccgtgtatccttttctaatctggcccagaggaaggcgatataccatcctaggccctctgacc

SEQ ID NO: 27299 - DNA, 1049 bp, Homo sapiens
ctgcctagatttccagtctctgaggttcgggtgcttaaagtcttgtggggatgagttttgtgtgtttgaagaccagaaccctaagagatagctaagcattcacgtttagcactacctgatgggacaggccctctttcctgtttctagctgcagttctcaggctggaggctagattctggtattcaatatctcaatcgtttcttctttcatttcctcatttattgttacctcagacagtgttctagccttgttgttagtcctagacttgggtgaccaaaggtggagagttgaaggaaccagacttttatgctcagatactcccctccttcccccaggggagaggacctgagaaggaaaacatcaggtttgtccaggctatagggttaagtccctctatagactctaggctttggtcagtagggtggtgaccttgctgtattgggtttcaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggtaggaaccctcagcattccacctcagtcacaggggtttgtgtctaaactggtttgtgcctcaggtacctccctagcctggactatccctttcacttttttgaccagtcatgaggtgttctgtcaatatcccagagtaaatctgcctatgtctgctgaattgtgcttgtgagtagcaggcacatcctccacgccaatggcatgcttcactttgtgtacaatctttgcataacagtatgcaaagattgggaaccagagccctgggagattattgggtcaacgttctccaactctgagagtcttaggcacacttaccactcccccatgccactgtacatttggagatgacgaactctaagaatctagagccacagaagcccaatgacctctgatggcctgtcttcttgaatagttgcatctcccttctcagctttcttttgtt

SEQ ID NO: 27300 - DNA, 1023 bp, Homo sapiens
aagtggcttttcatcttgtcttctagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatc

SEQ ID NO: 27301 - DNA, 1031 bp, Homo sapiens
cctgagcccttgggcccacttcccagcctaccgcttccgtccccgcccgactcttgggccagcgcctgggcccacactttcctatcccccgcagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggtgaggggcgcgggcggtgatctctgggcaggacaaccagaccttccggccctgccccattcggcctggagcctgaacacagcctccttctttcgacttccctctctgtcccctcgcgagccagactcattccaaaccaccttcaatctgtaaagtcaggttggaagcgtcagtgcttaagaatttgagctttagagtcaaaatgctttctggcccttttcttactggttcggtgactttaggcaagttggagactgggtttccttaagtgtagaatgaagacagtagcatctaacttatagagttgtaaaaattcgatcagcacactttgcacagcatctggcacatattaagtgctcagtaactagttactactgttgcttttatttttttttccaattgcgcataaggaaagaaactcgttcagcggttttactattctggatacaggatacagagataaagcagttaaactttacactctaaaggtcattttcacatttagaggctgttattgccatatccctagattgtaaattatcatttacagagcacttactctatgttaagcactgtgctaaatactgtagttttcaaaatcctgtaaataatgttgagatgcccattttacacttgacactatgtgtaaattgtagagctgactcttgaacccccaccttactccaaaatcattaacaccaagaaactaaaagacagatgtctttattgggtcttaaactgcaggcaacaccagtcaaaaaagctggtttctctatgtattttacactgcatctgctgcctcccac

SEQ ID NO: 27302 - DNA, 1055 bp, Homo sapiens
ttttcttttttttttcttctctttttgagacattctcactctgttctccaggctggaatgcagtgacatcatctcagagctgactgcaacctctgcctcctggattcaagcaattctcctgcctcagcctcccgagtagctaggattacaggcggatgccaccatgcccggctaatttttgtatttttggaagagatgggttttcaccatattcgccaagctagtcttgaactcctgacctcaagtgatccactctcctcggcctcccaaagtgctaggattacaggccactgtgcctggccaagaggtcacttttcatgtccaggctgcatggtatgtggtggtgaggatgtaggatttggaggtggaatgcctgagtttgagtgcctgtatttgccactctcttggggccaaatgtaatttgggcatatggcttaaacctcttgaacctttcattgtgttatgcacattggaggcagaactttccagcctagcaagttacttaacctatatgagcctgtttcctcacccaagtattatcataactgtctgacatcagtcattggaaatatcagtaaatgttaccctttccctccatttcctaatctgtaaaggaaattaaagaaacctggtttggctgggcacagtggctcatgcctgtaatcccagcactctgggaggccaaggcaggaggactgcttgaagccaggagtttgagaccagtcctggccacagagtgaaacctcatctctataacacagaaaaaaaaaaaattagtttggcatggtggtgcacgccttgtagtcccagctccttgggaagctgaggtggaaggattgcttgaacccaggagttcaaggctgcagtgagctatgatcctgccactgtactccagtgtgggtgacagtgagagcctgtgtttaaaaataaaaaaaagaaaagaaaaagaaaacatagtttatagagttttcctggcttgaagatttatgaggagttgagtatatgttaccattattacttttgttttattcctctcagaaaatgtgtgtaaaatt

SEQ ID NO: 27303 - DNA, 1087 bp, Homo sapiens
gggtgtggtggcatgcgcctgtagtcccagctactcaggaggcctaggctccagaattgcttgaacctgggaggtggaggatacggtgagctgagatggcaccactgcactcagcctgggtaaaagagtatgactctgtctcaaaaaataaataaataaacagacctcgtacagccttccaaaagtagcaccaagtattaatatctcaacttttgtttgcttcgtttttaattttttttgtttttaagagacgagcgtttgctatgtttctcaggctggtcttgaactcctgggctcaaagaaacaacttggctctgccttccaagtagctggggctataggcatacattactgtgcctggcatttgtttgcttcctttgtaactctttaaatttcattgcaattacagtttgcagttatttatcagtttgctggctaaatttttgtgtttccccggtagactgaagggttcttgagggcaggagctgtgtctcttttggtcttgattgtttccttaaatagtcgctgagcaaatatttgttgaataatgcatcagcagatgactgaatttaactgtgaaagcagttgtttttttgtagttctgaggggtggcccttggcccttgtaggtgagtggtaagcagtgttgagggagggtcttcttagttccagaaaccacaggaagctgcacgatggaggaataggaaccagtggaagacacacctgtgttagaatgaggacaccaacagggtttcatggagctttgtgttttgaataatgcctgtttttttatgtgtagtgaatgatgctacactctgggtggactttgcctaagtttcataaatatttaattggctttttcaggagaataaaggcagccccgttgatgactgaaaatgacaaagcatccacctaacagacgaggaatcagctttgaagtgggagcccagttggaagcccgggaccgtttaaaaaactggtacttttacatttttctgttaattaaagcccttcagtaaaggatttttgccagcactgatagagtggtagcttaggctttttttgtggtgtttttctacttcctgact

SEQ ID NO: 27304 - DNA, 1060 bp, Homo sapiens
tactgttctctccattttggggggtgactctgccaacaggggatgggttccattctattccaatttgtgttgttatatatgtccacatagcaatacagaaagtgggtccactagctaatacagtattaccatatttgttatgaaaatcaggtgtatgtttctggtggctctgccttgccattgtttgctgaatgcttcgaacttggagatgactgagtttgtttttgaccaagggaaacatcgtgaaggtgaagatagaactgcagcaatgaagctgctgctttaatttttgcatttgtaggagagacagagtttcactgtattggccaggctggtctggaactcctgacctcaaatgatccacccgcctcagcctcccgaatctcccctttttttcacacaaggattagcagagtcagttgtctgtcagggctttttgcccccagtagtgtacaactctgctctgtaagtgattttctttaaggaaactactgtgtaggttagcatttatgacaaaatggggaattggtcctttctgttgatctgtggttctttaacttgaatgagcaggtaaatcagctccttcttcctaaaaaatatgcatatttttgggtcatgtcccctacctaccctgccagttcagtctctggggcagtgactgaagtctgcatttataacaggagatgctatggaaatgatcttgtttctagagtctctggctgaagcagctcttattttttgttttcttcatgctgtaactgattctacatttgaaatgtggggaggctgatactgtgtgaacagctttgtagaaagagaaaaggaagatttaggcccacacgtgcaggtgctagcttggctgttttcttctattgggggaagagggattgtgcttcccccccaacccccaccccgcccctttttttttgcctagatagcctttaacgatgtcaatgtctggccaggcgcagtggcttatgcctgtaatcccagcactttgaggggccggggcagcggattacctgaggtcaggagttcaagaccagcctggccagcatgg

SEQ ID NO: 27305 - DNA, 1011 bp, Homo sapiens
aaccctccctctactctctatctccgtaagttcaattgttttaatttttagctcctacaaataggtgagaacatcaaagtttgtctatgtcttgctagctagtttcgtcatgtattggtgacacctgtgacaaataatcacctttattttgtaattaccaggaataaaggtcagtaggtaattactaattgtctatggcagtggttcttggactttggtgtacatcagaatcacctggaggagttgttaaaaatgcacattcctgtgccctgttcccagttgctgtttcagtgtatctgaggtgggactggtaacttgcatttctaatgagttcccaggagttgctcatgctgctgctgtgggaccacactttgagaagcactggtttactctgaggcaggtactgtgtgtggaagaaagtggtataagttatggtctctggccttgaagagcctgcttttgagttgtgatctgtacttatatgaaggtagacctaagtttgaagctctgtaggctggtgccaaatgagcctaagaagttcagatcgggggtaatcattagtagctgaaaagcccggaagcttttacagaactgttgtgggtatttgagccaggcacttaaagatcagtgagtggcacattcccagaaggaaaacacttttaatacagatgtggagttagaagtgtcgctggcagtttcagtgggtagcttgtcactttgagttggtgggtattggatggtggtaatgggaaataaggtttggaaaattattggggtcagattgtgttggaggttgaatacttttggacttcatttggtacccgtgattagccattgactaggccctgttgaggactggcggtggaggggtgtgggaagagaatgtatcagaaggagaaaaccaggtcttaactttgttgttgcattcttcggctcccaggcctcagggttttttgcagggggtgggggaattggttctaaaaagagaaaaacctgtttactagtggaaac

SEQ ID NO: 27306 - DNA, 1034 bp, Homo sapiens
ctgttcgaagagccctgcttctctctctctgctgccatctcattcgtgcctttgtgtttatacttccagctatttttcctttcactttaacctctttctttgagaagctcacaagccagcctgtatgtatgggaacctgtgaatgtatgcttttatgttttagattaattccttcctctaaaaagtccctggctttcttagactgttgtaggacttttgatttcagaattacatacatgtatatttcccccaaactttctttttttcttctaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaaggttcatatttagagttaaattaatcctctttttatatacacttttgcttatgctttgtgaactaaaaaaaaaaaaatgacttttctgttgttgtttttcaccttttattaatattcccttatcattttaatgttatgctcctttcatttctgattttgataatttgtgttccctctcttagtatgactagggctttatctattttgttttcaaagaactaactttttacttcaattttctctattgtttatttttaaaaatataattgatttctgttttgatcttgctttcttccttcaattttttctagaactttacctaattgattttagatctttcttccttttttttttcattacctggtgaaaagatctttcttcctaatatgagtatttaaagttataaatttctggctgggcgcgatggctcatgcctgtaatcccagcactttgggaggccgaggtgggtggattgcctgaggtggagagttcgagaccagcctggccagcatggtgaaaccccgactctactaaaaatacaaaaattagctgggcatggtggcaggcacctgtagtcccagc

SEQ ID NO: 27307 - DNA, 1079 bp, Homo sapiens
ctggtagaagtgggacactttgccacaggatccagatcagtgattctaacccatgaaatcttgctgtgtttgttgttagttataaaacgaatgaattgtcactgaagtatcaaaaattaacagatgatttacttataaattaactagttaagatttagcatgatgactataatagtttttgcaaattatttacttttaaattaaccagttaagatttagtgtaatgcctatagtattttagctttaatgaatttgtgttctctatggtttcttgagcaggagagtcatagatctacagccattttagtttgggaaattgtgtgtgtctatggtttttcatatcatcaagtatgtattgtgatggaaactgatagagaattcattattctgggggttagagagatgaatgcgacatctgttctaggcccttccaggtctttctgtccagacgaatggatgagacttcagatacctatgatacaagaaagtaagatgatgtcatgacaaacttagaatgaaactatgagaatagagagaagaatgacagtgaaaatgtgtgcctgctacatagaaatggacctcttcaggttggcgtgtgcgagattttcttgctctagggagattgtttaagcaatcactatgtcgacaaacacagatgtttccctttctgaattcatatgatgaagatcagggatccaaacttattcaaaaagctaaagaggcaccattcgtacttgttggaatagaaggttttgcagcaattgttgcatatggattatacaaattgaagagcaggggaaatactaaaatgtcccttcatctgatccacatgggtgtggcagcccaaggctttgttgtaggagcaatgactgttgttatatcatgtatcgagaattctgggcaaaacctaagccttagaagaagagacgctgtcttgctcttgtaggaggagcttgttttagttagacgtctcattattgaagttacgtattattgttgaaaataaactaatttgtatgggtttagatggtaacacggcattttgaatattggcttcctttcttgcaggcttgatttgc

SEQ ID NO: 27308 - DNA, 1032 bp, Homo sapiens
cattgtggcacacgcctgtagtcccagctactcgggaggctgacatgggaggatctctctaagcccaggcattcggtgttgcagtgagctatgatcctaccactgcactccagccttgacaacagagtgagaccctgtctctggaaaaacaaaaacaaaaacaattacgtataatttatttcattgtatggatgttccataatttatttacctagcccctgctgaaagatatttaagttctttctaacttttccctattaattctccctgttttacagacaaagagcctaatatttggcatgaaggagtgagttagctagagtggcacacttcctaatggtcagtattgtagaggttggtaaaattaaattaaatttttgtttgagacagggtctcactctgtcatccaggctggaatgcagtggcgctgtcacggctcactgcagtgttgacttccagagcttcagtgatcctccccactgttcagcctcctaaatcattgggaccacaggcactcgccgtcactcctggctaatttttgtattttttgtagagacagggttttgccattttgcccaggctggtctcaaactcctgagctcaaccgatccacttgcctcggcttcccaaagtgctggaattacaggtgtgagccagtgtgtctggcccagagtctgtaactgttgttttcctgctgagtgcctaattccatctgataagatgctgggtgctatataaatcaagtgaaatgaacagagtccctgcctttaggggcattgcacagtatgtgatgcaaacttctgctctcggggcactcattaaagcagtgtgtacactcagagtaagaggcttagtagggtggctagatttggagggtggtgtgtggtacaagtgatgtcagtactccaggactgggtggtgccttttgaattctttgagttgtggaaaatgtcttgatctggaaactgaatggtgtttctggtgtttctttggaaacataggtttagtggtgtgagtacaggacgatccaga

SEQ ID NO: 27309 - DNA, 1087 bp, Homo sapiens
taattttgaagtgtagagtataatttagatcaaatttaagagttttaaaattacctctgattatgggatgacacttgaaaaagtaatcataatacttaccaaaggtttaacaggctacctgcttccagtggagattgtgtgattgtgtttacgaaaaatctgattaactcaagaaagggccattcattgcataccgaattcctaattttttaaaaaaagatccatttaatataatatattcttgggtgaccaaatctgtagcataggaatgacttaatgtgattttttgttggtgggaagacattctaaagggagtcctcaataaactgcatttctaacacacaagaggttcttgtggcctgggggcggtggctcacacctgtaattccagcactctgggaggctgaggcaggcggatcacttgaagtcaggagttcgagaccaggctggaccagtctctactaaagctatgaaaaaaaaaaaactggacgtggtggtgggcatctgtaatcccagctactcaggaggctgaggctggagaatcgcttgaactggggaggtggaggttgcagtgagccgagatctcaccattgcactccagcctggacaaagagcaagactccgtctcaaaaaaaaaaaaaaaaaaaagtccttgtgatgggtttactttttgtcattggtgcctgaccgactattgccttctgcttatttgtcttttagggtcatgcttttattgtctctttgaaattgatcattgagtcctatgagtcctccttatgccttccacctccatttagttagctggtttttcttgcagtctctgggtcctttttgttgttgtttgttttgcatttattattattgttattcatacatttttgagacagggtcttactttgttgcccaggctggagtgcagtggtacagtcatggctcactgcagcctcaacctgctgggctcaagggatcctcccacctgagctttctgggtagctgggactataggcacatgccatcatgcctggctaattaacaaaatttttttttttgtagagatggggtcttgctgagttgtctacactggtct

SEQ ID NO: 27310 - DNA, 1022 bp, Homo sapiens
aggaactgaatttttagcttaccttgttaatttcaatgtagagccacatgtggctagtggctaccatactggacagtgcagttccagatgtgtggcagcagctcagttccacgttagtcaggagggagtgctccttcctcccctctccttctatcctcccatgcccctcccctcagcaggtgggtcttacttttggatggagaacaccttctgagtttaatttttgttgcttctttaattctaacagtgtgaagagtgccagtgctggcagcatggggtctgcatgggattactggaagaaaatgtgcccgagaaatacacctgttatgtttgccaagaccctccaggtagagatttctggagtcagggatataacagtatgtagccttttccttggcacagctggctgtgacacattctaaatgtctgcggtcttgagactcatttcttcagcatcggctagactccagctcctcctcgcctctgttgctatcctgccttgtggccagctatcctgaacgtagcaataagagcacacgtgtgaaggggcccacctagtggaaggcctggccttgagctagaacttttccttttctttaattatggtttaaaaaaaatgcatgaggccgggcgcagtggctcacgcctgtaatcccagcactttgggaggccaaggcgggtgaatcaactgagatcaggagttcgagaccagcctggccaatgtggtgaaactccatctctactaaaaatacaaaaattagctgggcatggtgacaggcgcctgtaaccccagctacttgggaggctgaggcaggagaatcacttgaacccaggtggcggaggttgcagtgagccgagatcatgccagtgcactccagccagggcaacaagagcgaaacttcgtctcaaaaaaaaaaaaaaaaaaaaaaaagcatgagatctaccctcaacaatacagtattgttgttaataactataagcacaatgtcgtacagcagatctccagaactttcatcctgcct

SEQ ID NO: 27311 - DNA, 1050 bp, Homo sapiens
aaacgcgttggtgtgactcccgtgtactaacccttgtctgcactagccctgctctaatcacctctcagggctctggaagccattctgtgaggcttactttaggctaggacattggcccagtcagtaggaagcagctgtgggtcccctgagctagagtgctaccctgaggtagttggaattggtacagtgggcaagctcctgcccagttcctaagtgggaaataggaaagggaggtagggatttggagtattgaaactgcagctagtatttcaggtggctggaaatgctggctggttgaaaaatgggccaggggctatctccattcagtaatttccatgccattgcatccccaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatggtagggctccttcattggccccctgtgcattggcatgcagtcgagcacccccagacgagctgctttctgaaccccccagtctgagtttacagggaccgctgtactctttgcttctcttcttttcagcctctccccacctccattctcccctcaggatggatgagccttacttttagtatttatcaggtgcaagatctgcatgatgttgggtcctgcctcacttgtctgatcccttctgtaaagttgagtatgcagagagagggcaactggcagtcctgcttgcaggaaatatgtgatctaagccaatctttacaaacaagttctgtgagaaattaaaattttgacttgagttttaggatatctgaggatttaatctgaaaaacctcttattccaatctttgataaaatctaaaatgaagctttctcctcgtaagccagtagagatttgagaatttgcctgagtcatttgtatagccctgagtattccttccagatattggtggttacggacag

SEQ ID NO: 27312 - DNA, 1033 bp, Homo sapiens
atcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctattt

SEQ ID NO: 27313 - DNA, 1027 bp, Homo sapiens
cgtgccactgcactccagcctggagacagagcgagactccctctcaaagaaaaaaaaagggcggggaggatgatcatctctgcctggagataaataccaatgattacacaatcaaagtgatagtatttattgaaacttactgtatgccatgtactgcaagaagtgctttgagtcatttcacagtaaccctgtcagatagatgtgattaattatccactttttacagaggagaaactgaggctcagagaggttatgtcactggactaaagttacgcagctggaaagtgcgaggcggtctgagtccagagcccttctttctaccatgacatttactgggggcaatatctggaagtaccaggttggtgtccagtggagccaggcaattcattggtaggccagggccagtccaggtggagaggtgtgtgaggggtgtgtgtgtgtgtgcctggtgaggcaagggtggctttgtggactgaatattactatagtgctgaggggtaggggtagataagtactgactaggagctctcagagaaggattagccttggccttctccttcctggccagggtcccccagaagtggggaaacaccagactccctgctcccattggcttttagggaagatgggctggctctggacacatcccgaggccacagtggggactgggctaaggaggccctgtgggcagggagctgagccttggtggatgggtgggggtggagcaggctggcactgcttcctttgtgggctagaggcttgtggatcagaatagtaacagctaacatttattgagcatttattatgtgccaggcccagttttaagggcttccatgtacaactcatacgttcttcacaaagccctgtgaggtgtagatgaggtataggagttattcttcccgttttacagattgatggagctgtggcttagatagttgttcaaggtcaaatagctaggctgtgggggagtcaggattcaaacctaggcagtgtgggtcagagccatgttcctgaaggccatgccagg

SEQ ID NO: 27314 - DNA, 1061 bp, Homo sapiens
ccactcactatcttcgaggggaataggacagagaggttcccagtgaggacctggcacttgcatagaacagggtttaagtcttctttctgtttttactagctgtgaggcaattggcaagttaattaatctttcaaagccccagtttgcccagctgtaatgtggatagtccaagtacctggttttagggttgtcatcaagattgaataagttaaggcatgtaaacatcttggcatggtaactagtacatagtgaagtatccatgaacattagtggagatgatgatgatgtcatgatgtgatgtcattaatggtctgatacaattaatgttaaatgggaaagaagacccataagattatcagtattcatattacaatggtataaaattaggtatgaacatagatacagattggaagaaaacaggtagaaaatggagttccagcaagcatatgggaagtgaataaaacagaaaaacaaatatttctttactgttatatttacttttctttagttttaattacaaaaaaaatttgtggaaaatctaataattcagaagtgtaggccaggcacggtggctcatgcctataatcccagcactctgggaggctgaggcgggtagatcacctgaggtcaggagttcaagaccagcctggccaacatggtgaaaccccatttctactaaaaatacaaaaagttagccgggcatggtggctggcgcctgtaatcccagctactcaggaggctgaggcaagagaatctcttgcacccggaaggcagaggttgtggggcagtgagccgagattgcgccattgcactccagcctgggtgacagagcgagactccgtcacaaaaaaaaaaaagaaagaaagaaagaaaaaaagtgtattctccccttagatccccaaacaaatcctactctccagtcgtagctaataacagcatgttgtgtatccttccaggatattttctataccaacataaacatacaaaccagaatgggatcatacattgcattattgttttacaacttgcatttttcatgtaactacacattgacatctttt

SEQ ID NO: 27315 - DNA, 1049 bp, Homo sapiens
tctgccgcccgggttcaagcaattctcctgcctcagcctccttagtaactgggattacaggcatgcaccaccacgcctagctaatttatatatttttagtaaagacagagtctcaccatattggccaggctggtctcaaactcctgagctcaggtgatccacctgccttggactcccaaagtgctgggattacaggtgtgagccaccatgcctggccttttttttttttttttaactttcagtagagatgaggtcttgctatgctgcctagactggtctcaaactcctgggctcgagtgatcctcccaccttggcctcccaaagtgctgggattacaggtgtgagccaccatgcttggcccattgtggtcattttaaaattttattctctcagactaaagagggtagctactaactcccccattttacacctggggaaactgagcaccagcaggataaaatgagttatccaaagtcacattgccataaagtaacagaggtgaagacaaatctagatctgattttgaaggctgagttctttccatttattttcctacccctgaacctgtctgttctagcttggccagccccatgtaaccccagagcaaaacccattgccctaaagctacaacagactcacctcctcatctaattaacaccttccttaattcacgacaggcctggagggggcagggacttggccaagatcactgagggcatcagcagtggagttaggacccggggcgggcggcggtggggcaggtctctggcctttctcctctcctttaactcagtccacagctcccagactcctgctagatccagtgacagacaaaaagaaggagaccagatggatgctgtgatgagtcatgtgctgctctggggagacagggcagctctggccactggctttggtttcatgggatgctcctgcctcagaggatgcctatggcagcagtagcctgcagggaagatggggacccctcacacaaggccacccattatgcatggaagccctggctctcctcctgtacacaccagccatggacc

SEQ ID NO: 27316 - DNA, 1014 bp, Homo sapiens
ccctgtgcaagcaccatcaggtttgacttctcagacagccatggtccagagggcagctcagcttgggaagggatgcccgaggaacagacagatgtctggagggaaagcaggagcctcactgggattggtttccttcctgaggtagcttaggagtcagccatagtggatccttgggtaccagagatgagcccaggggaagattctagctttgtccaagggtaagcttaccttccagtggttcttccagaattacctgatctgactttaataagctgagattgtccatttcttgtcctgaattgagttaacatgaatttttaagcagccttgcagataagcgtccttgggctgccagccaccactttgccccagaagtagccagataaacagcttttggcaggtccctgccagctcctgcacaaagctcgtcctcccttgacctaaggagatgactctgtcatgctgcactggctgggaacactacccatataggtagaatcctacaactctggctatacctggctcaattcttgtgcccagctgtgggacttactgctcttcttcctggtctctaattctcctaatcttcctgaacactccacagcattctagtttctctatctggctgtatctcaccctgtctgctattggtgagtcagtacctgaaaggtatctggaaggtccagggtggttggggaaggtagtgtcccatcacagaggagactagatgcaattttttcctgcccctggtccctagtgtgggagcttggccattcttctggatgtccctggcttgaggaggatctgtactgtgggcctccccagggcctgagcagttgtgcatgttgggctaggaggggcccagactggacatcctgttaagtacagtggcccaagtctcagccagaaagtggacactgggatccaggagggatctaggaggcacctgaatgagtcagagcagcccagtgaataggattagtgagttattatagctctctggcagttgctgcc

SEQ ID NO: 27317 - DNA, 1033 bp, Homo sapiens
gctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgtgagtggtggggtgtccgggtcgggccggagttggcccgcaggctggccgcggccgaggctccatggggttggcgctggggcaagggctggcgctagggcaagggggctctgaggcctcccacaaagggggaaaggagggaggggccaggctgtctggcggaggagggagtggggggccttcctgctctgaggcttctgctttagttgcttgagtgtgtggagggcaccacgggctgggcatccctgcccacttggccccgcatggcctggcactttgtgatcgcttgtgggcaggccgggc

SEQ ID NO: 27318 - DNA, 1044 bp, Homo sapiens
ttccctttaactttcctttactatacttaattctagttatttctagagcaagaagatgtttgcctgcaaaggaaattatgtcataccaaacgatattggtattaccttcctgtctacctgggagggaagaggtcttttatgatgtttctggataaccacaccagaactcctgcagttgaacatgaactctagagggggcccttttcatagccctgtatcagttactgtaacttacagacagatggagtcacatagctcatgtcccttatccaaaatacataggtcagggaactcagcagtgcccacccacccaggtggctgcctgtattgactgaattttgcattgccctcttgtctaaacctgaagaactttaaacttgacaatgttcttttcagataatttatttttctgaattgtggttaaatatatataacatgaaaattaccatttcaaccaagtttacagtctgtggcattaaattcacactgttgtataaccatcaccaccgtccatctctagaacttgttttgtcttccccagctgaaattctgtacccattaaacactaactccccattccctcctacccccagccactggcagccaccactctactttgtctctatgagtttgactattctagctacttcatgtaagtggaaccatgcagcatttgttcttctgtgactggcgtatttcactttgcataatgtcttcaaggttcatccatagcatgtgtcacaattccctcccttgttaaggctgagtaatattctattgtatgtagagactacattttatgtatctattcatttgccaatggataggtggattgcatctaccttttggccgttgtgaataatgtttcctgtctcttaagaatgatactcttcattgaaattgcaaggctctctgattaaattctgtacatccactcaaggccctgacttgtgggcacaaaagttgttttttttttgttttgttttgttttgtttttgtgagacagagtcgcactctgttgcccaggctggagtgcagtggtac

SEQ ID NO: 27319 - DNA, 1028 bp, Homo sapiens
tgccccgggacagacacgtgagttttctttcttccagagcccccgtcccaccgggatggcgggcccgcgcgggagctggtgcgcggagtcggcccggggtgtggggactgtggggtgcaagcgccccgagcgccggacgattcctcgccgacccaggagccatgtgctccgactcggtctgggccgcgggggaggttgcgcgctttgtctgaactgctgggaatgcgggcgtgagtgcgcggcccgggggagtgtcgggaccagctaggggagttgtcagaaagttcgtgcgggagtggctgcaggtggcgtcgtgggagtctgtaggagggtgtacgggatgttgtgtcgaggggttgctgccacaggtcactgagggtagaactgattgttagtgtgatgacgcctggagttttccctgtcggagagatcgggggtggccgggtcggttggagttcgtgggtgggcgggtacagaagttgggctagttgtgtgggtcacagttgttcgtgctaggcctggggtctgtaagctgtgcgtgtgcgtgctgtatgcgtcggtgaaaaccctagggtttgtaaggcttgagcgatgggtccgggccagttatcctagcgctgttggttaattgcctggcgtgagtgtgtctgggtgcggtgtggggtgcatatgtgggaagcctcccagactacagatggccctgtgtggcggaacaccgaggtggagaagtttgtgtagactgaggggtcattccccagggcccacccggggaaccctgcagacagacttggctggcagccagggtggaatttgtacagataaccttgagtacttctcacagccggccagggctgcatcactgagcccagatcccagctgccctggccacctagaaatggctgtctgacctcagaaagcagcctgcagtggtgctctctgaggagtggcacgtctaaccagtgcctgtctcacctccaggtggcctgactgaaagggtagacccttccctcgaaagcctggcctagcca

SEQ ID NO: 27320 - DNA, 1063 bp, Homo sapiens
tgggtgggtgggggaagtaaactagactgaagcgatggattttttttttcttttttttctttagtgtttttccctttgttcttgaacacttttgccctgcagcctcagttttgaattcttttagcaacttggattagaggggcccatatgtcagaagctcccagcacctcctacttgggagaaaagtgagccatctgctggtcaggaagtcctccagagaggcagcttttcccacaatggtggcaggaaactttggggaaagcaggaatggtgtccactgctgcggaggaactgccttcagagaaggtggggctggaaaagggttagaagcctcctagctgggattgtctttgtttcacctttctttaaattagaattacagaagcccctgcccagtgaacagataacgattggtcttatgctcctccctttcccccattttttcttttgctgttttgttttttgttttttgtttgtttgtttgtttttttgagacagagtcatgctctgtcacccgggctggagtgcagtggtgcgatctcagctcactgtaacctccgcctcccgggttcaagcaattatttgcctcagcctcccgagtagctgggattataggcacccgccaccatgtctggcttttagtagagacggggtttcaccatcttggccaggctggtcttggaactcctgacctcgtgagccaccacgcccagcctcttttgctgtttcattgctgacagtgttcaacaatatgccccatctttatatatcctaagaaacactaatcctaggttattgctagccaaaatatttttgtcctgagtagtgtcactgggccaaaagatagatcaggacgacagcctttagttttcctgaaatcaccaggtcaggcacaaggagaaaaggttcctggatactgactaacttgggtgggtggatctagccaggagaaagacagtaacatgtgttctgtactttctgggaagatccctgaagccatcacagaggctccccaacttctgagtcgcccatctgttgctgtgggagtgtgaacggatcgctg

SEQ ID NO: 27321 - DNA, 1035 bp, Homo sapiens
gactcggggaacggaagactggcgcgggcctgccctcgtcctcgttccggcacaatcgagtagggcagtggggcgggtggcccaagggtgtcagagcaaacttggcgggcactgggcggacagctgggcttggagctccccgaagggtggcctaaggatgaagccccctagttatgcggaattggcgaggagcggggagaggcgttgtcattcgcgggcagggtttgtgcctgaactgggaaagggagctgaattcgattcggcctccgccttttatgtgcagtagggttttgagtaggttacttgtttctttcgaattaagtagcacaaacattaacagtaacagacttctgctgagaatgctttctacgtgccaggtgctctgcaagcggaatctcgtttaactcagaataactctgaagtggggtactgtggtacattaaagccttttgcacatagtgaggctcgctaatcttgagctgctgttgcttgttgaatgtaaaggaccgaatactttgataagcatgagtcaagaggggagactgagaccacccgctgggtgagtgtgaggtgtgggggtggagaaacgccaccagatatgtgcgagaattggttgggacttcagaacgttcttactcgtcccattcggaggatgcttcgtaactctgctccatgatctggaaggggccatcacaaacagcttgattccaggtagcttgaaaagcgtattatatttgcagtcatttcttggttttctgggctgccgaagtggattttccttcctgaagttcctgtaaagggggatgggaggcacttcctgaaggtgcccttgttctgcccccagccctgcccagctcttgcaaaacctgcagtctctaatctgctgtgtcatttctttcttttcttgtataaggactggtttctggaatctagggcagatcagaaacctgagtcgtctgtgttcttccattaaacttaaatatagtggcacctgcctccagcatttatggttctaatccgtatgtgcggccagta

SEQ ID NO: 27322 - DNA, 1044 bp, Homo sapiens
gtccaataacacatgtacttactaagtgcccccctatgtgtgtggctaataataagggaattcaaggtggaaggcactcacatgtattaaataatggtagtcactacatcaggcaattttgatacatgtttttggacttctggtgaggaaaatgcattatgattaaaacctttcctggattcgggacagtctttttttttttttttttgagacagagtctggctcacccaggctagagtgcagtggcatgatcatggctcactgcagtctctgtctcctgggctcaagccatccacctcagcttccctagtagctgggactacaggtgtgcaccaccatgcctggcaatttttgtattttttcgttagagatggggttttgccatgttgcccaggctggtcttaaactcctgggctcaagtgatccacctgcctcagcctcccaaagtgttgagattacaggtgtgagccaccacctgaccaggaacagtcttaaagtgaatttacattttattcattatagtagtatggacaactagactaaacaattttcctttgccaagtttctcatatctgccttagttttctttgactgaagaacaaattaccataaatgtaggggcttaaaacaccaccgacttattggcttatatggcttatagttctttattttattttatttaagagagggtctcactgtgttgcccaggctggagtgcagtggctattcacaggcatgattatagcacactataacctcgaactcctgggctcaagtgatcctcctgtctcagcttcctgagtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccattt

SEQ ID NO: 27323 - DNA, 1026 bp, Homo sapiens
gtgacctctgcctcccgggttcaagtgatcctcccatctcagcctcctaagtagctgggattacagacgcgcaccaccatgcctggctaattttttgtattttttggtagagatggggtttcaccatgttggccaggctggtcttgaactcctgacctcaagtgatttgccctcctcggcctcccaaaatgctgggattacacgcgtgagccactgcgcccagccccttgattatttttaaatattctgttttatatcttctattgactgttcagatctaatttttttttagtgtttgtctagttttgtttagagattttaatatgcatccttaatttctcacggtatatcttgaattattattttgccatgtcacaaatagtaaaagaaccctataactgtatttgcatttaaactctcatcatttctgctatcattgtcatactttttgtttgtttgtttttgtttttgagatgaaggcttactctgttgccaagctggagtgcagtggcgcgatcttggcccactgcaacctccgcctgctgggttcaagcgattcccctgcctcagcctcctataggtgcacgccaccacacccagctgattttttgtattttggtagagacgaggtttcactatgttggccaggatagtctccatctcctgaccttgtgatctgcccgtcttggcctcccaaagtgctgggattacaggtgtgagccaccgcgcccggcccattgtcgtactttttaaccttctttcaaggatcccagcctttgctgtctgttgttcagtgtctcaatttcatatatttcatacagttttatagttatttttggtaggaagggaagttcaatatatttaattctgtcaagggcagaattgatagtcccaattggtgtctttttttttttttctgagacaaggcctcgctctgttgcccaggttggagtgcagtggtgcgatcatggttcactgcagcctcaaacttctggactcaggtgatccttcacctctgcccctcga

SEQ ID NO: 27324 - DNA, 1092 bp, Homo sapiens
gatcttgggccactagtcactgggggaactagtaagtgcagtgtggtacgtgctttgggggagcacttgagagggtggatacctggcctctcctgggaggactgtcaggaagaggtgaacatctgagcagagttgaagataggacctggtttggcaggcaggaaggacaaggaaaaggtgctcccggcagggtgggtagcagggtcaaacacgtcaaatggcgagagcgtggtatagctgcaggaggctagagggtaagattttggagttggagttagggctatggtgatgcaggcagcatggagagggagggtcagtcttgagggcatttcatgctgtgtcagaagttggatcttgtctgagaaaaacagggaaccactgaagggttttaaaggtaaagcaacacggttacacttgtattttgtgaagatcagtcttgaagcagtgtgcagaatggattgcatggctttagaccgcttaggagatgactgactgggacaatgtaggtgagaaatggcaagggcctgctgtaaggcagtgacagaaaccagaggcgggactgggcctgagaaatgaaaaagaggtagacttgataggcttggagggtggggaaaagtcaaggatggttcccatgtttctggtttgggttgctggatgcatggtattacctgtgcatgagctgggaagtcctggtgaagaaatagaaggttttaagctcattttcttttttatttttatttttttgggggactgggtctcgctctgtctcccagactggagtgtagtggcatgaacatggctcactgcagcctcaacttcaagcagtcctcctacctcagcctcccaggtagctgggaccacaggcatgcgccacctgctctgctactttttgaattttttgtggagatggggtcttaccatgttacccaggctggtctcaactcctgagctcaagcagtcctgcctcagcctcccaaaggcctgggattacagatgtgagccactgcacccagcgttaagctcattttagatttgttgagcctgacttggccttggtgacatctaagtggagatgccagtaaagttggaatc

SEQ ID NO: 27325 - DNA, 1035 bp, Homo sapiens
aagtatgaagtgactgagatggtcttcagatttagagtgagagatgtcacgaagctgtctgcagtggggttgacagtggttcgtgcatctcatttctgctgttacttgacatccagcatatttctgttttgttatggcaggaccttgttgctcgcctggatgaactcgggggcgtgtatctccagtttgaagaaggactggaaacaacagcgttatttgtggctgccacctacaagctcatggatcatgtggggactgagccatccattaaggaggtacctatctaacaattttcaggcatgaaacccaaaggggtcatcagctgtatctgctaaggatggcttttatcagagaggaatgttcagacagtaccttgggatgctgtcactcagtgtcctgggttagggattaagaatgagaaatagaaagatgtaatgcctgtcttcaggaaatgggttgctagtgaggtagacgtgtaaacaaaccatgcttgctttaaatggggtatgtacatgtcacgaggtagtatcaaggaagccacgtgtattactcctgtttcatctccctttcttcccagtacccttttctgcttgtcgcctgaatgctttccactctggtggctcattcagatccttctctgggctcacaattgcttctcctcccttcccccttatgctcagcaacggctaaatcttagctaatctttgctgatggacatagttcactgagaggcatgtgtgtctatcacacatccgccaagagttcattctttttctcaagaggaggttgttaacctgaaagaatctttagttggaatgcatgtgggaagcctttttgagtaggaccgtctttgtaccccttgtttgtgagaagttaccagcccttaatctaaagtacttaaaatacaagctgcttttatttaaattttaggaggagagatttgggttttaagtgagaattttcatttctttatgcattatgagttttgtgccaagtttctttaagtaaatagttatctgtcttggataattggaa

SEQ ID NO: 27326 - DNA, 1114 bp, Homo sapiens
ctaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaactttgtgagtgctagtatctgtgaatttctataaacattatacaggaaggccgttttcatattatagcaggcactattggggttacgtagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtt

SEQ ID NO: 27327 - DNA, 1009 bp, Homo sapiens
ccttgctgctacatgttgagttctttaattctttaaataagtcgatttcttttcttgattaaaaagaactttttttatagagatggggtctcattatgttgcccaagctggtctcaagctcctgggctcaagcaatcctcctgctttggcccctaaaagtgctgggattatagacgtgagccaccttactcagtctcttgagttttaaagtccgttcccaccctgctatccccaaatcattgcttgaggaagaggaaagtcacttgatcatttggacatttggcatttcctagcatttgaaaggaaaccccctggtagcaaagtgttcttgatctgagggcagacattgatttgagcagacataatgtgggacgtaagttctagccgcagtcaagagttgtgggccactacccttcggctgttcttatttcatactcatgccatcctttctgcatgaacatttctgaatgcccacatattagtgtacctaagaacctctgaatactggcaaggaattaggggtgcacaccccagccctcaagattaattccatgcctgtgcatgtcttttggaactgctttattaatgggtttggagtctgccattctgcaagactggatcattatcaccttagtcctcacccctgggaagagctgccactgaaggatggtgtgtgtgtgtcagcaaccctgcctctgcttgctggagcctgctgggatcagttactcactgcagtcacctcctcagcttcacagtctgtctagattgtcattttcattcattgtgcttccccatccctccttagagtctagggaaaggcagcggaggggaaacaaagagtacaggagataggttcttatcccctttaacactttctgtgagctgagtcccatttttgagaatctttctgtgttaggttagatgctgagtgtgacttggcaagaacacggccacacggcaggaatgtgcaggtttctgtaatgaatggtcaggatgtcatgttctaagc

SEQ ID NO: 27328 - DNA, 1031 bp, Homo sapiens
cctggaattacctcatctccttatgttgtcacataccactttcttagttattattgagtttgttttgttatttgtatttaagttgtcatcagcttaattatgaactagctgtctcacattcttttgtaaaatgagatggggcatacataaatagacttgggagataaatgattattcccttataaatgggatcttagagcgggagagtaccttagtctctctgttgtcaccagttaggaactgtaactgtgaactgaaaccttcagtaattctgtgtttgtctccattttctttcagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaacaaaggcctgattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttggtatctgaaggccccatttggacctctaggggtccaaggggataggtttttatcccctttaacattttctgtgagctgagtcccatttttgagaatctttctgtgttaggttagatactgagtgtgacttggcaagaacacagctaaacaacaggaatgtgcaggtggactgcagctaggacctctgct

SEQ ID NO: 27329 - DNA, 1021 bp, Homo sapiens
aagcccttgcctgggtgatctcatggagtctgaaggtgccggttggggcagggctggctcgggagaggatgttggcagccaaggccgccaatgtgcagggtgactttgagtcctgccctgccctctctttgccttctctgtgtatgaagaggctaaactggggagaatgccatgcgtctagccccagccccgcttcttcgaagcctgccttcggtgtgattggtcccattttccggttgtaagtactaagacccaggaagggaaagccacttgcctagggtctcccagttgccaagtgacagggccaggccttggctgtaggctctggactcctagtccagcagagccactgaaaaaggccaccacttccctgctctgggccttttgccggagcttcatttcctgcctcggtgtgtgtccccacatctctatctcccttcggattcccacaaccctttccttcccctccatggcccccaccccttatctccgtgggaaacccctctggcttccccttgagctcctgggggccacttcctctggggagcctcagtttcttcatgcctgaagtaggatagtgagtcatggttcccaggatgtcccaagaggacagaaataaagtgcttagcacacattagggactcaatcagtggaggcgggggagggccaggcacctgctcaagtcctgcctcctctggcagctgatgccctgtcctgtgattcagtttctgaagctgtgaaatgggcctagggcttgtacctggtaaggctaacaagaggatggtatgaggctgtaccttaggtccccacctggtggctggctccgtgtcgctgttcctgggggagggagacccagtagaggcctcccctgtgttcaaggcctcattccctgctgtttgtccaaagccaagtcacttagtctctctaaacctcagcctctgcacacctcccttgtgaggattaaatcagctaatgtattccccgtggctcaaatctactgggtgcttagaaaattttatat

SEQ ID NO: 27330 - DNA, 1050 bp, Homo sapiens
cagtgctgtgatggggatagcctgggtggagaaggccttggccacgtccccctggagccagcatgtggccagggagacagcacatggccccagcccaggccaagagtcaggcagtgggcgagcccagagtcggctcctggagcccctgctgtggacctgcctccggtgatgaccacagggactgagagggtcaagggcctcgaaggaaagccagtgaagttatctggcaggtggaggtggtggaagggcagcttgcgggagggtgccggactggagggggctgacgccttcacgggtgtggaaggcaggaaggttctagaaggcagaggagaatcgatccctgggtgtcctcgaaggcctggctaaggaagttgggggtttccactgccccgagcgtgtctggcttgctcatgccccacttgccttgcgcatgctcttccctttgcctgaaatgccctttctccagtgtctgcctggggaactcctgttcatcgctcaagatcagtgcaggactgccttctcagaggggcaaaggggaacagaggtgccagttgccatgccagtcgtctccacctgtgtccttgtattgactcctctctgcagtctagccagggctgaagtgatcggggagggggctgtctccattttgcagatgaggaaactgaggctcagcgatgtgaaggcccttgtccaaggtcacacagctgccaagtagcaaagccaggattggaaccgaagcagcaactttctgccctcctcaacctgctcttggcgggggggtgggagggggggctctcccggctccgcctccccccttgcatggccgagtcctggtgcgaagctacagtttccttattgtcaccagctgtttgtgtctgcttcccccctaaactgggagctgctggagggtggctctctggtgcacctcacttctgggtccccatagcacctgtaactcagcacagtggcgggtgcccagcaggtgatggtgaacaggatgaatgaacagcagtgacaatgtcaccatttcttgtgctctctgtgtgagct

SEQ ID NO: 27331 - DNA, 1048 bp, Homo sapiens
gagactggtggctggcccactcgctcagcacaggacagacaggctacatccccagcaactacgtggcgccctccgactccatccaggctgaggagtgagtaccgtctctggctgcctctacccgtcgtccctggacactgccggtgcagagtgcctctcctgggctggggtgggaggtctggctgtccagcgccccagccatatccagggagaagcactgtgagtgggcagaagcctggacagtcagcaccatcctccgtcctcccacccccaggtggtattttggcaagatcaccagacgggagtcagagcggttactgctcaatgcagagaacccgagagggaccttcctcgtgcgagaaagtgagaccacgaaaggtacgagcgctcttgctggccaacggatactgagtcttctgtgagtggtttgagctgggtgttgtggaatgagcaggagtttggtttgtggagtagggagggaagaaccttccgggtggaggtaatggcaggatcaaagtcagggaggtgcatttgaggaacactgagtaatccgcggtggccagatgtccagagaaagatgaggcttagtctctctggcctcagttttctcagataaaagatgaacataggttgtctggaggtctgagtgtcacacagtaacaggctcgttcccagggtaggtgctgctacaatgagccccgcttcttcctcttccccaggggtccctgggctgcactggatgctggaggctggttttgccctcccccaactgcagtcctggtccctgcccctctcctgtccctcccctgagccagagaatgaagaccatcccctttctctccagcccctctgaaagtgggttgcaggcgcccgtcaccatggcagccaagctgagctgcttcctgtgggcctggggctcagcgggagatgggaagcagagcatccatgtcgagccgtgcatttacgagcagtcgtgcagccatgtgcgggtgtgcatgctgtgtgtacatctgggcgtgtgtgtgtgtgcatgtggggtggaattgtc

SEQ ID NO: 27332 - DNA, 1049 bp, Homo sapiens
gtccccctctctccctgctccacgcagtgtcccactgcccgcctttctctgcagctggctggtatggagggggctgccctgaggagccccagagtaagctggaagggaggggacagaggctggtgtcatttgtctctgtagccctaggaccggtctgaaccggttgctgggagaggaggagggggcggccagatcgattgcagcaaagagggaagagagcggcagagggagctcgcggggcttgcgtgctgggtgagggctcgggcgtgggcgcagtgctgtagcccacccacctgggcatccgaagctgactgcagtgtcgggcctgtgggtgcctgtgtgcccgtgtgtctgtggcacacatggcctctgtgcacaggtgttggtccactccccaccccgagcctcctcctcctctcagcttggcctcctgacttcctctgggatcacccgccactctctgtctcttcggccaccgctgtgtagctcattctgaacccctttccctcagatcagaactctccaggggctgtcttggaatcttgggataaagacccccaccggcccctgagtggtctaatcctaactgcctccccacctccgcctggtgccacccttccccacctgctccctgcgcccctttgtcctccgcttctccagccctgcagctgttctttcctcagagcctttgctctggctgtgcccctgcctggagggctcttccctacttaacccctcaccgtcctgcacatccaagctcagttgctgcttcctccaggaagccttccaggccactcctgctgttgcgcgaacagctctccagtcacattcacatctgtggtcctgggaggtgattagggaagtggggctcctccctggactctgagttcctgagggcaggttccctggacatgttccctccccgcagggttcctggcaccccctactgtctgctgaatgactgactgaatgactgactcagcagatgcataaagcactgtgggcctgtgtgggggtggggctgtgtgcacacagatgtagatgcctgg

SEQ ID NO: 27333 - DNA, 1028 bp, Homo sapiens
gaagccctcgctgccctccccatcagcttcccccaccccactttcctcaccggagccgggctccccatgcctcgctctgcccacagggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgg

SEQ ID NO: 27334 - DNA, 1056 bp, Homo sapiens
atgaggtaaaaatgtaaggtgaatgaactgacagctcagctagggagacagacacagaaacctgcatttatgttacaaggtaaagatgtagaaggaagtatgaggcgctgtgggagcacaggaggggctccctgtccaacctgggtagtgagagaactggtgattagaaacagccccccccaggaatgtggcccccaagccaaacctttggtaaaagttagccaggtaaaggaaagtcaatggaaaaagcagcatgtattaaaaaaaaaaagttgggagggacaaactgcagtgagccttaaacctagctgaccatcagaatcatctggaatctcattgaaaatgttggggacgtgttctcagagtttctgattccagcagtctgcataaagtcaatggatctgtatttttaccaagttccacaggagtgtcctctgagaccagtctggtaccagtccttgctgaggagagtatggagattagatagttaagcagaagccagacctggaaggacctgtagagctgttgcaaggattgacttagttaatctctggacagtgttgaggacggtactggtgccctggtacctagtaagtattcattaggtgttagtagccattgctgttaggctagttgttttaactatgctctgctgccagaggactcttccaaagttttacaggtcataggtatagtactaatttcagttattttgatagtttccgctaattagcccaaattcagttttgatattgagggcttggttggggaggatgaaggagaaacacttatcactcctgtttttcttttgtgtttttcattttgccaggtagaaacttggctctttaggggcagcattaccagaattcttattttagaaatagaattttccattgatgctctgttattgtgtcagtaggactctgttagttttcatttataatcttgattaagttgtatagaaatagtttagggtgtagtatatctcttttatagataaaacaaatgccagcaatgtagaaacaaaagtagagaaatagccagactcctttagtt

SEQ ID NO: 27335 - DNA, 1026 bp, Homo sapiens
atattttaactcttgaggaaaacaatcaagttgtattatggtggaactaactaggtcacctcctagctgtgagaccctggaaggcaaatttcttttgccaactgagtctctagttccttgtctgtaaaatggggagactaataaaatgtgtttcataggattgttgtgagaattaaatgagataacatgtgtaaagcacacacaggcacatagtaggtttgcaatcgatgtggcctcttggagttcctggcccctagcccagtgcctgccacctatgcactattcagtgtttgtgaagaatagggatgtatgtaccccgtgtatgtgtaaaaggggctatatatagatgctcacacagatccatctgtcttgagaagggtatcaatattcagccggagtggctgagcacacatgcgtgactcttcttgggttgccacatcccctgctaggcagatgtccattataatgaaatgtaagaagggaaaaaaataataataaaggcagaggagtgtaatgttatggcttgatttgacagggcctcctgctacttcagctgccagtgccagacatggaacagattaatctgtattccaacacaccactgctgaagtcaagatcgatctagttagggtattttaaacatcctgtttgcatctagagtcttatcagaaaccaggacgtctgtccatctggggggcagggggcaggtgggtggcaaggttcagcaataaaagagaccacaggctgtaattttggaagtgagagaagaacactgctgtttgatttccttaaaacaaaagagctaatggccttagatgttctgtggaaacaaaggcagctctgtagcatggccttgaattttaaagtggccctgcaagatcttgccaagatatgggcctgatggttggagtgcagggaccatctccatcctaagaatagaactctggctgacccatgtgtgtctttcttaaccatttgagctgtggaaggcaggtgcaggttctgaagccgagtgggcagagcgac

SEQ ID NO: 27336 - DNA, 1047 bp, Homo sapiens
ctccacctcccacatctcataatctggtccgctttacctctcatatctctgcagcctatccacttttctctctctttactaccaacacttacattcaggctaccatcatttgttttcttccattagtgcagcacccgcctaactaactagtctgcctatctgtaggtttgggccctccagttcattttctacacagcaaccagagatttttctaaaatgtaaattcatgtatgcacttctccacccaaacacagtaaacagtggccttgcatcgccctcgggatgcagtctaacctcctgcgccggcctcatggtgcctcgcccagtttggcccctgctggctgctctagatacatccctcaccctcgtgatgtacaaaagccattctgtaccactcacgcttcctgaccttgtgctttctcaaaccttctagacattggcccattgctccgaactctgcccagaatacctctctgtgccatcttttccacatccctttcatgaagctggctaatgtattactctgtatccttcagaattttggcaaacaaattagtcaataaacatgtattgagtgtctgtcatatactaagcattctgcttagcgtttccctgacagtttctgcagaaaatcttccctgagaccacctggagcccctcctgtgtgccccaagtgcacccttgcactgcagcctcaggctgaagatcagggatgctggagccagactgtgtagacataaatcctggctctgactcctaccagctgggtgattacaatcaagttacttaaactctctgcttcagtttcttcatcagtgaaaggatgagaataacagtacctatcatgtaggattgtggggcggattaagtaaatgcagtatatgtaaatcacttggaatatttcctggcacagggaagtatgccctaagtggtagctattattacaagtattttgggcctgcatgcttatctgtctctccctctaaactaactctcagtcttcacaaatagggactaatcttacttactttctccttttctccagta

SEQ ID NO: 27337 - DNA, 1046 bp, Homo sapiens
aggtgacacaagttaacagtgaacgttagtgtgagtgttacaaaataccaggaagatcattgtcattattattttaagtgaggcatggccaaaatcctgtgggaagccttgtgagagaggtggcattgagctggtctgagaggctaggacagagacagtccagaaagaaacagcagtgtgagtgaaggcataggggctggaaatctcgtgtctgctcagccctccccatcagggaatggtaaatccattgcacccattttgtagatggagagtatgaggcattggaatctgttgttttctcctcagagaaaaagagagtaaaggggtctgatggacacagccccactcatgccttccggggtgacaccctgggggcttcttctcattctcagtgtcagattcgcgtgaattactgctcagagcctcattttgcctcctccctaaggtgtagctgtggtgatttgcaactccagcctttaaatggcatttacttctaatgcccacatgttcaattagaacttcttattaccctcagctctactatcttgcattgagccttctccctgcacctccatccttgtaatcaaaacagtgatcttccaagaaaggaaaagtatttttaatgggtgctgacatgtagtagtagtagttggatgtttttctttctcaaaccctgccacacacaccctaagtgattcacaattttccattgttgtgagccctagcctctgtctccctcggatcctggtttatttccctagtgccttttaaggtgctgaccccatactggatactgagtggatgattgttgagtgagtgcctgggcaagcgagcaggtgagcgaaccagtgaagggtctgcacagacgccatcttcattcccacccctctgtttttctcccccactgctttctgcccaccctcacctcccccacctccatgcagaccctcgcagccatccttccaggcctgggctcagcccttcatttctctccccatcacccttcatagccagctccttagtccatcccacctcttctgtctccg

SEQ ID NO: 27338 - DNA, 1032 bp, Homo sapiens
tgggggtctcgctctgtcacccaggctgaagtgcagtggtgcgatctcagctcactgcaagctccacctcccgggttcatgccattctcctgcctcagcctcccgagtagctggaactacaggggcccgccaccacacccagctaattttttgtatttttagtagagatggggtttcactgtgttagccaggatggtcttgatctcctgaccttgtgatgcccccgcctcggcctcccaaagtgctggtattacaggtgtgagccaccacgcctggccaagtgtcacttcttttgtgacactttcttgattccttgcctcaccctagttgagttactgaaaaaaagcaaattagagagtacatttgtgtatgaagctccgttatccctaatcttacgtggtaaagccttatgttgcaagtaggctagcattattatcctcattttatagatgagatgataaaggtatagagggattaagtgccttgtccacagacatacagctaggacatgagcccagggctgcctgatgccaaaatgtgttctttttcatgtactcagtgcctcaatgcatttaataagtgaaggtggtcacctgactgcaatcaaactgtggtgctttcatttattagaattaatgagtgcctcccaccccatcataccagtttagcatttaatttgttcctactagctgttcatttgaactggttacatctttgtcattagattatgttttgagagaggaactagaccttcttgtttatttgcaacaccacaggatatcgcgtggtgcctgttatatagtttaaaaataggaattaaatcatggtctctgatagaattttcgtggttgagtaaaggatctaaacagcgctatccaatacaactttctatgatagcagcataaaggatataaacagcgctatctaatacaattttctgtgataatagcaatgttttctatctgtgccatccaacaggtagccgcttggtatatgtggctatggagcacttaaaatgtgtgactaaggaac

SEQ ID NO: 27339 - DNA, 1030 bp, Homo sapiens
ttttaagtagatagaattgaaaatttagtttccagtttttaccagctgcaattcaggtgttccaatagccacacgtggctagtggctaacttactggacagtgcagagttaaaaaaagatgctcttccaagcatcaatacctagcttccgaatatccaggcttatttcatgaactgaaaatgcccccacactgaaagaaaaggattctgtgccctaatgttcagattgattagccctgtaggttctacctagggtgaagtcattttccgtagctgagatgctcacagactgtctctgagttgccttcaaaatatatgagatttataaaaattaactttttttcttgcttaaatacttctattcctgatgtgttgtctttccattttctaggaataatttttaatttatcccatttgagctctgttctaagtagaacgtctccccttctttatggactagttttggtgtaaagtgctcctaaatgaatgtttttaatggtgttttgtatcttggcctgaatgtaggtaatgggcttttattgcagaattactttaagactttctgtagatgtcaaaaccagccaaacaagtgaaaagttttgattaaccagttgtttaaattttactcaacaactagtttgaccagtttggaatggacatgggtagtgagtgaaaggacctatttctgtcgtataggaaggacatctgaacaagtgagttgtcccccaggattgggatggaggggtgtgcatgttgtgtgtattgtgactgtgtgtgctcaagagctctagggttttgtcatatcaccttgacacacatggtgcttatgttgactgttgaggatgttgaatatggagggatacagtttatcctaaataaatccccattgttaagttctggggtgatgaaaattaattggcattgtaaacagtgaaaaccttgggtctcaagccccttagataccttgtttgtctactgagaagtatatatcaggtcttgaatgtccacactgacattttacaatatggatt

SEQ ID NO: 27340 - DNA, 2116 bp, Homo sapiens
aaggttagctgagtacaaggcctgctggagacacagggacaagttggaggatagaatagaaggtgcccagtatgaggacagaaggactttggctacccccacagtttgtcctgcctgtaaacagagtggttgagtgagtgaaaaagggagagtaaatatataccgtggtagaagctgaattgatagtggaaggcttaccttaaattcagatgtagaaatggaactgacacatattctagtttttaaaataattttaatttttaaaaaaatgtatagcttttgaaaaggaaacctggaaatcctaagttatttttaatggctgtctgactagactgacaataccaggcactataactgctgacttcgtagcagtgatagtcatttctggcctagcactagcattttccaagctctgtgactcctcccttcaagcggtttcaaactccgacctgtcacccctttcctaggtactgcagggatgtagaggaataagacacaaagtgctcctgtcggagaagaacgcttgccagtggccagagtagcaaggccaggtgctttaagagaggcccgagtgccgtgggagttggaggccatttgtcatcattaggctttgaacttaggaggaatctgtaaaatcattagaagccccttaaggtttatgaatagggacatgatggagtgagcactccgctttaggaagattaatttaataacagaatacagtcttccatatttacaggttccacatctgtggatgcaaccagctacatattgaatatattttgggtaaaaataatacatattttaaaaatgaaatggtgtgacaattatttacatatcatgtgtacattgtattaggtactataatctagacacaaagtatacggaaggatgtgtgcgtaagttatatataaataccatgccattttgtaagggatcttgagtatccctagattttgatatccgtagcggtcctggaaccaatcccccatggatactgagggacaactgtatagtctaacttgggaaaggagcaactagaggcggggagacagtggtctcaaccagctgtgacaaagggcagattgctgataagaggctgtgtaggtgaaggagcaaagggagggagtatgtaaggcatcagtctgaggtatggaatctgctagaaactgggaccttgggatagattctaatggtttccaaggccttgtacctggaagacaggtcagtgaaagtgttcgtaatggaaataggtagctcagggaatgaggagccctgtgggggaaatgattagtaattcatgtccagaaatcttatgtttgtagcaccagtaggtcctccaaatggaaataggaggaaactggaaaaatagggtaatggttaacacctattgtgccctctgccagcaggatggcaaaggacataagttgtcctaaaatgatttcttattttaagtcttgtaatgctgttcgtgagcaacagtgtgaagtggtaaagataactccagataatgaggctttgatctgtagcacccagatttacactaacaaactctctgactttgggcagactgcaacctgtggacttagatattttcatgaaaatttgagttgggggaaacaaaggcatgggtctgtctaagtcctcccagtgccaaaattcaggaattctaagtgtcgaggtagtgtttgatgtttatatataataatttctgtgtgagagtttgaaaacggaaggatttcaagttttgtaatttttttctaccttctttagcatatctaatagttacttactgagtgctcttctaggtgcttgaaagcaaacagaacagtataaaaaattttgaagtttgtacttaccttctaatggccactccttccacatgaccactttgatgccacagtggctaagtgtctgcatgggtcatatagcacacattaattaggcagctactatgtacaaagtactgttaggtgtttcttatgtaaattttatcctaatagatttttcatattaaaaatatagcaatctttgctttgcatagtagtgcaggactataaccatgattgtgcaagctgaacccatgcaaagcaatctttataatcagtggggaaaa

SEQ ID NO: 27341 - DNA, 1052 bp, Homo sapiens
aatagattttggagaaagggatagataatattacaaagatattcaaaagtcgtctaccatggcctgtctccagtagcatggtagttttataaagtaactcattaatatctaaagacagtctatgtgtcaatagcaaatttgctgcactgtagcctattaaatattgaaacaaggagttagtctttacccatgtgtttgtgttatttggctatacaggttagcttacaaaatctaaatgaaagaagttgggcacaaggtgacagtttaagtaacttgaccagtgtcttaatttaaatccaggtgtgtctgacttcagagcccatgctcttttcaaggcgggggcggggggggcttcatcttattttgcctaaaacagctttattacacatggtcatgcttaaagcctatgtaaataggaaacatgtctagtttgtgttatgttacggtgttgagttagactagggattaaatgacagcagtgttaggtcatatatctttggatttaaacactttaaagactacagcctagattattacctttcagggtaatctaactaccatctacagagctagctactccttggtgattatggagtggcctgttagcattgttttctgacaatttaagaaactcctttttgatatatacagaaaatgtatccctggtttacttttcttgttttttccccctgggtttataataagtttgatacatttaattttgggagtgacatccattttgtcaagaaaacccaagaaagaattgaagtaggttgatcagtcaacatataattttttccttctccttcttgagacaggatcttgctctgttacccaggctggcgtgcagtagcatgatcatagttcactgcaaactcaacctctggggctcaagtgatactcctacctcagcctcccaagtagctgggactatagacatatgccaccatgcttggcttattattttattttaatttttttgtagagacagggtgtcgctatattgtccaggctggtctcgaactcctgggctcaagtgatcctcctgcctt

SEQ ID NO: 27342 - DNA, 1046 bp, Homo sapiens
gatttttaattgtggtaaaatacatataaaatggtaagctacataaaacacaaaggtgtacaatttagttgtgctaagtattctcatgttgttatacaaccagtttccagagttcttttcgtcttgccaaactgaaactctatacccgttaaacaataactcatcatttttcacttcccatatcacctggcaaccaccattcttaaatttagctttttgtctgttcctttcccgaacctgtgtagtggaatgtggctgggaaaaactaacatgtctgagttgacttttcctcctatttctctacatggacatgctattttctaaacccgcctctctgtgtattagatctgctccttctcatctagccaaggccattgctccaacaatgctccctctttctcctgcattctccattttttactctttactggatcattctcaatagcataaaaacatgaatttttcccccacttgggaagatttttttcttgacctcatatcttcctctagctactgcctcatttctctgttctttttagccaaaccacctgaatggattgcctgtgctgtctctctacttcccgtcctcccagttgctgatgacttccttgttgctgaactcaatggtggattctctgcccccatcttaacttcaccccagtagtatttggcccagtagattatttcttcttcctgaaaatactttcttcacttggtgtagtagttggaataatgcctcctgaccccccaccccgcaaacacccatgttttaatccacagaacctgtgtatatgtaatcttatatggccaagggacttggcaggtgtgattaaatatcttgagatgaggagattaccctggattatttaagagggcccagtgtaatcacagggtccttgtaagaggaaggtgggagagggggaatgagaaggaggtattaccgtggaagcagaggttggagcgatgtgctttgaagatggaggaagcaactgtgataaggcataagataattaattggtgatattccaagccactaaatttgtggt

SEQ ID NO: 27343 - DNA, 1063 bp, Homo sapiens
ggtttttgtagaactagtggtttgctggacgccacgagagggcattaaggtggagaaacagattagagctttggatgcgttctgtaactttccagtctgcgttgctctgcgcggttcattcagtggaatggggctggcattccattgctgaagaagcggaacagaaaggccccaccactggaaccaacgtacagagtctgaactgaaggttcttatctcaaaccatgtctccgaggcacatgagcagaaccatttattgtaaaaaatagagccgatttgctgcattaaagaaagcaaatgactagatacagtataaggtttttttctgagatggagtctcgctctgtcactcaggttggagtgcagtgacgtgatctcagctcactgcagcctccacctcccaggctcaaccaatcccccgtctcagcctcctgagtagctgggattatagattataggcatgtactaccacgcccggctaattttttttgtttttagcagagacagagtttcaccatattggccaggctggtcttgaactcctgacgtcaagtgatctggccgcttcacaatataagatttgagagatggttttagttcttttctttatccacgcttgctaaaaatttaggcagtctgctctcctgaacctaagatttttctctcacattctgtaatagactggtcctgtcccatcacatccctatggtggtggccgaacttgataaatgtatgccccttgaaagatgcgtgaatactgtgaattccttcagattgtccaaaagtctctctgcgtgatggggcagtacataaagtttacccacttttttaacattcatttttgtaacacagccagtccgttttaaaacttccaaatcagaatgctaattaaatattttattttttaatcctttcattgccttcaggatatacatagatgaaattctcagaactctttggagaagtagttatttgcttgcgagtctgttttcatcccaaagctctaatatacttaggttttgtgctttcctttttaactttgtatcttgctttatgtaataag

SEQ ID NO: 27344 - DNA, 1599 bp, Homo sapiens
ataaaaaacacaggtgaacataaaaccaaaccacttgatcgtacataatgtagattaaggaggcatttggcggttctgattgtggtttaaggtaagtccaaacttcctgtcaggcaataaaacctttttgtaaaaggaactagcagttgaagaagagaagcatgtttataaatggggagcagttagactggaccagacaggtatctgaagaaagacaaagtcagatgtgggaaggaggtgctgcagaccaccagtgggagattaaggtctgtgctctttaagaagctacgtattcattcagggagtcagcaaagcctgtgccagccagatgtacaaagatgggcacgatgcacttctcccctcaaagggcttatgctctagtcagggggaaatagcagcaaacaaggggttagggtagaattcaagataggttgtcagtaaggaaaatattctcacttgtgtctaccttgaaatagaccaagaaaaaaatgaagatgctaataataatttgatcagatgcttattaaaattgtgagagttatcaaatcatggacagtttctgaaactgtaatgccttcagcaggtctcccaaagtttgctagactgtatactctttgagtgctctcacagtgccaggaacatatttgttcctcagtaaatacttgttctgtgaaatccatcacttgatgtaacctttttctatagagaaaagggtttttttttaaggttgcattaaaagtggcttaacaaatctgatttaatgattggttgtaaagaatatgttagtacggaaaggtaaccatttttagaagtttctgtaggttttctcctttgtactacttttcttttttcctttaagtagaattatgctttattctgagataatcatctttttttgtttgtttgtttttgacttttgcttcagggtgtcatgattgactttggcctatgatgttggcccttaaacaccaggcaagggtggaaggaatgctgctgaaaatctgtgggtaatgtttttgtcatgaacatgagaaaacctagaaatggagaaggcacgtggaaggaagcacaaatggcagcccaaagaggaggttagagaatgtggagggtatagaagaaagcccattcagaaaggcaaaggccaaagataccagaaaagccttccagcttcacttccagagcaaagagaagctttgtttgtggttgacagaggtgactacattactcccagatgtctgctcaaagctcataagacatagcgtgagtgggttggatagggttcctgtcttgtcagcgtgaataaagcatgatacagacatgttctgttagcatgatcagtgcatgtggaagagtgtgtgtgtgagaaagaaacctatttgtacaagtattaaggaaagaaaaaaggtcaggaacctgcagttttcccttcttaactgtgatttttttttttttttttttgagacagactcttgctctgttgcccagggctagagtgcagtagagcaatctgagctcactgcctcccgggttcaagcgattctcgtgcctcagcctcccgagtagctgggactacaggcgcatgccaccacacccagctaa

SEQ ID NO: 27345 - DNA, 1304 bp, Homo sapiens
ttgtaaacatttcttggcagtcaaataaacccaggcagtttctcgaaggtgcctgccacctcctccacctccccttcttgaggatcctgacacaggtttgctgcagcaagtcagatatgattcttccctattcggggccccccacggctcttctgggctagggcaggtttgccgcagtaggtacttgccgctgaatggaaggcccacctcagccccccacatctcagtataaataatgcgtgcgctggagaggaatagcaaccagactgcttgggttttgccatgtcttctcttgcataagattggtcgtggaggaaaggcaccctctgaagatgagagtgctggagagagcgttgtgcgctgtggttgagaagagtgcgctggtggggagaggagactgatgggcaagaacgctgcagcaggctcgtcctgcagctgtaaatggcacaggactggagctcttgaattccagttctaggcaggggagcgtgggtgttggatgaaaggtttagtcctgtgttacatacaggactaaagtatagtcctgagtaaagtgtctgaaacaagaagcatgtgaccacctgggcacatcatttttctacctgagtggtacttggtgtactaaagagattatgggatgcagcacacttagacaaggtggaagaatctgagtgggtctcatcacgttggagttggtttttatgggatatggaaaagaggcccggatttcttctgagagcaggagtagctgaggagccccgtggcagcagagctcgtgaactacacttgtgtgagaagacaggctggtaagttgagacacgagattcttggattttcctgagacctttctccttcatctctccagacccaaagagaataacctggaaagtcagctagtgagggtctgcaagacccaactgagagagcttaagaaccagagaatttggaggcaggtgaaggctggagttgtatttgggggagttttgtttggagtcagtcttttttttttttttttttttgagacagggtctcactctcacccaggctggagtgcagtggtgtgatcttggctcactgcagtctccacctcctgggctcaagcaatcttcccacctcagcctcctgagtagctggaactataggcatgtgccaccacgcttggctaattttgcattttttgtagatggggttttgccatgttcgggcacaagtgatccacctgcctcagcctcccaaagtgttgggattacaggcgtgaaccaccttgtctagcctggagtcactgttaatttcttctgttggtc

SEQ ID NO: 27346 - DNA, 2103 bp, Homo sapiens
catctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaacattgtgtgattttttttttaaactaccctgttactgaaaacagtgcctttctttgtaagcagtgggtgattagtaatcac

SEQ ID NO: 27347 - DNA, 1050 bp, Homo sapiens
tcttggttggtcttaaaaccatgtaaggatttgcaaaagttagtgaatatgtgtgtgaaggtcattatgaggaggtttttggacaataaagatttttttttgtatagcaattaaacatgacaaagtatgtagactgaattaaaaacacatttcataaaattttttttttcttttttttttttttgagatgcagtctcgctctgtcccccaggctggagtgtagtggcgcaatctcagctcactacaacctccgcctcctgggttcaaacgattctcctgcctcagcctcctgagtagctgggactacaggcacccaccaccacacctggctaatttttttgtatttttagttgagagggggtttcgccatgttggccaggttcatgtcgaactgctgaccttaagtgatctgcctgcctagtcctcccaaagtgctgggattacaggcattagccaccgtccccagcccataaaatattctttataaggattgttatagaaaaattttcttggttccgttttgtattatttggtcagtttttaggcttagcactaatagaaactgatgggacaacttatgttaaattcagatactcaagaaacttgtccttgtgtgtctgatcagatagggacacagtatccagttcttgctttagcacatggaagaaactcaatctttaaggctgaaggtttaagtctgtagttgtgccccaaagtaaaggtgaaaaattccacatgctcagagaacaaaagtgactctaatcatgatagcttgggacctagaaatggattctgtttaatacgaggtactcatcagtgttagcaggtgtgtttcctgacatgtgcaaagactttttgggcagaatagttgattttctttggtgcgagatgatttaagttttaaaattaaggtgcatggagtttcattctaactttttatagatgcggaaagtaacttggtcaaggctacatggttagcttctagcacctccaggactagaaagcaggcctccttcctctggacggtgtcccctttcgcccccgacccct

SEQ ID NO: 27348 - DNA, 1050 bp, Homo sapiens
aacaagagcaaaacttcgtctcaaaaaagaaaaaaaatgtattttccattgtgacccagaacatatgcatatattacaaaggaaacaagtttcacagaaacattgcttgcctttattatgtgtgatgcctttatcatacatcctataccatctaattaaaacaagtattatccataacatttatttcatgacccatagtttgaaaaacattgatagtttcatgacccacagtttgaaaaacattgatagaggcaagatgtttgcagcattctttatcatgccaatagtctatacatctgttttatttatttctgttaatttccaatagtataatttgacatgcatttctgttttgtcttttcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaagtgtttctaaatttcattctcttatatgaaaatgtacatttgttcttgaagaatttgtttaatgttaacttttttgttcttttttctttgaaaagagctgtagtagaataacgtcaactttttaatggatttctccccaacgtagtatgacttctcaattttgatcttgtttgagttgagggctgggactcggagtttgtggaggttataaggagtgagttgtactgttttgctgctgggactttttactagttatggtcaattctccacttgagctgaaggccaagacaaagacttgaatgtcaaacacttcccccaaagatctaggcttagtcttctgatttccatttagagtgtgtttggaaggcctcatccctacctctggatggcccctgactgaagactcatgtcaagttttcaggctatgtgtatgctgtgcttaagctctcccctgtccccatcccta

SEQ ID NO: 27349 - DNA, 1050 bp, Homo sapiens
aacagttgtaaagtaagagtaaacagttgatctttcttcctgttgtttgtgcatttgcataatctggagatggaatgtgactgactttatatgattttctaaatgctacacatacttaaacattaagtggagaaaaaactctaaaatgttctattttgcatatctaatctctatggaaatttgaaatgacctgtatttactttttagttcacagagcaaataataataatatctaaagggtaaaaaccagcataggcttgatattcaaaaataagtaatttattttcttcttaaagcttttgcttgggaaattgtatgtttgatatgtgaaaaatgcattatctaaaataaatctgatatttacgttgagacgaatatactgtcaatttagaggtttttggcaataaaagagattgacattttaaatcagtctactgagataggaacgtgtaataattctatatggatattttcttttgtctaggtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaaggtaagctatacctgtctatctggcccattatcagggtcatagtaaaatattcataaacgttactatagtataggagctgatttcattgttagtcctctgaacagtgacttcatgtgttcagttaaagattgtattaatgtgaatgttaggagagatgggcttatgtaatgtttactaggagtttttaacaggtatgtgttctttaaaggtttttagctttgcttctaaaatctcatacctgttagatattaaaatactgtaacatctttcccttctactcaaaaaaatatacttttgcctatcacaattcttgtttccatttaggctaaacacaactaagggagatgcatctaccttaatagg

SEQ ID NO: 27350 - DNA, 1676 bp, Homo sapiens
aagggtctctgctttctctcagaaatgaattcttagctgttactataattcttagctattattattatcatctcagaactaggatctatgtctgtgaacattatactcgtaattattttgaatattcttacaaatctttaatttagaaaagttgtgaatataaagatttttgggaatataatttgagaatgccatggttgagtttagggatgtctttgcttgctttattttgttcaaattcagacactttatattcttccattttcatattataattttatccacaatttgaaagtagtgcttctgggataggtaaatgtgcttacttacaataagtgaaaactttaaaaaaatgactattgggttattcttgtctttatgttcatgtaccttgtattttgagttttctgtaccatgtttatatttattaatttgcattttctagaatgaatcagtcctatttttcttttttctttttgttaagatgtaattcttacaatgtaacttttgggtatagagctgttgacactgaaatctgtgaatctagaatggctcaacctgttgcttggttggtgggcttgcttaaagggaacttatagatctttttgctctccagggagtttgtaacagctttgctcaccctcttgcaccagaagataaaaaccagacttcaaatcatacgtgaacaacatcttactttaaaatttttccttgctggggagaggatagaagctccttttctcctcattgtgttcagagatgataaaggctgttacattacccaggagatatgaggtgtccaaatagttaaaggggttagaatgctaggtgccaatcttgaggtctcaagtctggtgggaggcatgggtatattaactgttttttaagtactggctgccatcaaggaattctgccatgcagttcacctctaacttaaagtgtttgcttctttgaactggttagcttttgatttacatgacagtacactgtgctttgtaaaagtaacattgagctgggaagggttaatgaactaaaattttaatgcacgttatgggcacttcaaaacctcagttctttgtagttgtgtaattttcttcgttcattgttttgcatgatacaaaaatcataattttggacctgaatgcacaatttcctatgtttttgaactagcttgtggtatcgtaaagcttttaatttaacttttaaaaagctaaaaagcttcttaatttattgtaaaatttcaccatctttaaagtattttataattactactgtcctttgatttgtttccatttatttctattatcttgcagcatcttttatccaaattcttctttcttataaatcttgtaagtaggaaccagaagcttctccttaattgcagtcatgtttttatttttttcataattccattaaaaatttgattgtcattgtctcttgtagtttttgcacttgggaagaaaaatacttttctgtgttttgaatggggaagattgttggcaagagcaaattaatctgcctgaatcagtcccattatttctgtatactagtctggtcatgtcatgaattccaggactttgcactaactgtgttttggcttttttttttttttttttttttaaagctttaagcttatttttatacagatttagtgtttgatttgtatgcattctgca

SEQ ID NO: 27351 - DNA, 1045 bp, Homo sapiens
ccattatactttagactttgtcacttttctcctaaattaactcataatggcctcccgttcttcttgacactgttttgccttccttaactgatcattcacacaagtgcagaagtgaggttaatatcaacagagtatttagatatctgcatacttgctaggttctcaggagatagaattaaactgaccctatcagagggaaccaagtacagaattttatagatatgaaaaagaatggtatatacaggcaaataggcagggttatcataactatcggcgcttggtttaagcaacagaaaccctctcaatctgacttaagtaaaaggagaagaagttgtgagaagctagtgatatttattaaattctaaggtcaggaaatgcagtatggcctcatgaagagcagatactcaaggaccaaaacaactttattcctctctctttctctgtcttcctggtctgccagaactgcttcattcttctcttctctgcagatcattttctcttattgtagtgtgcttctgagttcccagttttcattagccgggcatgatggcatttgcctgtagtcccagctactcgggaagctgaggcagaagaatcgcttcaacccaggaggcggaggttgcagtgagccgagattgtgccactgcactccagcctgggcgacagagtgagactccgtctcaaaaaaaaaaaaaagttcccagttttcatggccttggtctaggtgaccatcaggaccaattagtatctctgaattttaattatagactcctgggaaggaggatctaattaatctgcctgtctctggtctagtcagctacagttgtgaaggtgggtcacataagggtgttggagctcacccacttgttgtgggggcatgtttctcaggaactctgggctggggagatatcctaaatggtactttggtagtaggggagaaggctatcaccatgaactttctgactgagccataagactgaatgggtggtagtaggacaaaccaaaacaacagattcatgagagggcaagttattagtttagtttt

SEQ ID NO: 27352 - DNA, 1095 bp, Homo sapiens
tagtgtgcagtgggagaaataacacctgaaataaaggagaaaaacagaaggactggccgggtgtggtggctcacgcctgtaatcccagcactttgggaggccgaggcggatggatcacccaaggtcaggagttcaagacaagcctggccaacatggtggaaccctgtctctactgaaaatacaaaaattagccagcgtggtggcaggcacctgtagtcccagctgcttgggaggctgaggcaggagaactgcttgaacccgggaagcagaggttgcagtgagccaagattgcaccattgcactccagcctgggcgaagaagtgagactccatctcaaaaacaaaacaaaacagaaggactaagtaaaacatacctggatacgtggaacaaagagactaagagaaggacgaagaaaaatgtaagataggtgagaatggaaaactgagagcaaaatggcaggagacttgaagtgctttttggaaaggaataattgaaatatggaataggcaggaagttactgactgtaactaggaaagagccgaaggaagacttgtaaaatgtcgtattcagatgtgtagggcactgtgactacatgatcctggaattttactgtagtcattttaagacaatcagctaatcaaattagcatgcctaaagaaatttaccaaagtttccaaatgtttacactagaagcactgtttcaaatgatttgtgagctcctagaaaagaacactgatttatgagaaagttttttttttttgttattgagtcaataaagttaagaagtgtctgttgttaggtaccagggttatagtgccgaacaaaatctacaagatttctggccccctaaaactactgcatagaagggaaggcagatgattaaataagcaaacaaccattgtaaagggtgttaatagggtcattaaagcatgttataggagccatagcaggaaaacctaatctggttttaagaaggtggcctggaggaaaagatattctagctggtatttaaggtgtgccttaactgtaggtaaggaggtagaagcagattgtcactgacaaaataataataacgtgtaaattcttcagggtaaa

SEQ ID NO: 27353 - DNA, 1430 bp, Homo sapiens
tctcatgatttttacataagcaacattagagcattagaaatatatacttgcctaaaatcccatccagcccagagtttgtgggaaagtgtgatagttacttttcaaccaagccctcaaagatcacagaacatattttctaaaaactctttgctttagatgaaattagctaaaaaatgtcttgagagagaattttttaatttgtagagaataattaagatgatatttcaggacagcacagtccatatatttgccactcacttatgtaaagcgattagaaaattagatttcctattatctgtttgggaaaatgagggagatattaattgtaatgctattattttcttccagaaaactttcccctctcagagctgatgacagagatcagtactggtgtggaaactactgcaaatagtagcacttcactgaggtacactctatttgcttgaagttcatcagcgtgtctttttttaacatattgattgcagcttaataaataaggaattatgaaacgaaagagttgtagacaactagaaataaaaacaaaaaagatcaaagaaagaagtttgtatacaatgtacaaggttatcaaattattatagcatggatttttttaaaaccactttattgaagtataactgattgacttgttaaaagctatacgtatttaatgtatacaacttgatgagcttggagataagtatatatgcatgaaaccatcacagcaatctattcctgaacacttctaccatctccagaagttttctcctgcccacttaattcattattattattattttgtaataagaaccacttaacataagatctaccctcttagcaaatttttaagtatacaatactgtattattagctgtagccactgtactatactgttgatctttaggacttatcctgcataactgaaactttataccaccttttggctaatacctccacatttttccctccctgcagttcctgacaactagaattccactctctgcttctctgagtttattttagatttgtcatataagtaatatcatgtggaatttgtctttttgtgcctgccttagcgtaatgtactctagattcacccatgttgttgcagatggcaggatttccattttaagactgaataatatttcattgtatgtgtacaccacattttccttgtctattcgtccattgatggatatttaggttgcctccatatcttagctattgtgaagaatgctgcagtgaaaatgggagtgctgctatctctttgagatcctggtttcagttcctctggatatacaccctgaagtgggattgctggatcatatgaacattctatttttaatttgttgaggaaccatactgttttccacagtggctgtaccagtttacatttccaccaacagcatacaaggggattcccttttctccac

SEQ ID NO: 27354 - DNA, 1063 bp, Homo sapiens
tgtgtatatttctggggataaaatatcgggggctgtagctgagccaggtcaacattcactcctggagccctggtggaggtgtcctggtgaatctttgtgtttcaggttcaacttgcctcgaaccctgtgctggatgcctggtacggtgctcgtgactgggccttgaaccacctagatgataatgaagtttggatcaccaggaaagagtatgaagaaaagggaggagagtacctcaaggagcactgtgcttccaacatctatgtccccatccgcctgccgaagcaggcctcccgctcctcagatgcccaggcatccagcaagggctccgctgctggtggaggtggtgctggtgagcaggcatagcagaggccctccagagagactgccctgcacgccatgccttgggccacgttggcagtgtgacaggactgtgattgtgctagatgtacctgcccaagtctgctggtcacatttggcagcaaaatggatttctcctggggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaaattctttaaaatttatcttgtccgtgtagatactttattcttctggatgtattcagaaattgcatgaatgcccagtgaggggaggtctttcatgcatataaaaaggtaatgtttattgccgggcacagtggcacgtgcctgttaaggcccagctttgtgggaggctaaggcaggaggatcgctggagcttaggagttcgaggctatcgtgtgctgtgatcgcacctgtgaataaccactgcactccagcctgggcaacataggaagacattgtctctaaaaagatacatttttcataaaaggtaatgtttattcaataaaagcagttgcctcaggaaccg

SEQ ID NO: 27355 - DNA, 1069 bp, Homo sapiens
aagatgctcagtaaatactgtaggggcctattatgtgcacctttgctcattcagctacatgctttgaggagaaataaagggcagggggaagggagcggtagataggaagaaaagtagttcaggtgattctgtctgcctttccactcagcaagtatttgtccctgggtggctgtgcctggggtttgtgaatctgccagccccttccttgactcttgtttctatatacctttcaaagtgtgggcattctgccacactgaatgaggtacagtgtttaaaaacaaatggtttggccatgcgcggtggctcatgcctgtaatcccagtgttttgggaggtcaaggctggaggattccttgaggccaggagtttgagaccagcctgggcaacatagcgagatcccatctctacaaaaagttaaaaaattagccgggtgtggtggcatgtgcctgtagttccagctactcagcaggctgaggcaggaggattacttgagcccaggagttggaggctgtagtaagctatgatcatgccagtgcactccagcttgggtgacagggcaagaccctgtttctaaaaaataaataaaaacacaattacgtatagcatggcttgaatacaagctggctgcttaccaggtgctcaggcgagcttcaccaaaattggaggaaatactgttttgaaccttttgagaacccatatgtttgtttcctaagcaagtttttggataatcttgaattatacaggatattttccctacatacttgctgtagatccacccctccaccactgtatctgttgatgacgcattcagctttttgcctctgttgctgtgtgaactgggatttggctgggctgtggccgcctgcctggaagggctacatagcctcattttggcaatgtgcttatgaattggctgtccggctattcctggtttgttgaatgagagttcagaggcaaagctggtaccaccacgaggttccaattcctcagagtcacgtttcttaccagtgcctattctcttttgttccaaagaggccacttttgctatgacctcaccctcgggcatcctc

SEQ ID NO: 27356 - DNA, 1028 bp, Homo sapiens
gtccatagattaaaatgcagaagttgaacttgtattgagacaacacagtcagcaagtcctagatttcaagccttggcccaggtctgcaggggacgaactgggggttaacagcaacacacagtctggaatcctggttccttagggatctggacccagcttgccctgctcacttgaaggtaggggcagttgcaggcatctccattagtgttgaaggcagagccagagctgtcagctttagactcaaatcctccacgttgcttcaagccttgtaatttagagctttagtctagaaaatactgattatgtttctgacccacctttgaagtgtcacattggcaatggcatcttaaggtagagagcaggaaggttgaagagagggtggggataatgagcggtttacatgaatctctagaatttgtgccatttgtacatatgtggctccaatggttgtatgttctgccgcctctgcggtagattgtctgatggtttgcatgaggtgtgtctgtagaattttaaaaagaaaaccccatttttgaagaaacacacaaccctgagtgataattacgtgtcagccctgggtaaaggtagaaatgtgaaggcttgtggaaaatgaggcagtaagatcaagaaaatcttgacacctttctttttcaacagtaccctcattgctcagaacaaaatttgaactttcttcaccaaagaggctgtgggaaaaaacaaattgaactctttttcttggaatttccttttgtaagaagtttattaaaaaaatttgtttttaacctaagtaggatttatctatattaaccaaacttagctacaaatggacttttgctgttctaaaatataaaaactaccctctccaaatgaaattgatgacgatgatagcttccatttgttgaggaggttttataatcttggtgttggataggtgctttatttacattatctcattgaaggctttcttttttttttttttcgtgatggagtcttgctctgttgctcaggctggagtgcagtggcgccat

SEQ ID NO: 27357 - DNA, 1071 bp, Homo sapiens
cagtgagccaagattgcaccactgcactcctgcctgggcaacagagcgagactccatctcaaaaaacaaaacaaaacaaaacaatgttggaactaaagcatcaagagattgttaaagatcactgcctcttccccagcaccattatgaggccacctgttcccttgtctgccttctttaggctgctgtatagacaatagtgactctatcttggatgcaagtctgccatgttcacttctgtttagacccagtcttataaatgcctcctgatttctgctttgtatattgtccttagtgtaagaacatgtcaacctctctgggggcagcactattgacagcttcttgttttgttttgtttttccccaaaaacagtctacgcataaacaagtagatacgtgtttgccctaagaagaatgcagttactagggtattattcacactgttctacatctcacttccttttcttaacatatcttatagttcattccatatcagtacaagtagatatttcctcttcttaataactacaaattattccattattggaatattttatgactgatttaaccaaacttttgttgatcaacatttaggctgtttgaatttttggctattataaacaactctgcaatgagtatgcttgtatttatgtctttgtacacatatagtatgtagcagtatgtctataatttcttgttttttttgttttgttttgttttttttttttttttttttttgagacagagtctcaccctgttgctcaggctgaagtgcagtggcatggtctcgcctcactgcagcctccccccgcctgggttcaagcaattctgctgccttagcgtcctgagtagctagtattacaggcactttccactgcgcccagctaatttttgtatttttagtagagacagggtttcaccatgttggccaggctggtcttgaactcctgacctcatgatccacccccggccctggcctcccaaagtgctgggattgcaggcgtgagccacctcacccggcctataatttcttataagtgaaaatgtaaagggcgtatgcattatgtattttgat

SEQ ID NO: 27358 - DNA, 1044 bp, Homo sapiens
ctttagataaatgattatattgagatataaggtgacttagaaactggaggaggcaggccatagaaagctattgcagtggtctagagaaggatggtgtaacggggtcctcaaccaagaggtgatagtgggataatctggtgaggatgggaaggagaacaatttacaattttagcgttagggtctgtagacattagaaacttaggttggtgcttttgcaccaatctaatagatggatatttgtgatgacaaaggggaagggacaaaggtgcacagtgactgatcacgacttgctgccttggcgaacagtgctagtattaaatgtgatagaaaagtaaagattgtttttttgaggggaaattaatgtgtgtgtttttaaacatatttattttttcctatattattgatggcctttgatgacattagcaggaagtttggaatgggaatctgaagcttggcagaggtcagacgtagaaggtgtggacatagggattgaacatcctgatacatgcaggaaggagatggaacagaaataactgagaagaggattaaggacaaagtccatggagcatcaacattcaggagtcaggagcagaaaggagatagaatggcagccagggaaatgacagaggaaccagcagactcttcatggttagagaaagcaaagacagagtgaggtttctggagaggtgggtaggtggcagtttcagccaacagagcggccagggagcaggagaactggttcagtcctgggttattcatcttggagatagcacgtccagtggtagggttttagggttaagggtgtctaagggtaagatgataaaaatccctttgcatatttgaatatgttaacaatgtgttgttgactgtttggtccagacttgtggtcatgccaggatctgtgtagatctttttttttgtctgctccccaactccattttgaataatgggtttataaataggttgggacccagatgtaggtatttttttaaagtttcccaatagacagctagggaaaggtagacagacctagtaaaggtagat

SEQ ID NO: 27359 - DNA, 1008 bp, Homo sapiens
gggaatccaatacctggatattggcaaggtattgccaatagagggcaagaagggcaggtggggagttgaaagagtcagcccagttcagcaaaatgttcaggaggcagttgcatgaacagggctggtgttggcaccagagggatctgggttagtgtttagattccaagttgctggccctgtagttgctcattgttgttctcattgtggctaataaagagatactcaagaccgggtaatttataaaggaaaggtttaatggactcacagttccacatggctggggaggcctcacagtcatggaagagcaaaggcatgtcttatatggcagcaggcaagagaacttgtgcaggggaactcccatttacaaagctatcagatcttgtgagacttattatcacgataacagtatgggggagactgcccctgtgattcagttacctccactcggccccgcccttgacatgtttacaattcaaggtgagatttgggtgggaacacagccaaaccatatcactcatttagtatgagaagggcacaggacacgggatgccatcgataccatcctggcacatctgtggcctgtccggtcctggaggtggtagaaagtccagacagtgagggggcaatggagatggcagagaaccaggagagttgggggccgggagctggcgaagagtagttccaagaagcagcggccagcagagccgagtgctgctgaggccatcaggaagatgccttgcgtttggtgctacccagttgttaggttcttgggaagagtggtctcttcggagtagtgggaacaggtgaggctcttgtggattgaggagagggtacaagcaggagaaggctgcagggggatttccttataattaagtccttgaatagaagtctttagaagtatcagttttttaaaaaattgggtattcaagagctcagtggagatcttttcttcttttaaggtaatggcactctagtgtcaaatggagtttggtgtagtgcatgaatcat

SEQ ID NO: 27360 - DNA, 1600 bp, Homo sapiens
cttcagtgtggtgcaaggaaagtatcagaaaatgtctttcacttcttgttggcacattatatggttgaaaccaaacatgctttttgttttacaggaaacttcggctgttctcaggaaattctaagcatcgctgccatgatgcagatccagaatatctttgtggtccccccaaaccagaagtctcacgcagtaagtcagctctgtccccaggctgtctgtaccagtctcttttgctttgagctttcgttgtcaaaactgtactcaggaactgctgaagacagagctgtacaaatgtgatctgctcatgttttgagtgtttattccgtgcttgatgttgtgtcaggtgttttgcaggcatcattccactttatcttcattataagcctgggaagtagatattattatcatattttatttatttatttatttattgagaggaagtctcgctctgttgctcaggctggaatgcagtggcgtgatctcagcccactgcaactgcactctgcctcccaggttcaagtgatgctcctgcctcccatgtagctaggattacaagcgtgctccaccacgcccggctaatttttgtatttttagtagagatggggtttcaccatattggccaggccggtctcgaactcctgacctcaggtgatccgcccttgacctcccaaagtgctggtattacaagcgtgagccaccgtgcccggcctattatcatattttaaagatggaggcatagagaggttaggtaactcattcacagttgcacagccagaattgttggctctggattcacagtccagagccccacaccttaaccattgaactaccaacttctagtttctgtcagggaaattgtcattcagactgctctgctagaaaccttggtgggcacattagtgacataagaagtcaggtgccagggtatagcaggctgattctgggcaccacacgacatcatggtcatgttgcaggtgggccattataagctagagagatccaatccccacctaaggtgcaggcatcagcaatgactaattgagtgaacactggaaagacggaaggacaagttttgatactgaagagatagatactcagaagtaaggtgtgttgatagaggtaggtcagagatgagttcaaagtcagttcctgtttgaaagtcagagaattagcagccttatgcatggaggggctgaatttgtatgtgtaatgaggaggagagagactttcttagggattgttgggatcctccttgtcagttgtataactatagattacaaagtttttctgcctctgtgcccagatgcttatgtctgtttttgtttagttttgtttttaattaacctggaggaggagagagacaagaacactaacattttatcaaatttctttgccagataccttgtaataaattatcttaatccacagcaatcttgataggtttagtttcctgattttacagataaggaaatcaaggctgagagaggttaagtaaccaagctgagttctttcaagatatggcagagctagaatgctgcaaactaggtctttctgaatccataacccacacgctattcaccatgcaatattacttccagtg

SEQ ID NO: 27361 - DNA, 1038 bp, Homo sapiens
tgaggatctcacctgagagtgctgctccaggtttgcctgatggtgggcgtgggcagtgggagagaaatcacagcattgacggtcttctcttctccaactcagcaccctgaatcgagttctggtcttgagtgctaattggtctgctctcctgctgaaaagtggccaaagtgaatttgtttgcaatgtgaagggaaccttgagctctggaggcccagtataatgccagtgcttaatggctctgtggagttctgctggatacaaaggagggagaagagagggcatctcttcttccccctaacatctcagcctgtgggagtgattgtatccctgccacttgtctttctaaagaggctgagccgcctgagggctcgaagtcatgcctggtcaacttcttcccttccaggcagagctttgccacctcactcctcaaaaagccacataaaaagtgagatgggattttaaagtggttttatatccctttgtatacgatatggcacatctggaataaggagtgacatggaaatggatgttggtgggcctggtgtacttcaacagatccaacaactggataagggatgacatcactggtattttcccaatatgctctggagttgtaaagaggctgctacagcagcattgctgggggactctttctaaggtccaagtgctctaagaactctgagtagaatatggaaaactgttcttgactgcctggcatgttgactcttcctgttctatagactctgtgtttctggtcataggcatagtcatatgaagctcattccccaggacatgcagatgaatccttgcatgggcctttgatcctaacaaggcaagttaaattccttccctaaattgatgttatgaaaggaatgatctctctggtctcaaggaggcatggaaaaagtcatttgcaatgggaaagcctgagaatgacacatggagaaaagtagatttgaacaatggaaaaggtgactacatagtgaccacactgttcaagtgccctgatgcagctgtatcttaacccctggattttct

SEQ ID NO: 27362 - DNA, 1028 bp, Homo sapiens
attttatatgctggccaaatcctgtttctgactttcctggcacagccctggacatgcttctgtatcataggacttgttccccagcgcctttgctacttccttcaggcacattcctaggaaagattggcagtggggtttgctctttgccagcactcctgccggtttgggggttatggatgccaggttgggctccaggcactctgctctccatttgtggaggcagggacggtaacagcacctgacaagtagggatgatcacattgtattcagaagcctggtggagctctataaacccaaatttctaacagtctccaatgtaatgccctgtaatagaagctgtccttaaccctcaatcatctgtattcagctagtataaaaatgcaaatctgctcttatgcctaaacagttaggagtagaggagacttggcttcctttggaaagtcaggatgatagcttcatcccattctggtttttgtgattaattgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatgaaaaaaaaaaaaaagaaagaaagaaaagaaaagaaaagaaacaagcaaccccaaaggtttttatcctttcaggtatccaaacatctttattctagaaagtttctcctcgatggtaaaataaagctaggaccttatagcaagt

SEQ ID NO: 27363 - DNA, 1046 bp, Homo sapiens
aagtaaggaagggatacatttttaaataaaacattgcattttggtaaaaaacacagattatgagaacacattgagttagaggaacatcatattgattccaagaacaaaaagcatggtggagaaattttgtaaccatgcaaatccagtgtgctctgttctcatgagttaaaaagaattttcctcctatagaaacttgttatttaaatgtgtgtcacatgtaaataacagtctaatgagagcaatatagagggagaaatatgtaagcaagggaaagtgggcattgttttgtttttttttttctccatctatttcaatacttgggtctttcctaacctatagtgtgtcctgtttctccctggctagatttcttaaagtttctgcctattcatcactcaagtacctatctcaagttgtagctacttttgtgtgcagggtgtaatagcagatgttctcctgatctagattttgttgctctgcctaactgcatgccatcatttgtttctccctttgtgatcttctactgtagtcaagtgtccctttagaacaaacttcatgggatggacatagcctaatgagctcattgctgatgaagtctttttttcctgtgcattggttagtgcagtaagcaaggctccttaactgcctgtcccagtgtactgaaaaataatagtgttctctcaccttaaactacaacttgtggtttttgcttattgcttctttagtctttgaccacatgcatgtttttacatagttgcagttattttattatattcctttttctgtcataaacactttccaaatgtgtttgtggtactcaaattatagcttagcagttaaataatttgatatattacagtttcccctcttgttaggtgtatccaattttggggtttgtttgttcgtttttgtttttttctgttgttgttgttgttgtttaagggaagcaccaaaataaacctctttttaaaattaattaattaatttttttgaggcagagtctcgctctttcgcccaggctggagtgcagtggcactatctcggctcac

SEQ ID NO: 27364 - DNA, 1053 bp, Homo sapiens
tacattcatattgttgtgcaccatcaccatctccagaactctacatcttgcaaaactgaaactctgtagttattaacaattccccacttctctgttgccccagttcttttttttttttttttttttttgagacagagtctcgctctgtcgcccaggttggagtgcagtggtgtgatctcagttcactgcaaccttcgcctcctgggttcaagcaattctcctgcctcagcctcccaagtagctgggattacaggctcccaccaccattcccggctaattttttatatttttggtagagacggggtttcgccatgttggccaggctggtctcaaactccagacctcagatgatctgcccgccttggcctcccaaagtgctgggattacaggcgtgagccaccgtgcccagcctattcccccagttcttggtaagcaccattctactttctgtctctatgaatttgactactttaggtaccttgtattaatagtcatacagtatttgtcctttgtgactgactcatttcacttaacagaatgtcaacgctcgtccatattgtagcatgtttcagaattttctgacttttaaaggctaaataatattccattgtttgtcctgcattttgtttattcattcatcttttgatggacatgggttatttctgcctttggctgttgcagatagtgctgctgtgaaacattcgtgtacaagtatttgtttgaatattgagtatattcctgggaatggaattgctgggtcatgtggcatttctgtgcttaactttttgaggaactgccatactatcttttccacattggctgcacctttttacgttcctaccaggaccacacgagggtgctagcttccctacaccttcaccaacacttgttattttttgttttattgccatccttatgagtatgaatggtatctcattgtggttttgattggtattttcctaatgattattgatgttgcatatttttgcaggtgcttattggccacttgtatatcttctttagaaaaatgaccattcaagttctttgccccac

SEQ ID NO: 27365 - DNA, 1036 bp, Homo sapiens
agagcgctatcctgaaggcatcaagtggaaattcctagaacataaaggtccagtatttgccccaccatatgagcctcttccagagaatgtcaagttttattatgatggtgagttgtttcaaggttcttgattcttggccaggaaaagaaatctgcttctatttagggatagaaaacaaggaaggatcctatgtaatagataatcctttttatttcattttgttttattgccatgcaattttgaggaaggggcatcaggtgttaactcttaaaggctcatttgctgctgaaaaagtgccatggaaaaggggctattcatgtcttccctacatagtccaaaaaaggtttgtcaacatggctaacagtgtgtggtccacaagctgaaggttttgatctgaacttcatttctagggagcaactcttcgcaagagttattagaaaagcctcacttgaatggtagtattttatgttagcaatataacaatgcaatcggacaagctgctcatcactagaaacagtattagtatatggtcgaggattaatagtctgccatccatctctagatagggctggtaggcatctgtcacctattctgtgtagcataacactatgcctttgatatatgtgcaatcaagtctgatgagctgctttaaagaaatgccctgcctgggtctcttagaaccctcagaattgtcccttatctgtcgttggtatttgtatccttgggtttgaaggatttgagggtagcctttgacatgcctcctgttggcagtgtagcagtatgtagatggtaataactgattttcttcattccatgagttttatccagaaatggttagagcattgttcctcatacccttatgtgcttatgactcaccaaagtggatctgagcccatttaacagttgtggggtgggcttcttttccctttccccaccgtccctcttcttctttcccctttcccaaccatccttccctcttctgtcccctttcctgacagtcccccttctcctttccccagcattcctcttccacctc

SEQ ID NO: 27366 - DNA, 1033 bp, Homo sapiens
attaggcttttcatatgggaaatctgggcttgcctagtatggatatatatttttttattcatattccacccacctaactttgaagaagaaagatgcctatttcttttccccacaattcctttcttccactccctgccctatcccttcctccccttcttgaacagaggctgcttagcttagcagtggcaggagtccctctgaggatttgatttttaaaaaccattgaagaggtgtaaaggaccctgcttgctgaaaggaaaaggaagagtgactgggcctcccccaggtcatccctgtcctgagcaggcacctgggaacaattaactggcatagtctccagagaatgacccaggtaaatatatgctaaagagaaggagaatttgtacaagtagatataaatcagtatgttgtctttgttgttgttgctactatgtgtcaccagacctttatataccatgagaaggcaaaccattattaaagagaattcgctagccctgggtatttatgcttagaacatgaatactatacctcactttttggaaccacttttttctctaggtaaagtcatgaagctgagccccaaagcagaggaagtagctacgttctttgcaaaaatgctcgaccatgaatatactaccaaggaaatatttaggaaaaatttctttaaagactggagaaaggtactgtagcccatgtgttaatatcctagtaccttgcaaaacaatcaagtactaagtaataaattatcattttgcaaaacatttcctgatgtaaaatttgagttgtatggattttgttgtatttaaacttgcgtattttttgtcttcatttactatattatgtagggtttctgtccaacaagagtacttgtatatctttgctattggctctcatgtgatggcaggtaggtgggggttatcagattaggccaaacagaaaacctcaactccagttgcgcacaggaaagtttgtcgctgcaggactgccccgtgtctgctgttgcaaagagaaatgttaatctgatgtccctctc

SEQ ID NO: 27367 - DNA, 2076 bp, Homo sapiens
ctattcttttatgaggctctatcagagactcttctccatttcctgttttgatagtactcagtaaaacagtatgaatttttaaagtacatttaaaaacacccaaataacatttacaaacatatatcctttaagacacaagaatcagttttgaatctagttgaaatcaatccttataggcagatctttttggggaattttatgatatttaagtttgagaaaaccactagaggttttcctttatttgaatttattttttagtgatttttcagactttcctctaccttgacttagtctcccacaagagataaaatgcattagtagagaacagcaatctgaatctattttgagtactttcttgctgtcttccagaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaagtgagctcgcacttcatcctatgggccaaaaagggggtggagggcgtcctttattgtacttgggaatatttcccaggttacacaggactgtttgggaagggagatacttaagagcaggacagtatttcatgcgtaggtctccagatgtttttgaggtacagttgtctcccctcatccacaggggatatgttccaagacccccagtggatgcctgcaacttcgacccaattgctgtcacttggaacacatttctgttgatgtcttccacccccaaatttaatgtcttttccatgtttattaagtacttatcacatagagtggctataacttttgcagtctgaggcacaacagcaaaactagcacgactttctttttccttcttcacaatttcacagatggaaggttaattcttaccttagatcttagcaacttcaccatacagttttttttattaagtcgataatttccaccttttcatttaaagcactctgtgcagcttctgtatggcatatccaaattgccaacatcaccactttcacactttggggcctttattaagtaaaagaaggattacttgaacacaagcaatgtaaaaccattaaagtcaacctgataaataaggcagctactaggttacccatgggcaagtgacatatacagcatggtatgttgtatatatggttcacgcatcccaggtgggactacaagagatttcatcatgctcctcagaatgatgtgcaatttaaaacttacaaaatgtttatttctggaattttgtattgaatattttcggatgacagttggctgagggtaagtaaaaccatgcataaggtgggactactgtattgactgttaagaaggaaacttggaaaattatgctcagcagataggtccacttggggtcatgaaaggtgaaattattcctcacatcttatttcactatcctcgtgctctgttatttccagagatgccaaggttccttctcctcctccaggacataagtggaaagaagtccggcatgataacaaggttacttggctggtttcctggacagagaacatccaaggttccattaaatacatcatgcttaaccctagttcacgaatcaaggtaaggggatagttgagagctgcactggttcatggtgctgataacctttttttgttgaaatgtaacgttctcgtcctctagaatcactttgacaaattaaaaatcctccccattgaaagaaggcaagtactttcatagttagcattatggtgatcttcctacagtgcctccatttttttggtcacattgtaatcttatttattaattcacaaatatttactgaaatcccaaatgtgccccacacagtatacatttgatgctaggaattatgttggtaaacaagatagacgtaggccctgccttcatattgcttaacgtccagtggtcagaatgtgttgaagtatggtgattgtatattggcctctgcagatgtcttctacttcctcacctctcttggttatgagaaggg

SEQ ID NO: 27368 - DNA, 1677 bp, Homo sapiens
aaaagttggccgggcacggtggctcacacctgtaatcccagcactctgggaggccaaggtgggtggatcacctgaggtcaggagttcaagaccaccctggccacggtgaaaccccatctctactaaaaatataaaaaattagctgggcgtggtggtgcgggcctgtaatcccagctactcgggaggctgaggcaggagaatcgcttcaacccgggaggcggaggctgcagtaagccgagatcacaccattgcactccagcctgggcaacaagagcgaaactccgtctcaaaaaaaaaaaaaagttgtttgctctctctctcaacttagaagggagggaaagtgatgatatgctttgagagattctattagatgactcaaaaagcgactcatggtgaaaatacagaaatccaagattcatgtgaagagttgaatatagtttactgaaaatgtgagtgtggggaaaatcaatgttcgtgaatcaatatattgttttaaatatgtgatttaaagtatgtacctgtagctaaataaactattatatgtggacatttgcatctctaaaaagtttatattttagttgcaaaaaaaaaacaacccacaaaacaacttggagtgaccctatgatgaaaatgagtgtttgccttgtatctggagtggccatctctttcaggcatatacagtctctcactttgctctatctccacagacactaacaggtttcagtaaagccaagtgtcccttctcagtgctccaatggcccccatcacactgaattgtcatggtctgttggcatttctgtacccactgctggagtgggaacttgttctgactcagctgtgctgtcttagtgctctagaggatgcatccgtgaagcgtgttgcaaggaggagagagaaaaacagaaaagtgcaggtctgccctggcctgggctttccccttctcttcctttattgccatatgttgcctcagtgatgcagtcacagtgtccctgccacctttcagaagaagatacatctgcagcccagctggagaacctcaacatctgggtcccactatgggggccaatcagcagagatacaccaaggtcaatggagacagcagtccctgggagcagccgagccaggtgtgattttgccttgagagagaacacgaggctcttgagggacagataacacaacccaggtgaggaggaaagcaggtggacatgacctaagaagtgtgaggcctgatgactaagttggagccacagatagatttgggggccaggggtcaggagcctaaacagcaggttgtgggtggagttcaaggtgcactgaggttagttcttagcaagtagtactggctgtgtgctgaggtgcaggctggctcacaaacccagaggaggggctgttcagatgtctaacacgagaaactgagtaaaaattaaagaatggtttaggccaggtgcagtggctcacgcctgtaatccctgcactttgggaggctgcagtgggtggatcccctgaggtcaggagttcgagaccaacctggccatcatgatgaaacccccgtctctactaaaaatacaaacaattagctgggcatggtggcacgcgcctgtaatcccagctactcaggaggctgaggcaggagacttgcttgaacccgggaggcagaggttgcagtgaaccgagatt

SEQ ID NO: 27369 - DNA, 1054 bp, Homo sapiens
cttcccaggcctgagcttggctgcttttgcgctggtctctagtgggaggagggagttgggggattttgaaaaaccccagatctttgagagttgttccacttagcgcgtgcctgtgctgtggtcggatgggcactctgctctgccctccattcccccgcctctcagtgtgaagagatggtgtgtctgcaactctagactgggttgcttcttgcagggacccccggagactagggttagagagacccaggctcagaaccaggtctgtgtgaaggagggagatcaggaagtgacaccccaagggggggtcccacaaaccttcttgggtatggtgtgcatgtgtgtagatagttgaggagattgggaggaaggaaggtcttgtggtgaggcagccaaccatcctcagctacaaactccagatctgacacagatctaatgcagctgctcaacttagaaatggcagcccccttcctcagtgcccccactgaccctgtcagccattgggagaacattttagtgacttgagagcctgtggattccaaagtaaaggaagaatcgacactgcaaagagctgagataaccctgggaacatcactcaggcatcaggctccaggcatggtccccttccttactccctatgctgtgttgagttggtggcactggctggaagttctcagagatctcctgggtaacagactgcattttaaaccacgcatattagcaggcaataaatgtagcacagtggttgatggcaagtctggatttgaagcccatatattcattgtgtgtttcccggccagttacttaccttctctgagccttgatttcctcatgtgtaaaatgggggtaataatatatccagtatatatggttgctccaggatcaaatgagacaattcatataaaacatctagcattgtctgacacataaatgtttaataaatatgagctgttattagcaataacattaacaatagaccgtggctgcccttcaagaccctgaactgggaatggtgagggggtgaggtgtggctataggtgaggatgaaggtgcagga

SEQ ID NO: 27370 - DNA, 1029 bp, Homo sapiens
ccctcagagcagtggggcagccgatggcctatgctagataggccacagcccctgccttagctagggattgagaagaaacagacacataagatgcaatgtggtgtgtttaggttgtgttgagtttgagatactgatgggtcgttgaagtgggtctgcttagtgggcaattggatacacaagaccagaggtaagaggagaagtcctgggctggaagcaggagtggagtgggggctgaggcatagaagggatgaggtggtgtcgcataggaagagaacttgggatggattgagaagctccatatgagaaggcatgggcgaggaaaggagcccaggaaaggcaggtcagacagactgcaggccactggtgagggagagggtctgctgtgttgagagctacagaggtaaagacaggaacgataagaacttgcaagtgccctttggattcagcagcagctaatagcccttgtgagacttttgagctgcatcagcagcatggctggcattagatggcagtgggcagcagggagtctggaatggcaaaagcagagcctttgtagggcctgtccttgagggagagaacaggtgactggggtttgagcaggctctcatgcagatggctgaaaggagcgagcagcgtgtgggaggagatggagcccaagcttagctggtaggaccagccttctggagaaggtggcctcttcccctgagcctgggggaacagagaagtattctcaagggttagggaattcctacttggtggccctttcaccaagtgcatttggtagatgggtctgtagctgctttggagagggcacccgcaagccaaatagagaagggatagggtgcttgccaggctgtcccctagaaggaaaaggtgctggcataccaggtggttgaaggactggatctgggggtctaggctgaaaagggaagagtctgaatgtaagagccactgaggccgggcgtggtggctcacgcctgtaatcccagcactttgggaggccgagatgggcagatcacttgaggtcag

SEQ ID NO: 27371 - DNA, 1075 bp, Homo sapiens
gagcaagaaaaaagagaagatgactttaggaaaatcctaaacgaggtttggttttaaaattttcttcttggctggctctcctctcctgcaagttgcctttatccacttggggtgtgatatctgaactgaaaaagctgcaccaatctgaggatattggtccaaaaagagacaagagaccacgaggctcaagcagagagcatccacacagcatccaaccagaaaggccagtgtccttcctccatgaaaggcagccagggacagatgtcccagagccaggagagagagggagagaacacaggacctgcccctaggccactgactgagcaggataaaacccacaagggcacatctcaggctacggaatagagagatttcctggtgggacggcctcccaaggctagctggagatgagaccactagtacatgtgtgagcccgcaaggcactacccaatgttctgtccaacttcctccttgtgctactagagagcacagtgtggagtccttgtgtcaaggtgctttggtccacctgaacagccacctgtcactcagccaagagaaaggagctttaagttgtacaatcactaccaaaccccaaggccctggcaagccatccaactagggcgttctttttcaggaacccaagattctcaaaaatgacactcctcccctcccaaaataaaaaagctcctttatagtcaaaaacgaaaacaagtaatcaaaatatacaaagcatatgtatcaaatttaaatttcctttatcagaatgatcatctggtttcacctttgagaactcgatctacaaccccatgtaaaaaacaaatgggtacaagacatcagcaacaaaaaaacactaaaagatgattttactatctctgacgagtccaactgcatacagagaaaagggataagattagccactttttataggctttttcttcaggagagactaacctcacccaactctcaactctgcagcccacaaatgccttctactgaaggcaacaacacaatttaacccttaggcagtgtgcaaaaccacagtgagctgtcctgtgacagggctacatacctggct

SEQ ID NO: 27372 - DNA, 1285 bp, Homo sapiens
aggttcgggggcaggctcgggtggaggtggggtagggggcgcgggggacggggaaggggaggagcataaagtataggtcttaaagctatggaacttgatgggggccaaagaatgtactatttttaagtaatgtggtattgtaccacaaagtagatctaaataagctttatgctgtatttgaactaattggggcatgttattgggaggaggttggggggatttttggttatgttaaatgtttgatgtttaaattgttgcatgttgaattcaaactttttaacaagtccttgatgtttcaatttgaaagtgaccaatggggctgaggctgtgtccactgaggctaagatgactgcctttcctgattggccttggcttttccatacattgtgtgacccttgccctatgaccctttggctgaccttaccggaagccatgacgacagcagccttttgccattagacgcagggtgatggtgaggattccaagggttagacaaaactggttaatctgaactaggtgactgttaccttgcgtgttttgtggccaaaccaccaccaaaaacctcacactgtgatgtaagtacttagtgtaaaactagtaaacatttttgtaaaatgtagaaatgcatgtaatcagttaagttttatattttacaatgttctgtaaaataaaacttagcgaggtaaatcgaataaaggagcagtcactctctaacagattgtaggagaggtttagttggatttagtctatttgacttgcccttaatttaattttatggcaaatcacaaatgtgtcgaaggtttagcaatataatagcaaagtcctactccagtaaataaaagttgatatgtttgtactaactttcaaagacattatgcgtttttatcattacaaggcatctaattgttcccttcatgtgataaaggtggtggaggtggatacagcagtcggagaacatctggcagagacaaatacggaccacctgttcgtacagaatacaggcttattgtagaaaatctttctagtcggtgcagttggcaagatttaaaggtatgttttgtaattcaagatagaaatgatatgactaatgctttaaagtaaactccttttatattcttatttctgggaatttattatggtatatagatgttttaagatttccgagtctgaccaatcttgtctttcaggattttatgcgacaagcaggtgaagtaacctatgcggatgcccacaaggaacgaacaaatgagggtgtaattgagtttcgctcctactctgacatgaa

SEQ ID NO: 27373 - DNA, 1080 bp, Homo sapiens
cctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacata

SEQ ID NO: 27374 - DNA, 1031 bp, Homo sapiens
cacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaaggcttgttttgagtttattgcatatgcccacttaggaccagattcttaacaaatgtttttttgaattggagtttgcattggcaagccattcctgtcttgagtatgagaacaggatcttgtgttcacttacccagaaacgtgagtttgggatttagtatatggtttatgttgggcaactcattaatcactgtgcttcagtgtcatccatgaaactagggataaaacatgcatgggatgtgaagattaaaagtcaagaatatgaacagtacaagagagtaccataacaaatacaattttatttacaaatatacatggttggaccataccttggaatctacttgctaatgcagctgctgttaacagttcttgtatctgctcaagagatttctatgatcatataaaaatgcctttttaggttttcagtgttcatgccctgagtagtagtctgcagtttgctttaatacatggtaatacagagatcggctttaaatggctggctggttactgttgaatgaatgtatgataaattttttttcagaaccaacagtgtgaataatcctttcagttgtctatcagcatgaatttaaaaattactttcaagattcaacattacacaataaaacttagagttcttgcaatagagcacctagtgtagtaattaccgatttatatgctaatctttgagtttcctca

SEQ ID NO: 27375 - DNA, 1075 bp, Homo sapiens
tgcgccaccacacccagctaatttttttttttttttttttgtagagacaggattttgccatgttgcccaggctggtctcaaactcctgggctcaagcaatcctcccacctcagcctcccaaagtgccgggattacaggcgtgaggcacaaaaatactgtcgatagccagaaaaataatgtcttagcaactcacatccatgttagttgtttgtttctaggtcttgctagctcaaattccacttatccgtcttaatcaccatctaaaagatgcctttgtttttgagaatccatgtgtttgtgtaggttcaccactttcttttaatcttctgaatacctaaaataaacctttgaaatctagatcacgcacagtctaggttgagatgagagaatactgagcggatggttgtgtatgtatcaatgtgtagaaaaaggcatccatcgttatggcaaccagcatccttaactgatgcaatcctgttcccaataatatgagatgtgattaaaaattgacattgcagcaaggaagaacacatgcaatgcgttggcgtggcaaccggaatagttaaattctgcataaatttaaacctgtcgatcacagcaatttggagaatttgcctacatttcattaggaacccttttctcatctggcctgggagggaatcaggagcctggtggtctgacatgtggccatgacttaaggccaagtaaaatcaagggattaaattaaatcattggtgtgggagaggggctggatggtggactgtaccaaaagttaccctgttttcatctgcataccctacatcatttagtcactcaacagatatttattaagcacccactctgtgccccgctctgggctaggtactaggaatacaaaaactaatatttcctaccctcttggagcttgaaacctcttagcctctggaattactcaaatctatgtgaagtgccagctgtggtatgtgtaagcgagacaggtatcttgtgttaccagaaccaataacaaggagatttgattaattagagagatcaggtggaggcgaagagatcagtcaaagtgaagcagagaggggca

SEQ ID NO: 27376 - DNA, 1111 bp, Homo sapiens
ctcactgcaagctccgcctcccgggttcacgccattctcctgcctcagcctcccgagtagctgggactgcaggcgcccgccaccacgcccagctaattttttgtatttttagtagaagcggggtttcactgtgttagccaggatggtctcgatctcctgacctcatgatccgcccgcctctgcctcccaaagtgctgggattacaggcgtgagccaccgcgcccggccaattgacatttttaaaagtctttcagagtgtggttttttggatttgtcttgttgctttctagtggtgtcacttaacttgttcctctatcccctgtatttcccatgaactgaaagttagatccaaaggctgggttagacttaggttaaatttctcactgtcactgtctctgtttctctctctgtgtctctctgtctccccctgcccccctctgcttttggcaagactagttcctaggtgatactatgtactttgtactgcctcatgttggaatgcacacagtgtctgcttgtcttgctgttagcagcactaaggttgaccaatgaggtcatgtggggacaacaagagcaggtttctcaaagccagtgtctgtgaggactcaaaagacattttgcggatacaaatgctaaacctcagaccagtcagcagaaagagagaaagagaacaagtgtgtgaacacggggaaaccagtggctgtctttctttccttctccgtccccattgctgtcttccttttttcctttctccctcccttctcctttctcccggtcctttctctccccttctctcctccttccctttctcccgcatatcctttactcctactcccctcccccattccccatgcacacccctccctttccttcacccctgccccgtgaccctttccaccttctccactttccacctccctcccgcaacccctcagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcct

SEQ ID NO: 27377 - DNA, 1042 bp, Homo sapiens
aaaagcagctactcagaacccattatatgccaggcactgagaatacaaagtcgagtcaggcatagtcccagtccctgctttggaaaagtttgtaatacactgagagagagagagacaaattagtaaacccagaagggtgtttctgagcatgtcaggtggggtgggagctgagcctggagaagcggagaggaacaggctcaatagcagtatcacgtgtaaggccaaggagcttgaacttgatgctgaaagccacagggagcccttgggttttcagcagccttgagcatagccagatctgtgtttcttctttttttgttgttgttgtttatgaaagaacttctagaatgttttggaaagattcttctgtcagttgtgtggaaagtggaaaggaggaggcagcctagagccaattaggaaggtggtggtgtcaccaggcaaggagaaatggggacctgaattacgggagtcaaggtgtgagtggagaggaggggctggtaggaatgggaattaggaaaggctctgtagaggactactcactgactgatgtggcaaataaagtaaaggcattgcaattttgtcaaaaaaatgccaagggaacatgtcttacggaagatggcagagtagggaagcacatgtctgtacagcatgtgccagagctgtccattggtgattccagtgagagaaagaaacgccttataattgttatattgggagattgataaagatcttatttctgtggaatttacatgaagtttcaatgtctctagacacattatgggagatctagatattctacttttttttttttttttttttttttgacatggagtctctgtctgtcacccaggctggagtgcaatggcaccacctcagctcactgcaaccatcgcctcacgggttcaagcgattctcctgcctcagcctcctgagtagctgggattataggtgtgcgccaccacaccaggctaatttttgtatttttagtagagatgaggtttcactatgttggccaggctggtctcgaactcctgacttcaggtga

SEQ ID NO: 27378 - DNA, 1035 bp, Homo sapiens
ctcccgggttcaagcgattctcgtgtcttagcctcttgattagctgggattacaggcacgtgctaccacacctggctaatttttttgtatttttaatagagatggggtttcaccatgttggtcaggctggtcttgaactcctgacctcgtgatctacccgcctcagcctcccaaagtgctggaattacagacgtgagccaccgtgcctggcctggaactaggcgtttttaaattaatttttttttgagacgagtcttactctgttgcactggctggagagtgttggctaatttttttgattgattgaggcgggggttcgctctgtcacccaggctggggtacagtgacataatcacggctcattgcagcctcgacctcccaggcccaagcaatcctcccacctcagcttctaaagtagctggtgccacatgtgccaccatgtctggctaatctttttgaaaaatttttgtagagagagtatctcactatgctgcccaggctggttgaacttctgggctcaaatgatcctcccacgtcagcctctcaaagtgctgggattgtaggtatgagccaccattcctgttctttttttttttttccttgttaatttttttgagactgagtcttgctctgtcgtccaggctggagtgcaatggcgtgatcttggcttactgcaaccttcgcctcctgggttccagcaattctctgcctcagcctcctgaggagctgggattacaggcgcctgccaccacgcccggctaatttttgtatttttagtagagacagggtttcaccatgttggcctgactggtcttgaactcctgaccttgtgatctacccacctcagcctcccaaagtgctgggattacaagcgtgagccactgtgcccggcctttttttttttttttttaatttgtagagacagggtcttcctatgttttccaggctggtcttgaactacagggctcaagctatcttctcgccttggcctcccaaagttctgggattacagtcatgagccatggctggcacttc

SEQ ID NO: 27379 - DNA, 1021 bp, Homo sapiens
gttcaagtgattctcctgcctcagcctcctgagtagctgggattataggcgcccgccaccacacctgactaatttttgtatttttagtagagatggggttttgccatcttggccaggctagtcttgaactcctgacctcaggtgatctgcctgccttgggcctcccgaagtgctgagattacaggtgtgagccaccgcacctggccctaagctggatattgttcccctgttttccatcttatgaaaacttgtaaaaaatctcttactagtggctgtcttctacctgtttctctttgtccttgtgaatttttgccttgctttattttgaatccctttttttgtcatggcagtgtggtcctggcagggagagaaaatgccagatggtgtgttttccccaaagtctgaaatgatcccttttcaaagctcaaacctgaatgtgtcatctttctggggcttcccctgacacttgggttggaaactctggcttctttccccccatggcctgtttggctcacaggtgccaccagcctcaccttgatccactgtcacttgtgcttactcggtgttagctgctttgcctcctttcagtccctcgaaccctgagctcttctcagagctcctagtgctcctctgtcggcctgcagtgcactcccgcttgtgcctattgtgtagctaatgtgttctcatccttcagttctcagtgggggtgctatttcttcagagaagttttctctgttctcccagactgtggttggtctctggtgacctctgtgttgtgcccacacctgtctgcagagtagtgtgtaccccagttgtagctgaagataacattcatctcccctgctagatttaactgtcaatggcagccacttgtcttatttaccagatggatccccagtgcctacaataatgcctggcacacagtgggtgctttttatatgcgagcaaaagaaggagtctcactatagcttggggcaccccagactctggtcttggggagtgggagggctggggaggtgtt

SEQ ID NO: 27380 - DNA, 1080 bp, Homo sapiens
taaaagtgggctctgtgcttctggggccttgtgagacttctgcacataactggcacttgtctgcctgcagatgaaggatagcagagcaagctgattatataaaactgtgaattagttaaggagatcctcagcctccatctctccttgctggtggccaccttcttacctgttgctcattttaattttttaaaactgaaagcatgtttgcaataaaaaaatcagaggtggctgggtgcgttggttcacacctgtaatcccagcaagttgagaggctgaagcgggcggattgctcaagcccaggagttggaggccagttcaggcaacatggtgaaaccttgtctctatctttttaattaaaaaaaattaaaaaatgtattgagttgtaatttacgtactctaataaacagttttgagttatgacaaagcatacagccatgtaaccactgtcacagtcaaggtatacaacagtcccatcaccccagaattccctcgtgctccttttcttagccttttttcggcccttagctccttgcactgtgatctgttttctgtctctataattttgacttttctagaaattaacaattaaaatcctatagtattacatttgcaggctgttttttttgagacagagttttgctctgatgcccaggctggagttgcagggtgtgatcttggctcactgtaacctctgcctcctgggatcaagcgatctcatgcctcagcaacctgagtagctgagattacaggcatgcaccaccacgcctgactaatttttgcatttttagtagagatggggtttcaccacgttggccaggctgggtttgaattcctagcctgaagagatccgcctgccttggcctcccaaagtgttgggattacagatgtgagccaccatgtctggcactacatttgcagtttttatttatttattttttgagatggagtctctgtcgctcaggctggagtgcagttatatgatagctcactgcaacctccgcctcccaggttaaagcgattctgctaactcagcatcccgagtagctgggattacaggtgcacaccaccatgcctggctaa

SEQ ID NO: 27381 - DNA, 1073 bp, Homo sapiens
gcccaggctggagtgcaatggcgcgatcttggctcactgcaagctccgcctcccaggttcatgccattctcctgcctcagcctcccgagtagctaggactacaggcatccgccaccgcgctcagctaattttttgtatttttagtagagacaggatttcaccgtattagccaggatggtgtcgatctcctgacctcgtgatcctcctgcctcagcctcccaaaatgctgggattacaggcgtgagccaccacacccggctaaaatttttttaagaggtgaggtcttgctactttatctgggctggtcttgaactggccttaaagtgatcttcctgccacagcctcccaaaacgctgggattacaggcgtgagctactgcacctggccctcatttgataattttctgtctcaggaatggagagtccaaattagcctgaaaaacataatctcttccgcttcctaaggtttcaggtgcaaattcgttgtgtttgagcagccttatgtgcagggcgaaagtgcccatccctctatcaagagtggagactgcattcctgtcctctgagcttacggagcatgacattttctgtctggaagcctgtacaggttgctcgccagcctgcttttacaatggaagtgcttttacaataagtttacttccttgggtcatcatgattctaaattccaggtagagagagttgcttaactattcctctgcttgatacatttgctggaggaggaaatcgctattttgtgattcagaaatcagctcaggaattttagccctgatagtgatacataatttcgggaaaagatttgtgaatcccttagtcagaaatcagtctccaaagtccggctcagtggctcacacttgtaatcccagcgcttgggaggccaaggtgggaggatcacttgagactaggggtttaagaccagtctgggcaatatagggagaccctgtctgtacacaaaaaaaaaaaaagttttttttttttttgagatggagtcttgctttatcacccaggctggagtgcagtggtgcaatctcggctcactgcaacctccgcctcccgggt

SEQ ID NO: 27382 - DNA, 1040 bp, Homo sapiens
ctctcttagtcacccgggttggagtgcagtggtgcaatcatggctcactgcagccttgaattctgggctcaagtggtcctcctaccatagcctctggagtagttgggactacaagcaccaccatggctggctgatttttttatttttagtagtgatggagtctgtgttacccagactgttctttaactcctggcctcaagtgatcctctcctgtcagcctaacactaatcccagagtgttaggattacaggcgtgaaccactgcctttggccatgtgtgtgctcttagtccttgttgatgccacgaattagagaggttctggaattttctcatgttcctcagaaactccatgtcccatggagatgcttgagtggctcagattcacctctgtgaattgtggtttgaactgtaagatgtgtacatttgacttgtgcttatctgtcttcactcttccttacagagggggatctctgtgtgtcccagatgggggataacaagggtttgggaagagactgtggatccctgcctaatctctaggtcctgaggaaggaagaaaagaatggtctgcatttgttctagttttttatctccccatggagtggctggccagctgcgggaagtggaggcggcgaggccccaggctgctgtttctaggagttggcctcatcacccaggtccctggctacctggggtgtttctctcatcctctgagtgccctggttatgccatgagagtcagccatggtggtatctccaggtgactaaggtcacataccagcacacaagggttcgtgtttgtggaacctggtagcttccttcagagctgacatttgcccacagccagcctggcccagccccataccaccagccctggcgctctggggcgtgaggtgccttttctgcccccctgctctagggcaggtggaaatcacccatggtgggtctacatctgatagaagcatcttatagttctgcttctggaccagaccatcctgggtttttctctgttctgctgaagggttccctccacgtgtccatcac

SEQ ID NO: 27383 - DNA, 1515 bp, Homo sapiens
cgtggtgtggtcgctgccgtggatctctgcacagtgggatcccttcggttcatccaaccatgttcagtccacaggacccttccctctgaggtctcatttgattctttctcctgagaagatgcagagatcctgataatataaatggggaagctgaggctgctctttgtcacttcctccgactgctcctgagcacctgagtttgcaagcacgcgccggctggtgctagagacatggtggtatcccgtgacactcagcctcaggatgggggagactgatgtgaaatacaaataacttaaacactttcaggcaaagataagcactgggcctagttcagagaagtggcaaattgctactctggcctgtctctgaccaactcccagttctctacagagcacgggaaagcccctcggggacgtctttcctgcagtgtgcaggctgcccttctcccctgctcttcccagttgatgggatggttgtgttttctctatgaaaaaaggagttggcaccttgggctttctgaaacacacaggtgttttagaaatcagtggagggtgagagaaaggcatggttgtggaggcactggactgtgaacaaggtctgcagcgggtccccctgctgtctctctccactgcatggagcctcctatgaagcccaaggtggctgggggctgaggctcccttgggcctgccatggaactgattctgagtcaagcagactttccacggaccatgctacatgagccgaggtgaggcactagttagtgctcctttcctgttgcagtggagatttggctcctctgtactaaaatatctgcatgctctccaaacaggtgtgagggcaaatcacatgaccttggcagctgtaattaaagtttgtgggggcttttcggatgacttatgaggagtggctgtgattcgcacctttcactcttagtagcactcgccctcccctgttctctgttgcctgaagctggagaggtccttggaaccccgaggcctgagaaagggaaatgggtttgagagcccccattagtgtggaacaaagggttgagtgagcctgggctttgagctgtcggggtcctaattcagcagctgtgtgactgtgtgccaggctgttgatctctgagcttctgtttctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtcccacacacacacagcccgagtgtggtgcctcacgtgggctgccccgtgcctacccacagccacagaccccgcacctggaggaggacttgaaggaggtgctgcgttctgaggctggcatcgaactcatcatcgaggacgacatcaggcccgag

SEQ ID NO: 27384 - DNA, 1941 bp, Homo sapiens
agagaaaccttgtcctggctaggggtctctgacaggctggggacctgcagccaggttactgcaaagaaaaaaacatcaccgcagggagtgaagagcacagattgagtcaggtgggcctgggtttgagttatgacaccatcactgctctctgggatctttcaggttccctgagccccagttaaaagcctataaaaggggtgccaagcctaagtcaggagggcacagtgccaagcagagcagagagactggaagggcgtgggaggggctttgtgcaactccgctgtgcttggggttgaagctgcgtctttatgatgcttgtggatgtttctggtcccaggaaaactaggaacagccttggctcctcctgaggctttatgtgacaaagccaacgttattgagtatgttattactggataatgctcagtgatactccacatttattgattatgttattatggcctgggggctgcacggcacccatcccagggctgatgtgcccccacgtacttgactgtgcctccagacacaccactgaatcaggctctgaaacgcacacacgtttctttacttgattacttgattttttttttttaagtaagaaagttctttagaacaagattaagttctttgcttaatttttttttgagacggagtctggctctgtctcccaggctggaatgcagtggtgcaatctcggctcactgcaagctccacctcctcccaggttcgcaccattcttctgcctcagcctcccaagtagctgggacaacaggcgcccaccaccacacccagctaatttttgtgtttttagtagagacggggtttcaccctgttgaccaggatggtctcgatctcttgacctcgtgatccgcctgcctcggcctcccaaagtgctgggattacaggcgtgagccaccgctcctggccctttgcttaatcttttaagtataaagtaagcttaagctcatgtaaactccctatctgaaagcagaaactgaggcttggaaaagtgtgtatcctctttcaggtctcagcagccaggtggtggtgctggggtgggattgcgggtttttttcttccctctcacagcttctcgcaaaatggtgactccttgacttggttttggtttcagccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctgtgagtgctgtggccatctctgggggtcctgcagtgcccgccttcttagctcagggctgagtgctggccatccctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgctgacccgtctcactgctccttctcacccgcctcctggctgtggcttctcctcgaggctggtgctgcacggggcgggcagtgcatggccatgtctccttgtccagcgtcctacttacagttgaggaagcccacagccaggaagtgacttgtccagggtcacagggaatgtggagagagaataagaaggctctggcttctaggggagggaggcttataactctacccttccctggccaggatcaccagggtctgttgggaacacatagtccctgcctggatggtaaccc

SEQ ID NO: 27385 - DNA, 1030 bp, Homo sapiens
ctgtaggtgacggtcttaacttgtggtctgttctctaggactgtgagtggtggattagaagagagatgaggagctgccaaaagcagctacacagagaacagagttagcaaatggcacccgagacagaactatagcagatgcaagagccaaaaacccacagccgcttgactcacggatatactatgatgtcaagctgcagtcaccggtggtcacaatgggcagcctaagtcatcaggaagaggctattgtgcactgcttgggaggggtggatggctttgggaatgctgccatctaaaattgctcatggatgtatgttgtgacttaagtcttttaactgtacgtatttgttttttgtttttgtttttgttttatttgagacagagtctcgctctgttgccaggctggagtacagtggtgcgatcttggcccactgcaatctccgcctcccaggttcaagtgattctcctgcctcaggctcccgagtagctgggattacaggcacctgccatcatgcccggctaattttttgtatttttagtagagacgggtttcaccatgttggccaggctggtcttgaactcctgacctcaggtgatccacccgcctcagccccccaaagtgctgggatgataggtgtgagcccctgcgctttgccagggctggtttttggatgtgattctcagggccgtctttctttacccttctgctctgctgaggcccacagcagcctagtctccttgggtgtgggggaagggtttaaatctattcatatatcgcagaaggtgaagccttttggtgttcagcttaacatgggaaacatttcctataaaacgccccatcttaggtcgaccctgccgttgtccctcacagaactggaccaaagtctgaatggacgcaattgacacatatctcagggtgttagtggttttggtcctctgacattctatttacatgtctggtgttaggtaggatttcttctaaaaattggcctggagctccttcccaccccccaccctgttaaattgtttct

SEQ ID NO: 27386 - DNA, 1023 bp, Homo sapiens
acacacacacacacacacacacacacacacacacacatcatgagatatgctttggagtcatactggcctgggatcaaatcttggctcttggctttgccacctatgaagagttaatttccttccttccttccttccttccttccttccttcctccttccttccttcctccccttcccttcccttccccttccttccttcctttcttccttccttcccttccccttccttcctttcttccttccttccttctttccttccatccttccttccttccctccttccttccctccctccctccctctttccctccctccctccctctatccctccttcatacagccatccaaggagcatgcactgcctgctgtatgcaaggctttgtggtaggtgccaggcaggaacaggtaattaagacatggtccttttccttgagaagcatgatcttattagagagacagaaataaacaatttcaaatgtgtgtggtaagcattatgttgaagtagcacaggggagtgtgggaccaccaggctaggctggggacagtcagaaaaggcttctcagaggaagggacacttgcctgtgcttgaaggtgagtagaacttggccaagtgaagaaggtagggaaaagcattccaggtagaaggaacaacatatgcaaaggcatagaaggtgctgagagtgtcaagatgtgaggctgaagaagggagccaggggcatttggaaagctgtttattatctctgacttcagttttctcgtatacaaaatgtgatgagcaatgcttacttgtttatgaaattaaatgaggtaatgatgtatgtttaagcacctggtgtagttagcttcaattccctttccaaatctgtctacagatgcctaagagccaggctttgattttaaatgagagaaggaataaaaagcactgaagggcctggccgcccacttgcacagtgcaggtttcctgcagctgctcttgtgttggtcgctttattgctgctttggacggagcactaaatgtctgcat

SEQ ID NO: 27387 - DNA, 1050 bp, Homo sapiens
aaacagtggtaactagaggccctgggcttcctttgtatttaccagagtccagatgaaactcctggcccctgtttttcagaggcattaagcaaaagaaatatgtctttttacattttataaaactcagaaaaatggctttaaacagcttttgctctcctgctataattatttattttcaaacactcctgcaggggaccgctccgttttcttaccctgaactcctttttctcataaatgaaccatcacttcaataaatcattatggaaacagagactaacaccggctctgaaaggttgaaagatttatgtaacacatttatgtttcccattttctcattctggtactcggctgcaaaagctaagctaataaaagctgctattaatatttcttgttgcctagcaaccccagagcgggagtaatagcttcggctagaaaaatagatgaccgataaggaaaaattcaattcttttattatctcagggggaaatggccttttactggaacattatgatgtacgagtgtgaagttgaacacaaaagatttttttgtatgtgtttgtttttctgtttttaatgaacattattttacctccactaactcttttagggcacttttacttttctttcgtaaaccccccatcccatccctcatgcttaatttagcagctacagtagttaagaatctgtcggcgttctttagtttaaaaatggtttttgcaaaggtttacaactcggtcataaaaattcactccctgttaaaactcaggccagtgataagctaacacgcaggctggttttctgtgaacaggatcacgtttgttgacgagataagattcatggttttccctacaagaaaggtcggaaaggaacaaaacatgttcttttccatgtcccagttttctttggaaccagggacactgtctcttttgagaaccgtttgctctgcagtttgggatgcgttcacactgggagaggatggggcacagatattcactgagcacctgctctgcagagccttggtgccgttcccttctcccagcaccctttaagg

SEQ ID NO: 27388 - DNA, 1051 bp, Homo sapiens
gggactcaggctgacaaaaactctacagttgcatgactgtaccacctagaatacatggccttctcagtggctgctgtgagggaaaagagcctggggaggcacacgtaggatattcacagtgttagcctggaagtagcgtcatttctacttatctttcattggacagaactaccatgtggcctcttctgactgctgtgggggttctgggaaatagaagggaacaaatggaatgtttcttgaggattactctctctgccttagttttattctagtgttgtgagtgaagatgtcagatggatcaaagtgagacttgcctcactgagtgtaagcttacaattagtgagccttatataagacacagctctgcatgtgatttagataataagcagtaggaagaaaaattatagttatgaactggagaatcaattctttctgaatcacctagattttgagtgtatcttattgtgctccctaaaacatttttaggtgataaggccctgtgtgtagaatttctctcttgaaaatacagaaatgacttttgaggcaaaatcattttgtgagtggaggtcatactttcttgttttttttttccttttttttttgagatggaatcttgctctgttgcccaggccagagtgcagtggcgcgatctctgctcactgcaacctccgtcttccgggttcaagcgattctcttgctcagcctccccagtagctgggactataggcacgtgcactgtgcccagctaattttttgtttttttagtagagacggggtttcaccgtgttagccaggatggtctcgatctcctgacctcgtgattcacctgcctcggcctcccaaagtgctgggattacaggcatgagccactgcgcccagcagaaaatggttaatttaaaaatagcaaagaggccaagtgcggtggctcacacctgtaattccagcactttgggaggccgaggcaggcagatcacctgaggtcaggcgttcaagaccagcctgagcaatgtagtgaaaccccacctctactaaaaatacaaaatcagccgag

SEQ ID NO: 27389 - DNA, 1083 bp, Homo sapiens
ttgagatggagtctcactctgttgcccacgctggagtccagtggcgtgatctcggcccactgcaacctctgccttttggtttcaagcgatcctcctgcctcagcctccccagtagctgggattacaaatgcctgccaccacgcctggctaatttttgtatttttagtagagatggggtttcactgtgttggtcaggctggtctcgaactcctgacctcgtgaattgccctcctcggcctcccagagtgctgggattacaggtgtgagccactgcacccggctagtaagcataaacttctaaagaaatagttattaagcagtctgtatgtgccaggcaggtgaattaggctaatggaagaaaacaaaagctctagagccagatagatgtgagctggagttctggctctccaccatctatttgcatgttgctctgggcatatcacttgccttccctgaccctccatttcttcacccataagaaggggaaagttgttgttatgaacatacctactctgggactgttgggaagattactggaccaaaataatataaaggccttagcaaagtacttaaccctagaggtgtttgatatatcatcaatattgttgatggcatttggaatgagatgtttcacatttagtatgctgctttccagatgggttggaagaagattcacacacgtttcctaggccccgaaacctgacatttgctctttctttttctcttgctcttgttctagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtaagaggccagtgcttctgttttgaacagtggtttctaaa

SEQ ID NO: 27390 - DNA, 1026 bp, Homo sapiens
ttgccccaagccacagacctagggagtaagagttgggaattaaagtttggatctatcgactctaaagcctgtgatgtttgcactagaatgtatggtttttcacattctatattgttaaaggttatagctgtatttaactgctttagtagactttgtcataattgttttcccccaaagcatttaatatacaacttggtttagaataaatatctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctttgggccttggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtgccttaaagttccgtcacttaaatcagatttagtga

SEQ ID NO: 27391 - DNA, 1031 bp, Homo sapiens
cctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaattgatgtgtcaccaccatctctgttgttaccagacctagctaactattctgatcacacttatttttaactctgttttctttaaaaataggcaaacagttttatttcattatttaggaccagaagtcaaggtgttatccaggggaagaaatt

SEQ ID NO: 27392 - DNA, 1056 bp, Homo sapiens
gtgggaatgaggaattttccaaagagatcagtgtgagtgacaggatggggggacccgcctgaatgatgtgatgttgggttctgaggaagtggtctagaagttctcttttggctactgagtccagttgtaaacatccttcagggagccttgtgtttggaggaaaaaaggttgtcttttaggttaagatccttttgaaaaatgcgagagaaggctgtggcacatgtaaattaggcatcagtaaatttgattacacatcataaaaagctataggtcctctttccaagcaaatgcatatacatttgatgtagaaacatggttgaaagctggaattttaaagttaatcaggtttaaatgtaaaccccagtcctaccattacctagctgtagaaactgaggcaagtggctttgcttttcggaccttgtttactcacctataaagtgggagcaacatttctcacctctccaggtgtcctaagaactactaaagaggctgcatgtacagcatctgcattcaataagtagtgaaatagtgattgtcgtaatgattcatcatacaccttgcatacagcttcaggagatggaccttcttgaggactccccgaacaaaggaaatgtgtaaatttggattgcttagagttaaggcacacctggggtgaccatctttttaacaggacaaacggtataaaatggggattataaatatatctattttttgtgtgtgtgatggagtctagctctgttgcccaggctagagtgcagtggcgccatctcggctcactacaacctccgcctcccgggttcaagtgattcttctccctcagcctcctgagtagctgggattacaggcacctgccaccatgcccagctaatttttgtatttttagtagagacggggtttcactgtgttggccgggctggtctcaaactcctgacctagtaatccgcccgcctcagcctcccaaagtgctgcaattacaagaatgagccaccacgcccagcctacatatatatatatattatacaattatttatttattttgagatagagtttccttct

SEQ ID NO: 27393 - DNA, 1107 bp, Homo sapiens
aggttcaagaacctgggttctgcctcaacctcctgggaagctgagattacaggcacccgccaccataaccagctaatttttgtatatttttagtagagatggggtttcaccatgttggccaggctggtctcgaactcctgacctcaggtgatctgcccaccttggcctcccaaagtgctgggattacaggcataagccattgcgctcggctgagattagcaataattaatgtgatatgaaaatattttctttttcttcatgacaaattcatggctaatactgccaggatttttttgttgttgcccatattcataatagaaggaaatgctaatatgaaaataaagatgtcactttttccccaatccatgcaatttccccctaaattgtatccatgacctacctgagggggatccatggactctcaggttaagacccctctactgaagggtagcagagtacagtttcaaaattactgattaagagcgtgggctcaccaggagttcaagcccagccggggcaacaggatgagacctcatctttacaaaaaatgaacaaaattaggcatggtggtgcttgtctgcagtcccagctacttgggagactgagttgagaggatcacttgaggctgagaggttgagggtgcagttgagctgagattgcaccactgcactccagcctgagtgacagagtgagatcctgactcaaaaaaaaaaaaaaaaaaaaagaaaaaaaaaaaggaaaaaaagaagattttaaaaataactctagtccttatgggctgtatgagccaggccggtgtcttcaccctaaaaaaaggttaaaaacccagggccaggtgtggtggctcctgcctgtaatccctgcaccttgggagacctaggtaggaggatctcttgagaccagcctgggcaacatagtgattgctgatctctacaaacttaaaaaaaaaaattagctgggtgtggtggcatgtacctatagccctaactacttgagaggctgaggcaggaggatccctggagcccgggagtttgaggctgcagtgagctatgatcataccactgcactccagcctggatgacagagtgagaccccatctctttaaaa

SEQ ID NO: 27394 - DNA, 1067 bp, Homo sapiens
agtcctggctaacgtatgaaccacaggctgagtgaccccagacaagtcactctttcgagtctctcttatcccggctgtaaagtgggagccgcgatgcctcccgcatcgggaggttgtacatgtgaggtgtgaagacatgtaaagtatctggcatgcagcaggcctcatagatgggggtgcgtgctgcatccctcaaacagctcagtaaacagggtgcacgctacatccctccatcactcctcagtaaatgggggtgcacgctacatccctccatcacagcttgctaaacgggggtgcacactacatccctcgaacacagcttagtaaacaggggtgcacgctacatccctccatcacagctttctcgcgggcctgcccagtgctgggcttagcccatggggaggagggaggcagcgcagccccaggagccttccttccccaccccagcagctcttgtcttgtcttgcttttaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgacggcctgcccgcaactcccaccgcagccttcccccctgccccagcaaggcagagcatgaagactagagttctagggaaatggaggtttctaacttgcttctgccgaggactcattaggaagtctttgtttccctctctataaaagggagagatagtgttagtcaaatggcatttcccagtgagagaagctcgtgaatgttgtgctgaaaaagactcttaatgatccagcaagtttgggaaatgctgcgttaagcaagacctacatttttccttcctcccttccttcccttccctcccttccctcccttccctcccttcccttc

SEQ ID NO: 27395 - DNA, 1024 bp, Homo sapiens
accagttttttctttttttttgagacggagtcttgctctttcgcccaggctggagtgcagtggtgtgatcttggctcattgcaacctctgccttctgagttcaagtgattctcctgcctcagcttcctgtgtagctgggattacaggcgtgtgccaccatgcctggctaatttttgtatttttagtagagatggggtttcaccatgttggccaggctggtcttgaactcttgacctcaagtgattcccccatcttggcctccccgagtgctgggattaaaagtcatgagccactgcgcccggccacaaccaattttttctttgtttttctccactcccactgtttcacttgactagccttaaaaataaaaataaaaaaaaaataatcttttaagaaatgcctgttcatgtcctttgcctaatttttcatggttttttttttcttgtaaatttgtgtaagttccttgtagattctggatattagacctttgtcagacgggtagattgcaaaagttttctcccattctgtaggttgtctgttcactctgatgatagtttcttttgctgtgcagagactctttagtttaattagattccgtttgtcaatttttgcttttgttgcaattgcttttgatatttttgtcatgaaatcctttttttctcctttttttttttcttttttcttttttttttttgagacggagtcttgccctgttgcccaggctggaatgcagtggtgcgatcttggctcactgcaacctccgcctcccaggttcaagcgattctcctgccccagcctcccaagtagctgggattacaggtgcatgccactacactcagccaatttttttttgtatttttagtagagacagggtttcactatgttggtcaggctggtctcaaactcttgacctcgtaatccgcccgccttggcctcccaaagtgctgggattacaggcatgagccaccgcgcccagcctcctttctttccttctgttggattgattgagtcctcaccgccatca

SEQ ID NO: 27396 - DNA, 1046 bp, Homo sapiens
gtatatcagagaaattaaaaatggagtcctaatgcagcacagagagctaatatccatctgacgttgtgtgataatgggtccatcaggatataaaaccaccaaactgttaattcaaaattaatttgataaaagtaacagaacctgaacaaaattgattgtttgaattccctggatagttataagccattcagttggctttttgtggtaaggaaggataaattttagccctgagtttttcccaggaggccgataacaacctatgattccatgaaactttatcttaaccattctctcctagatcagggctccaaatctgattgtaagttgagatttctttgggtttttacaaagaagctttactgaattgtcagaacatagtcagttactcatttattattaggttgtactttttgcttttggctgcacatgttagaaatcagacacttgctgggaggcaagaattattactaccttatttataattagaaatcatgattgaaatggtagaagaaatgctttatttgcctacgcttaagtcaatactgtcaagaatgcatcttgatgtttcctgggaactcagttatctacaatttgaaactttatctgccatttcatagagacaaaaataactctcccaaaacatttggtgaaattattgttcatttatttcaaagtgactctaaaagttagtgcatattcttaaatttaccagcctttaatggtaaggtaaaatttaatgtcccattactcagttacaacaatcatcaagtcagctattcttgttttatttaatccttcacctccactattcacccacactgcttgattgttttgaagcaaatcccaggcatatctcatttctaaatatttcatgtgtatttataaaatattattgaccttttaaaaattataatacctttatcatacttttacaaattaggagtaataaatttccttaatgccaaaaaatgccttgttactgtttagtctcctggatttatatatattttttagcttgtttgaattaggatccaaatgcgatttat

SEQ ID NO: 27397 - DNA, 1629 bp, Homo sapiens
tacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaatctttgtgacattgactcagtggtgtgtttattctaagatccaaagctggggagaggttggtaaacttttgttgggcttctattatgtgccagggtactgagctagttatcaggaatataataaagatgaaccagatacagtttttgcagggcatttggggagttagccaagcacaaaaacacacaacattgaacataccatggtagaagaaggtacagggcctgtggatacacagaagagggagtgacggttctgctgggatgtccaaggaaactcttctagaggagacaatataccttgaaactttaaaaatgaagaagagatggctagattaataaagagtaggaagtgagggagagaagacatcctggacagaagagcccgcctgtataaagcctctagtgtgagatgatcaccttggaatccttcatcctcatctgctgctgcacgaagccaggccagacgtggcccagcattcagaggtggaacagcagg

SEQ ID NO: 27398 - DNA, 1029 bp, Homo sapiens
gttaagcagccatttctagggtggcctcctccccaaatctgtgttactgggcccagaggaggagctttaggttgaaatggttaaacaaagagagggtggtagtggggagaccctggttgtggaattgtgggaggcaggtggccagaggcctaagtgccggggcaggtgggatgaggtggaaggatgtactgctgggattccctcactcccagacctgccccttgctgccctggccatgctgggtccccgccttcgtatacagccctcccatatattcagtggcgttcccagtgggcaactggggcccaactccggctctctggagcaaagtggaagttgccagtctcactcaggcccaacccaatccagcctccacttggggctccctgggcaggcccccacgaaggctagtgcaagggagctccccagaaagggtcagattttttagctgggagggcgctgtcttgactgcccgctgacagcgcactcaggacagaagttcacgcaaaggttgatggaatggaagagtgagtagagattattttcgaaagttgatgggattgaaaatacccagcaagggaactgcaagggagactgttcaggaaatgggctggagtgcaagctgggtgggaagaccgctgaaagtggttactggggtggaatttgcacgggaattagcggggtggtgggggcggaggtaggcaccgaccgtaggggagctccaggaagattgcgctgggagcaggagctcgggagcacgcagcagccactatgaggtgctaagcagtccccgcgctgtggctccgcccaggctggtccgcgcggcagctgatgcccagtcttggtgcccagtaatggtggggaggagtgtgtgagtgggcggggtgggagggggggagagtccatccaatcgttctccctctgtcccaaactggagatctatctgcatcgctgccctgacccccaatcccggagagctctgtgcccctcgatggctccactgctctcccgagggcgcccactccatgc

SEQ ID NO: 27399 - DNA, 1063 bp, Homo sapiens
tcactgaacaatgctgctctgaggccctggtgcctggtgggctgtatcagaatcacctatactcactactcaactcctgagcttccagggctggggaatcactgtgtgctaggcactaagggacagcaacattataggcagagcatgcctctgagttcacaggccaaggggataggtaccccagaaggtagactcctcaagggcagggatttgtgtccgttttattcattgataagccaccagatcctagaacagtgcctggtggacaatgggtgcccaaaaagtattttttgaaaaatgaaataaatagcatgatacgggtaatactgagggttgtaggagcacagaggtggagcctcccaacccagcctgaggatgtcaggggatcttcctagagatggtgaggaggaatgaaggatgagtagatgttggccaagcatagcggtatggggcaggtcgagggaggtgggcagagcattctcaaaagagggaacttaaagaatatgagtgtggaatggaattatgttgtacattggatgttgctagattagaaagcagtagccaagagtggcaggggtgaaaactggagaagtgggtaaagagacctacccaatgacacacagctggtaagccttgtggactaaatccaagactcttgaatgaaaacctccactctttttttaaaaaaaaaatatggcataataagatatggataacacaaaatttaccttctaaccatttttgtttttgtttttgagatatagtttcactctgtcgcccaggctggagtgcagtggcgcaatcttggctcaccacaaccttcacctcctgcattcaagtgattctcgtgcctcagcctcaccagtagctgggactacaggcacacatcaccacgcccagctaatttttgtattattagtagagacagggtttcaccacgttggccaggctggtttcaaactcctgacctcaagtgatctgcccacctcggcctcccaaagtgctgggattatgggcatgagccatcgcactcagccctaaccatttaaaaaagtagttgggt

SEQ ID NO: 27400 - DNA, 1020 bp, Homo sapiens
ctcctaaatagctcaccttcacaagcagggtcttgtatttgaggcaggtaggttggttatgccattttcagatggggagactaagaccagaaaggtgatttccttaggggcagagcctagtctggaagtcaggcctgtgacttcagagcaagggtttggggtagatggcacatgcgtgtgtacgtgtttgtgtgggtggagagaaaaggaggggcgcgggaggagttgctttagcctttgtctgggttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagacgtaagtcccaagtcctgagaagagggactggggtagggtagggaggatgtcctgtgggtcctgaatcttgtggcactctctcccctctggttttcttggccctctatgcttctaacttgggacctgacatgtaactctcactgtcc

SEQ ID NO: 27401 - DNA, 1029 bp, Homo sapiens
gcatagagtgttgaataagacagaggacactgcactcaagaaatataagtctactagctagggcaggtgtcagttaattaattacagttgtgttcagttcccttaccaagggaaagagcagaatatcctgagaggacctggattgggttcgaagggggcacggtgttcgtcacgtaagcacttcaatactagcaacctattgtcatcatcgcttgttggctggggaagacagggatgattccagaacccagattgcccagtttcagtggcagggctgttccccatctactcactggcttgggactctgaacatggcctgggcaggtggggtggggagtgattcttacctttggcagctgttaactgttgatatttctttacacagaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattcttaataggactgtacaaggacagtagcttcctttttcacttacttttgcctcctttctggagcattgggttttgtgatgattcatagactctttaaggtagggaaagggtttggcaacgttaggcttttgaagctaggaagatagcagagctggagtagatggtgttttgcttccttgggaggggtaaagaggtacagttaattaaatttttttatt

SEQ ID NO: 27402 - DNA, 1045 bp, Homo sapiens
ccgggggcagatactttcggtttgcagctctcagggcagcgctgccctgggacgcccagtgggttttcacggctcccctgggtctgggatcagggcagctccgcctaagggcgcggcccaatctgagggttcgtcgcccccgcgtggtcagacgtgggaatggcagcttctgaagctctatgtgtggtgcctttctggggctcaccaggtgccatgttgcgtgggaccatgaaactgtggtggtcttgtctctgccacaagataatgtaggcttgggcctcaagataatgtcggcatggtgtcccatctttggcatgagtcctaccctttccaagtgcagtggtggctgattcagtggtggctcccagggatatgataggcaaagggggttcggtctctgctgtctgaaattaatcctgggctcaagagagaggggcgcaggtgaggcctggggctcttcatgcctgatttcccgctacccctctggcttcctccaattcctacatccaagttaactctgagacctgtggttaccaagaagacagtcgatgtgggggaagggcaaaaccaagtacctactatagctacaaggaataatataaaggaattgttccattttgtatattggtatcatcagcttcttgagaagccttttgggtaatttattgtaaaaatcactactttaaagacaaaaatccttaattttaaatgctacaaaatttaagagctcgtttgagttgatgcaggacccacagttccctatagggcgatcactgatgagtgtatgtgagctaaacgcacaggagcttattctcgagagttctcaggaattctccggaattatgagaagcatatcaaccgcttcatcgggggggctccacttggcattttacagggagagttgggcagttcccttctcaaggcaaacagatcttacagtggcgtttattcagataaatatgagagccgtgtgggactggctgtatgatgacggggatatcctcccactgaatatgcctattacccaggtcatggtaaatctggg

SEQ ID NO: 27403 - DNA, 1032 bp, Homo sapiens
gcccaccttaattcatcctgggccaggcacagtggctcatgcctgtaatcctagcacttggggaggccgaggtgggtggatcacatgaggtcaggagtttgagaccagcctggccaacatggtgaaaccccgtctctactaaatacaaaaaaaattaaccgggtatggtggtaggcacctgtagtcccagctactcaggaggctgaggcaagagaatcacttgaatctaggaagcagaggttgcagtgagcagacatcatgctattgcactccagcttggtcaacagagtgagactccatctcaaaaataataaatagtaaagattaactcatcctgtctccatcactcactgagacctgcctgttctcttccagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaagttgttgcgttgtaatttcactagggttggaggtactcagggtaggcagaggtggaacttaaggatgtggggccaagcaatggggtgacaaagatttattcccttgtaccttattttatgactctgcatctgtttcttcatctataaaatgagtgtcacaataatgcctcctgtctatggagtcggtgatgtgtaccagcaatgttagtgaatgttggagctccctcagctgtgttgcagatgaggctgagccagaccttaggctgaaacctactcctatagctgtagaaggaacaagcgtgtgtgttgggggggggatcccaacacacagccacccatgttctgtcctgaagaagaatgcttaggtcaccctaagcaggtccagggcctggggagacagccaggaaa

SEQ ID NO: 27404 - DNA, 1074 bp, Homo sapiens
aactccttcaggtctgttagcagctggttggttgtgcaagcctgaagcgggaggggtttgggattggaagttgggtcccttcatgtctataattgtgctcttaggtctctcctcttgggttttttcttaatctaacattcatacaaatacacttgggatcttgttaaattcttttctgtaggtgtgaagtggagcctaagatccagtctgtttatttattttggtttctaaatagtttccaagtgatgtcattgctgcggtctgcttaagaacaaaatttagagcaatgttcttagaatgtggtccttccagcagcagcagcatcacccggaacttgttaggcaaattcttgaccccaaactgccctccaggttctgaaggtctcccacggttgaaaatcactaggttagcggatactggagaaaaccagagctcagaacctggcactaaattagtcaatatatgctggccagggccgggtgtggtggctcactccctgtaatcctagcactctgggaggcggaggcaggaggattgattgcttgaacttaagaattcaagaccagtctgggcaacacagtgagacccccatctcaaataataaattttaaaagaaaaataaataaatcttggccgggcctggtggttcacatcagcaatctcaacatcttgggaggccaaggtgggaggatcacttggggccagaaattcaaggttatagtaagcttatcactccagcctaggcagcagagtaagaccttatctctaaaagaaatgtttcgaatactaactgtggtggatgtgttttcatctgccatgtggtccttggtcacggtgtttggtaccttagatggccacatggcctgccttgggccagtcacaggtctaaactgtagttcagattcaactggtgttgtctggaattaatcactgggagagagtaaagttattttactaatggggttgctaaaagagaagggagtcagtctcagctgctgggggagcccgctgcagacggaagaaagccaagtagagacaaacagctgggagtcggagagatgacattaactgaga

SEQ ID NO: 27405 - DNA, 1033 bp, Homo sapiens
cacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtaagggcgggcggggcggggcgggccaagagggtggggaggaggctggacctccggagggctgcctggaggaggaggggtgcataggcacgcattgggctgcgtggccattcattcaacaggcactcattgagcacctgctgtgtgccttgtgaagagagctaagcctccacggccattggtttttgaccacccactccactttcactccattcacaggcttttctggaatttataactgcagtttctcccattgttttgagcagctgcagcaacccaaatacaaagtatggctttcataaacggataaaaacaccttggcgataatttccttcatcagtctcctctttacaaaacagtcacatggtcgttggaatgttcgttcattcattcattcagtttttagttcttatatatttgttgaaacagggtctcactctgtcccccaggctggagtgcagtggcacaatcagctcactgagccttcaactgctgggctcaagcgatcctcccacctcagcctctcaagtagttggaactggaggtgcacgccaccatgcctggctaattatttgattttgtacagactgggtcttgttatgttggctaggctgttcccagactcctggactaagcgatctttcggcgtctcaaagtgttaggattacaggcatgagccactatgcctggtctattcattcattttgtaaatggtttttgagctccttatattaaccgttttcaaacactttccatgtgccaggcagtgttctctatgc

SEQ ID NO: 27406 - DNA, 1062 bp, Homo sapiens
ctgcaggggtcagagggtggggcaggaaaaccgttaagagactgttcagacagggaggtgacggtgacttggaccagggtggtggcagtaggatcagggagaagagttggattctagatatgcttttaagatagagccgatagaatttgctgagggattggctctgggaagggatatgaagagaggagtccaaggtgactccaaggcctctgggctgggcatttgggaggatggagctgccctttgctgaaatggggacagtggagggaggagcaggttgggaaaggagatgggagcacctcgtgtggacctggcattgagccaggtgtttgaatatatgatcatctccttctgtccattttatcacgcccattttggaaaggatgtgacagagagttgaggttaatcagcatgcccaaggtggccctgctggtacatggccaggccaggcctcccacccctttaccactctgctgtcctactgtgttttcttggctttctcagtcccgttcctcctcttcgttttgaggaaatgacaacaggagaactctgcagaagaaaccacctaggagccgagacctctccctcgttcctaaagagctgtccagcggttaacgctggacacacatcaggtctgctcagtggatctgtcacccacatttttccctgacaaatttgttggattaacctcatgaagatgaatattccacagtagaactcacacttaaaaaaataggagtcagtggcataaaggctttgatttttctgtggacacaggcttaaatccagattctaccgcttgatggcttctccatgggagcctcagttttctcatctgtggagtgggtgtgtattactccattctcacactgccaataaagacatacccaactgggtaatttataaaggaaagaggtttcattggctcacaggtcagcatgtctggggaggcctcagaaaacttacaatcatggcggaaggggaagcaaacacatccttcttcatatggtggccggaaggaggagaatcagtgcccaggaaagggggaagcctcttataaaa

SEQ ID NO: 27407 - DNA, 1101 bp, Homo sapiens
tcggggactttggaaataattcaagcaatgaagattggaagagatgatcagggaaggggaaataaatccagcagagatgaaagccaaggtccgcagctgctcggaccatcaaacctttataagcaatgtgaggtttttaaggaaaggagtgaattatagctgttaggaccaaggacaaaaaggctttgatctaaaagtgggagacatcttaaaggaagctgtggcttttgcataaggtatttccacatcctcctggggtgcattagatgaacccatttggaatttacaggtctgcagaagggcccttattcctaagggtatacacttgaaacaagcggctttgcaggagtggagttgatatttggagagagaaagcgtagcgctccagcaggcatacctgagaaccttgcagcgttttacgaggctccttgccccgctgggacagacagatacaggatgtgtgatcttacgaggcattcgagcattgccatgggaggtcattttggtgagcccttgacctctccatttgaaaagtatcagtttggaaaaggttgtctttactgccaggaaactttagaacagaggctataacatggctttttggacagtcactctgtcgctaaccagatgttggcctctgtttgccctggggcgagaccctagcctatgccggactttccctctcgttgagcactggctgccaaggactcatcacagcacgttctgcatcgcttcgccattgcagtgtatgcacggtgcacgtggctggcatcgcagaacgccatcaaaacagccccataggcggccatctgctgtgaagaaatcagaagtatgtgcaccacatacatctaggtgcattgggaggaagaagtaggggggcggatttttagctgggttaagtcaaatacccaccgaaactatgaatgaaccttccagtaggaccaaaaattacagcagattggaaatgggagaaaactgagatgaagaacaagcccccgaggcagacactcctgggttctaatcccagttttgctcataatctgtgagttttaatttgcaagttgcttaacctcaaggatgaaagcttcagtttctcacctc

SEQ ID NO: 27408 - DNA, 1049 bp, Homo sapiens
ggtcttgccgtgttgcgcaggctggagtgcagtggtgagattgtagtttactgcagcctcaaactcctaggttcaagcaatccccccgcctcagcctcccaagtagctggaactataggcatgcgccaccacacctggaatttttttttttccaagatggagtcttgctctgtcacccagagctggagtgcagtggcacagtcttggctcgctgctacctccgcctcccgagttcaagcagttctcctgcctcagcctccctagtagctgggattacaggcacacaccaccacgcctggctaatttttgtatttttagtagagacagaatttcaccatgttggccaggttggtctcgagctcctgacctcctgatcctcccgtctcagcctcccaaagtgctgggattacaggtgtgagccactgtgcccagccaatgttttaatttttttgtagagacaacatctcactatgttgaccagactactagagtggccataatcaagaagactgaaactaccaagtgctggagaatctagaactctcgtgaattcctagtaagaatgcaaatggcacagccactttggaaaacagtttggccatttctttaaaaagtgaaacacttaaatgaccaaactccggggctcaagtgatcctcccacctcagcctcccaaagcattggaattacagaaaaatctgaggccaccacacctggcctcaaattttttaaaaacataattattaaggaccaggatctgggtagtgggcactatctcacttatttctcaccatagccctttgaaaaggacaccgtttattttcttcatctatccaggaaattgaggttcagagaaatttggtaaccaaagtcacaggttccatcccagcctgtcagacctcaaagaccccacctggccatggtaccctcctcctgcatgttcctctccgactgtaagaaacctaacctggctcttgggtctgggccgccaacatgccatccggacagaggaagatccagagacttaggggtcacgtgagccatagccacg

SEQ ID NO: 27409 - DNA, 1112 bp, Homo sapiens
attataagcgacagaaattcaatgcacatcagcttaggccaaaaaggagaatttgttcatgtcaccaagatgtccaaacgtagacctaaagcaaggtgggatccagctccctaaatattttcatatgaatctgtgtgcactgtcaggaaggctctgcctgtagggtgacagagatggctgccggcatccttgagcctagatctaccagctcagccaccccaggaaaaaaaggtgcctctcccaggagtcatagctaaagtcctcaggccaatgcccattggctcataatcatccttgaatcaatcactatgattctagccagggatgggttatgagatcaccctgaaagacccataatgggtgttatttttactaaaaattattaactgctaatttacggatgtgactgctcattctcagagagattgggtatctccacaatagcatgctgcctcctttgctaaccggttgttttttgaaggtgtctaataaagacactgtgttgggaatccccaagaccaccttcggcctcaatgattgactagaactcacaaggctcagagaagctgttagactcacagttacagttattacagtaaaaggacacagattaaaatctgcaaggggaagaggcacatggggtgaaatccaggaaagaccaggcacaatcttccgggagtcctctcccaggggagcacggacactccacctaattctcccagcaacaatgtgtgcgaacacatgccaagtgttgccaaccagggaagcccacttgagccttgatgtccagggtcttattgggggtcagtgacataggcatgcgacacctaagtaactgacctcagccactcagacaccagcaccccagagcaaaaatagacattcaccataaactacattcttagcctaaactatctcaagtggaagtgcatggtgtggcccaagggcttggagctcatgcaccaggaactggccaagggccagccctgaagacagacatttcttaaggaatgtgcagggtttgagcaacccaggcctgctgagttaaccctttcctgcacagccagcctctaaatctttatagcagaccccaaatgaaatcagctaaatgg

SEQ ID NO: 27410 - DNA, 1085 bp, Homo sapiens
tcctaaatgacatttgttagaaaaacaggaaaattcataagaataattggaaagaccgttaaaatagataaggctttagcaagcttaatcaaaggggaaaagagagagatcaataaacaacatccagaatgaaagggtggacattactaaaatccaggggaggttgtttcttttaattacaagaatgccaggcacactgttttaccaatgaatttgaaaatctaggtgagattgacacttttcaggaagacacaaattactgaaattagcccaagtggaaataaaaataaatacaacaaaccaaagatcatgaaaatttgttaaatcattaaagagaaagtgcgtttttggtgcccccaccaaaaaaggcaccaggtcccactggttttaaacaagagttccaacaaaacttcaaggaaaggataaatctcatccagcataaactacagagcaaagaaaaagatggaatgctctcccacacattttataagactaacatcaccctaaagctgacactggagttacagcgcatatgacaaatggacaaattgcggtcgtcgctgctgaagttggaaggcccctgcgatcccagcacctaccttcatccatgccctgtgactctttacagaagttttctgcagatcctgtctgagctttagtttccacactggtgaaaagaggggtctggactataattggtatcatttatttgacacctgccccttgcctcgtaacacacctgcaagcagatagaataaccatattttgtaattttttaaaaaacactgaagactgtctgggtgcagtggctcacgcctgtaatttcagcactttggaaggcccaggtgggtgggattacctgaggtcaggagtttgagaccagcctggtcaacatgatgaaaccccatctctactaaaaatacaaaaaattagccagatgtggtggcaggcatttgtaatgccggctacttgggagactgaggcaggagaatcgcttgaacccaggagatggaggttgcagtgagccgagatcaccccactgcactccagcctgggtgacaagagtgaaactctgtctcaaaaaa

SEQ ID NO: 27411 - DNA, 1032 bp, Homo sapiens
tttttcttgctctattgttatggcgagtacttctagtacattgttgagtagacatctttgttttgttctcagtgttcggggtgaatattaagatgttatgggtctgctgatctgctttgtattagtatagtattgtttctagaatttcatataaatcccatgtaatcataaagtatgttgtgtcagcttcttttttttctttacgtatattttgttgctgttgttgtgtcatacttcttttgcttagtctaattccctgagattcattcatgttgttgcatatatgagttcttattttgtttctgagtatgtatatagtatatagacaatacatatgggcagtttgtttatttaccagttgagcaacatttcttagctattatgaatagagccgctgtgaacatttgaatacaaaccttagcgtgggcagaaggtttcattttcttggacaaatatctaggaggtggaattgctggatcatatggtaaatgtatgtttaactttataaggaactgtaaaactgtttacctgtctgttccattttgtgttctcaccagcagtatagccaaatttcagttttgtaacctcaccaacacttggtattaatattctcctatgttttagccattctggtagatatgtagtggtatcccattgtgattttaatttgaaatgtcattcagcttctttggtgaagtgtctgttcaaatcttttgcctccttttcctttcctttttcttttctcctcccccttctgttttgaaaatcaggttgcttttctgttactgaattcttagaaaaaactgagttcttaggaaaaaaactcatttttttaaatgttctcgatatccatcttttattagatatggtttgcagatattttctcccaggctttgttggtacaattctaattgatcagctgagtctctgtagtaatgctccatttcttggtcatatgtatattttgaggaataacaagtgttttaaagctcaaaataacagttatgctaacatatactataagctgcattc

SEQ ID NO: 27412 - DNA, 1058 bp, Homo sapiens
cggtggctcacacctgtaatcccggcactttgggaggccgaggtgggcaaatgacctgaggttgggagtttgagaccaacctgaccaacatggagaaaccccatctctactaaaaatacaaaattagtcgggcatggaggcacatgcctgtaatctcagctactcgggaggctgaggcaggagaattgcttgaatccgggaggcagaggttgctgtgagctgagatcgtgccattgcactccagcctgggcaacaagagcaaaactccgtctcagaaaaaaaaaaaaaaaaaaggtgggggggtttgaaacacatgggcaattagaaatactggtgtcagagtttaacaagtgaatgactctcaatgactgattaacaaacgacctattagttggtttctaagtgtgttttcatcagaattgaggtggaagttaatcaaattgctctctgagagatcatgaaaacataatttttgatggtagttcactgagactcttatcatgtaattaagattatactgaaagaattgaatgacatcgctttcacataactccttccatgtatttaatctacttatgtcagcacattttaatcttacaaaaaatgagtgcatgtcagtggtgggagaaggacaaaacatcttgctcattgtagcgaacagattcactgacagtgaaaagtgtatttttatgtatatattacccaaatttgtaatatgtttatgttttgaacaattacatcctaataatgatcatagtaactcagaataagatgtttttcaatacttagaccttatgatcagatggaatttaattatttcagtttatatatcttttttcagatataggataataaaatacattcaagcataaaatggcatttcctcatgattaaattctggggaagaagaacggaaattttatatttcaggagaaaggaagagttgtagaatttctgacttggagatgatctaggttcttttcaatatgtaagagtgatataacaccttattaaaatgctaatgctcataatatcttggaagtgactacttcgtaact

SEQ ID NO: 27413 - DNA, 1058 bp, Homo sapiens
atactttattgtggcctggtgggtagctccatcccagcacttggggaagctaaggcaggtggatccctttagctccatgagaccagcgtgggcaacatggcaagattccatctctaccaaaacgatgtaagaattaaccaggcgtggtggtggtgtgtgccggtaatcccagccatttgggaggctgaggtgggaggatcacttgaacctgggaggcagaagctgcagtgagccaatattgtgccaccacactccagcttcggtgacagagccagactctgtctcaaaaaaaaaaaaattattgctaaaaaatgctgattgatcatcttaacatttagtaagctgtaaatcttgctgggtgaaggtcttgcctcagtattgatggatgctgactgatcagggtggtggttaatgaaggctggggtggctgggacaaattaaaacagttttttttttttttgaggcagagttttgctctgttgcccaggctggagtgcagggtgtgatcacagctaactataacctctgccttccgggttcaagcagttcttctgccacagcctctcatgctgaggcaggaggatcacttgagcccaggagttcaagaccaggatcacttgagcccacgagtttgagaccaagctgggcaacatagcaagaccccatctctataaaatattacaaaaattagctgggcatggtggcatgcgcctgtagtcccagctactcgggaggctgaggtgggaggactgcttgggcctgggaggcagatgttgcagtgagccaagattgtgcctctgcactccagcctgggcaacagagccagaccctatctccccaccccataccgtcccccaataaaaaataaataattttgtttttttaaaggctggatgcggtggctcatgcctgtaatcccagcacttggggaggctgaggtgggtgaatcacctgaggtcaggaatttgagaccagcctggctaacatggtgaaaccctgcctgtctctattaaaaatacaaaaatgagccagacatggtggaggcgcctgtaatccca

SEQ ID NO: 27414 - DNA, 1041 bp, Homo sapiens
tggacataattgcagaaattgtacaattaatgcctccccctttggctgagataaatggttttggatttgtcttgctttcacatgtaaatagtgttgaacagttaacaaccccatgaaaaaggcagggtagtttttctctattctttccttatactctcatgggactctggtctttttaattcttccttttatccatggtgtctagcacaatgtggcacatggatgcttagcagatgcttactgaatgaacatagctttcattttaggaactttaggtctgtttatacctgcttcccttttcctaattaattgatggcagcaactgtgatttgcttatttccaagtgccagtgcagtgcctgattctaatagatacacagcaagcatttaattgaaatcgaattaaaatctaacacaagatcatttcaagaagcaggactttacaaaatctaggttttcagaagccaaggcgtctgttttcactgcgttattatgaattttcaggctgattccgtatagaactaaatgtttaatttattaaatatgtagaatacattataagtcagcttgattctttctagtatatatcacaagatatgtggtaatacctgtctttattttactagacatgcatatgctgtaatttgaaataattccttgtcccccactcccttatcaagaagattatagcatttaaaaaagattgttataaatgtcttaccaatgttctcctgggaagcaaatacatttttacttaattgaacatacaataatggactaagtaatgggaaaaaaaaattcttaaactgagttaagtttatatagctcaaaaaaagtggtaccattttatataactttattattattattttttaagacagagtcttgctctgttgcccaggctggagtgcagtggcgcgatctcagctcactgcaacctctgcctacggggttcaagcgattctcctgcctcggcctcccgagtagctggaactacaggcgcccaccaccacacccagctactttttgtatttttagtaga

SEQ ID NO: 27415 - DNA, 1058 bp, Homo sapiens
gcctcccaagtagctgggactacaggcgcctgccaccacgcccagctaatttttgtatttttagtagagacagggtttcaccatattggccaggctggtctcgatctcctgaccttgtgattcacccgcctcggcctcccaaagtggtgggattacaggcgtgagccactgcacctggctctttaattattcaatttattattattattgtttttaagagacagagtctcactcggtcacccagtctggagtgcattggcgtgatcataactcactgcagcctcaaactcctcaaacaagcagtcttcctgttttattcctaagtagttaatgctataggtgtgcaccatgatgcctggcttatttttaaaaaaattttgtagagacagggtgttactgtgttgcacagattggtctcaaactcaagtgcctcaaactcaaactgcctgagcctcccaaagcactgggattacttgagctactctttttaaatatgaaaattggaaaatcaaaaccgaacatacctttaagtttaaaactcttttatttgaggataattttaaacttaaagcaaggttgcaagaaaatagtacaaagagtttttacgtttatctcccccccgggtcaggattcacctagtgtcaactcccttcctcatccttgctctgcctgtccccattcccaggtttattcactcactcattatatatgcaatttttcttaaccatctgaggataatttgcatatgtaatagcctgttaccccaaatattatactaagaatattggtctcttaaataaccgtcgttcatttatcaacttaagtgtattaatattgacaacatacttttatgtctattgtccatattctaattttgtcagttgatccaataatattctttatagcattttcttaccctctagcacaggattcagtctaggatcaaatattgcatttagttgtcattttcttatagcttcctttaaaatctggactgtttacagactttctttgtcttttgtgacattgacacgtttgaaaatacaatacccctgaga

SEQ ID NO: 27416 - DNA, 1123 bp, Homo sapiens
ctgggcgacaaaacaagactctgtctcaaaaaaaaaaaaaaaaaaaaaggctgaaacgagccagtgtataaggagcagctatgtggtattttagagattaccatgtatagattgttgttaattgtgataagaggaactgtaaatgacggctcaaagttgaaatgcttggatgatagagagcatttacaggaaacagcttctgtgatatgattccaccagctgtagcatattaggggagaggatcagggctgcagggactgtatagtgtagatgttagctaggagtgtattctttgggaccctagacttctgtgttcaaacctcctgccttccacttgctacgtttgtgatcttggacaagttacttccttataggattattgtaaagattaagttaattgacatgtgcaaaaaacttggcatgtagtaggtgctcagtaaatgcttgctattacttttttattattattattttaagctgtgacaaaccacagcagctgtaattactctggtttgatgttcttaaccttagttcctcgttcaggaatgacttactgctctatttggtttgtagatgcagtaaataagaatgtaattacgtgattgaaaggctgtgttggagtattaacttcctaaactcaatgaagacaggggttgtcctttgtaaaaattgtgataatcatgatggagcagatttggagtaatctcaatgattcgtccgcactatacaccaaaagcataaatagggactgcccaagtaggggatagtgcccttccaacctttatctggagaaatcaagacagcctgtgagagtattcatcgccccaaggatactgttgctctttaccttgttatgaaactttgatatatattaataatcttcaacctttcagccctctgttggagaatataattacattcttaaacctcccttttataattgtcttatttaagactcatcttctcccatcatgtatctttaagttatgtttctgctcttaaactatatgaagtttggaggcttaataggataatctatttaaaattcgatatggaaaaatttatctatggctgggcactgtggttcatgcctgtaattccagcgctttaggaggccaaggtg

SEQ ID NO: 27417 - DNA, 1041 bp, Homo sapiens
aggcggagacaggtgaaaaggggacgctagtacaatctaagtttgggattttgccagaagttaagactaaaggtcagagagagtccaggctattgattgcgtgtcatctgataatagtcctgctgatgggatctaccctggaaaatgaggaaaaaggaaagccgagaggttggccatctcaaggtttgacaggacaaagacaggttctactgggagcaattgagagggtcagctggaaggagagaagaggaaggagctggaagttccccagttccatatagggacaagagtcagtgtgaccagcctcaccaggctggcttggagtggaggaggatgtggtaggtgactgggagctaaaggaatttaggggcagcgttggtttctgtgggggaagcctgcgacagatagaagtctgaggagtgtggaagggttactgtgggatctgggggcattggccactgatgggattgttgggcagtgctgggtttgaggttggtgatggtgattgttggacttgccttgggagtggaagagagaatgcgagccagtgtcagaggtgctggtgaatggaggtgtgtgacccgagcggtaacatccagaaaggatttcccgcaaagacagcgcggcttttcagctgcagctgccccaccctgctccagtctccctcatttccagcctggaaattgttgctaattgccccattggcagttgggaaggcaacgcctgttaagatgtggagcaataaagtggagcaggtatgctgtgccgtatgcccctcttcctgcaccgtcctccttctgtcatcgttgagtggctcaggagtgctggccctctaacagactgcctgggcgtggatcctgactgcagagtagcacttctggctgtgacgtgggcagatggcttaacctccctgtgctcagattcctcacctgtaaaacagttaatggatgattagagtgttcctgcctccctgggttgtggtgaggactgaatgagcacctgccactaggaggcaatcagtgagtcagctatcatcattat

SEQ ID NO: 27418 - DNA, 1045 bp, Homo sapiens
tctgtgtaattctttattttaattcccttttttcacatggctgccaagaagctcaggtttacattttttctctgtgactaaggttttctgtcataactggctcttctctaattcctttattaatggtactttaaaaaaatctgtacctttcatgtttagctgcttctaatctttttcaaaagtgaatgggggtgggtagggctgctgcattgcacagttctggaggcaccattgatctggagagaattgtatattgctgtggccctggcagtggggctgtggataacaaacactcgtaaggcttaagcatcactttggccaaggcttttccaggattatgtcagtcatgggctggtggcacaggaaaaggggaaaaagcaacagctgggaggttcacagataacttctttttggtgtcaggcagccctttagggtaagtacagtactaatttggctatgactttgtacttgtgttttaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggtatgttggtgatcatcctctgtggacttattgccatttttactttttcaaaagatgcagaattaagtctttcctcaaaagaagcaactaaaataagcaagccctgttcctttattagtcacacagtcctgggctgatattctttgtattagcaggttcagttcttagaacgtgctaatgttgcttggtatataacatcattattaaaccctgtttactcagacttctaatacttaaatttcttgccacttttcttctctctcaaaatagtatacattcattatagaaaaataaaatatatagttacccgtctttccttctctgtattgaaaagtcagtatgactgtattgaaagccatccataacccatagattgcccttgttaacatcttacttaaatccatctagatttt

SEQ ID NO: 27419 - DNA, 1093 bp, Homo sapiens
aaaaaacgcctacccatgctcatgcctgtaatcccagcactttgggaggcaggtggatcacaaggtcaggaaatcgagaccatcctggccaacatggtgaaaccatgtctctactaaaatacaaaaaaaaagaaattaactgggcatggtgacgcatgccagtaatcccagctactcgggaggctgaggcaggggaatatcttgaacccaggaggcagaggttgtagtgggccgagatcgcgccattgcactccagcctagcaacagaacgagactccgtctaaaaaaaaaaaaaaaaaagcctacccatgaatgagagttggctgagttgacagtttccttttttttttttctcccctcaaaacttttccattatttctctttactcaaaacttgacctaaaaatccaggagagatatttcccataaagaagcttcgtacttattagcaatcactctccgttttcttttctttccttcccccattccttagtcactgtaaccactgatctacagatttgcctgttctggacattgttccattgtccatctttccctttttattattttaatattcattatattctatttattaaccacgtagtttccttatactaacatctttccctttaattctatcctttttcaactcatgtatgttgcctctattgttaagtgcatataatgtcgtgtcttttgtgttcccatcttcttccactgttactgccttctgccttctttgtgttaaatagatattttctagtatatcattttacttctggtcatttcttgtactatatcttatgtattgattgattgattgattgattgattgagacagtctcgctctatcacccagtctggagtgcagtgatgtgatcttggctcactgcaacctctgcctcccaggttcaagtgattctgctgcctcagccgcccaagtagctgggactacaggcatgcaccaccatgcctggctaatttttgtatttttagtagagacagggtttcaccgtattggacaggctggtctcgaactcttgacctcaagtgatccacctgccttggcctctcaaagtgctgggattgcaggc

SEQ ID NO: 27420 - DNA, 1059 bp, Homo sapiens
caggtttggggcctgcgtattactaagccttttgatacgtaccactaagctgacctgcagatatctctgtagccatttacacttctgtcagcaatgcatgagagttcctatttctccatattcattccaggtcttctcattttaatttgttttagtcattgctaatttgataagccaactgtatcacattgaaaaagtgtttcaaactgctagtgaggtggcatattttctctcataggattgatcattcttaagaattgccttttatgaattcttttatgaattactcttagctcatctactggattattcatctttctcctattgatttatgcatttttaaatatataaataatgtagcatatgcatacatgagttgcagatgatttgcccactttattatttccttttcattttggaaaatttagcttttaagtaaccaaatctatgcgttttttatttatttttttattccacttctggcttccacttttggcatcattaccataattttataaagatccctctgtatatcctctgtacatatgaatgtattaacatttttaagacgtattcttgatacatatcaccaaattgctttctacaacagttttgccaggagtgtacaagaatgcccatctcactgcagggagaatagcttttaagtgtcatctttttgttttcccagaaatctgagtggatgacaacaacctgcaatcacgcactttatgctatttgtgatgtttttacccagttttatgaagctttgaatgaagttcttctttctgatgtatttgcacaattgcagtggtgtgtcaaacaaggtactctttaagcctctaggcatcatttttcttacatagtctttaatgagaggttagttttttcaatatttaaaagcatggatgtagtgccatggagtacaatatataatttagttggtgaaatgtatacgttttaattacagtataaaaaacagtgccccccccaagtcagttcataaagcatttcttaaagatgggatatagttatttttgtattctacaagatgtaccttca

SEQ ID NO: 27421 - DNA, 1050 bp, Homo sapiens
cgggagaatcacttgaacccgggaggcagaggttgcagtgagctgagatcatgccactgcactccagccagggtgacaaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaaaaaaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattcttaaaatatttcatttattgtctgtcaacaccatgggagcagagatttttttttgtccagtttattcattgctgtgccacaacatcaagaattgtgccttgactgggtgtggtggctcatgctgtaatcccagcactttgggaggctgaagtgggagcatcacttgaaaccaggagttcaggaccagcctggagaacgtagtgagaccccatctcttaaaaaaataaatcatgccttgcacatagtaggagctcagtggatatttcttcagtattggctgaatcattattagggttaatctttatcatctaacatagatcagaaactgtttgccagcctcctcatcaagtgtgtggtccagttggaattgatacag

SEQ ID NO: 27422 - DNA, 1028 bp, Homo sapiens
tttttttcatagaggaagtcatgttttaaatactagcaaaagtaatgtaaattttattactgctggaaaaaatacagctgtgagccagaggctgtccttttgattttaaaattttaggcagcttgttcagtaaagtttcctagggtttcatacatgtttcaagaatgcattcctgggctaggtgcagtggctcacgcctgtaatcccagcactttgggaggccgaggcaggcggatcacgaggtcgagtctgagatcattctgaccaacatggtgaaaccccgtctttactaaaaatacaaaaatgagctgggcatggtggcgagcacctgtaatcccagctagtcaggaggctgaggcaggagaatcacttgaacccgggaggcggaggttgcagtgagccaagattgcgccactgcactccagcctgggcgacagaaactcttgtctcaaaataataataataataataattcattcctgtaatgaaataattggagacacacacactcctgcttatgcagtggaggcagcactgatgaaactgaaactttggccagccaagcctgccatcatggaacggctcagtgtgttccttcaccagccagtgagcagagtctaaatggaaatgtttcagggtgttggggaataagtgtgtcttatagacagggatgacttttggagagtcatgactgccgttgtctgcaatcacaatgcccagagcattccatcttcttcattagctcttctatcctctgtcctgtcctctagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggtaaggccacacagcagataagatagatggccacactggtcaccttcctaaaacattaaagtgcttggaaaatgcccaaaattttaaac

SEQ ID NO: 27423 - DNA, 1143 bp, Homo sapiens
aaatctaaaaattcactttcttgaagtacttttgaataaacaaatttaattgtggcagttaagttggtcatttgttcatctgacattcatgcaactgagttcccacattatgttggggctgctaatgattgatctgaagggatagtctccagtcttgactggaaactcatgttttgctgggtgactgacatgttgtgacttatcctttagttcatacaacaaatgcttactaaatatgtactgtgtgccaggtaatgctgaaggtcctgagcatacagacgaaagtccctgccctcaggagcttgcagtctagtgtgtgtatgagacgacaaagaagtttatttcaaatgagggtaattgctaacacagtaaaacaaggatgatgtagatggtaatcgtagaaggcctttttgaagagttgacagtgggctgagtgctgaatggtgtccattatcaaattagaggatgagcattattatggtcagggagaactcttgtggccagtttgtagaacagaaggcttttgtgcctggaatgtagcaagagccaggaggaggtaggagatgaggtcagtagataccagattgcttagaccctgctgtggtaagggatttggtggtggtggtggtggtggtggttgttttggagatagggtctcactcccattgcccagtctgtagtgcagtggcctgatcacaactcacagcagtctcaatttgctggatctacaggtgtgtgccaccacacctggctaattttttgtatatttagtagagacagggtcttgctgtgttagcccaggctggtctgaagccggctgaagcaatccacctgccttggcctcccaaaatgctgggctaacaggcggcagccactgcacctggccaggagtttgggtgtttaagacaagtaattatgaggaatctaaggagttttagttgagaaatatacaaatgctagagaaacataatgaagaaagtgaaatgcagatttattaagaagtgtatttttaaaaatcaagaaaataagccctgtgtggtggcatatgcctgtagtcccagctattccagaggctgaggcaggaggattgtttgagctcaggagttagaatccaatctggacaatacagtgagaccccctgtc

SEQ ID NO: 27424 - DNA, 1086 bp, Homo sapiens
taaatctcttgaactgtgtatttcttagcctatgttgttagtagttaaatcgacgtaggccatttagttagcttaaaatttgtgggctgggcacggtggctcacgcctgtaatcctagcacactgggaggccaaggcaggaggatcacttgagtccaggagtttgagaccagcttgggcaacattgtgagaccctgtctctacaaaattttttttttaatttgtcatctgttagatgtgaagttttttggtcagttataagcatattatgtgatttagttttgtttaagctttaaatatgaaaacttctagaatcataatcttagctgtcatcttctgaactctagaatttatctccctagatgcaaattcttagcactttgtagtatttgcgattacatgttgtacatgaaggaatttcttgtttctttaatctcagaactttatgtgggatatttatttgctgtttaaaattttaatttctcgttgtggggccttttttttttttttttttaagacaggtcttgctccatcacccaagttggagtgcagtggcaccatctcagctcactgcaacctctgcccccaggctcaagacatcttcccacctcagccttccgagtagctgggactgaaggcacccactaccatgcctggctaattttttgggttggttggttggtttgttttgagacggagttttgctcttatcgcccaggctgcagtgctatggtgcgatctcagctcactgaaacctttgcctcccgggttcaagcgattctcctgcctcagcctcccaagtagctgagattacaggctcctgccaccatgtccagctaatttttgtatttttagtagagacgggattttaccatgttgaccaggctggtctcaaattcttgacctcaggtgatccgcctgcctcagcctcccaaagtgctgggattacaggcatgagccaccatgcccggcttcaatttttttgtagttttggtagagatggggtctcaccctgttgacaggctggtctcttaactcctgagctcaagcagtccacccacctcagcctcccaaagtgtcgggattt

SEQ ID NO: 27425 - DNA, 1045 bp, Homo sapiens
accaaaccttcctctatttgttttcttagaaaattagtaaataaaaaaacagttatgttttacctaaaatcatgtggacatgaatgtggattttgtgttacttcctcagttactgctttgcttttaggttgaagatgaaccaaacaaaatttgtgaagccgatcgagtggccattaaagccaacatagtgcacttgatgcttagcagcccagagcaaattcagaagcaggtaatgtcgctccactttttagatgggctcctctgtaaagctctgatctaattaatcttttcctctcctagttaagtgatgcaattagcattattggcagagaagattttccacagaaatggcctgacttgctgacagaaatggtgaatcgctttcagagtggagatttccatgttattaatggagtcctccgtacagcacattcattatttaaaaggtattgatgcatagattcatgtttttaaaatactttctaaagttttatttgcttgtgtaaacagttgtgtttttgtgactgttgtcattcctttgaatctgatcatcttggaatgagagcagaagtttctgtattgcgtttgtttcttctcaactaggatgtttatttcatattgctctattacctgtgaaatacttagtcttgataaactgcttgatccctttaaaaagaaaactggctgggcatgatggctcacacctataatcctagcactttaggagggcaaagtgggcggatcacctgaggtcaggagtttgagaccagcctggccaacatggtaaaaccccgtctctactaaaaatacaaaaaaaactagccaggcatggtggtatgtgcctgtcatcccagctactcaggaggctgagacaggagaatcacttgagcctgggaggtggaggctgcagtgagccgagatcaaaccactgcactccagcctgggcgacagagcgagactccgtctcaaaaaaaaaaaaaaaaaaaaaaaaagaattccctttgaatttcggaatttcggaaacccatctattcatagatgtcca

SEQ ID NO: 27426 - DNA, 1060 bp, Homo sapiens
gcctggacgacagagcaagactccgtctcaaaaaaataaataagtaaaatatgaatagtctcagcttagtgcaaggctgtttcactaagatcagcatgctgggtttatgatgcactaaaaccatgttgctaaattcctttccaaggccactattgaactctgcagtacccatgcaaatgatgcctctgccctgaggattctgttttcttccctgatcctgatctcaaaattgttctatagtttaaactttcaggtaagttcatttgatttcttgcttttggttcttactctttgattttaaatagagttttctttctgtttgataaagacttctttgccagcattgatttttctgaaagaaaaggttttttctgactctatttatctatagtgttctgttctacagtagttctttcagatgctaatgagatgtttcatggaaaaaagcagtattctcttatatctagtaggttagcaaaaccccacatcctaactcactcttggagagtcaccctgtacactgttttactggtggcattaagaagctagatttctgaggccttcctctttcgttcatttatatgggtattaacatttggggaatcatgttttggttaggggttgctgtccagcttatacaaaatgacttttattggaagccatatgagggagacaaaagacttgaagtaccagactttgaaaggggtaggaactagtagtatttcagaggaaacatagccacagggctatagcagggaatgcctagttaccctgttgctactgagatagtggcctccaatcattctttctgttcttaatcattaattcaagattcaggaccaagaaaggggtgttaattggtacaaactgttgctatactgcgatgcaaggagggcctagcccattcattgtttgtagccagtacctggacttaccttcacaacatgaataaactcatagtggtagggaaagcattccccaaaaggaaattgggttgttttagctagaataggagatgaacagcccaaaaggacatgtcccacatcagtgttcagctgga

SEQ ID NO: 27427 - DNA, 1024 bp, Homo sapiens
gtgtataaaatgttttgtccacgtggtaagggaacttataaaagtggtgttcttaatattttaatcaaaagtttcaagtcagtgtttattctgtaggatctccctgaattttttgaagataatatggaaacttggatgaataattttcatactctcttaacattggataataagcttttacaaactgatgtaagtatttaaaatgttgcctgagtggtctttttctttcattaagagttatttggctacagtctggaaacctatttactcttgcattgttaaaagataaaatttcaatactgtaataatatttgattctatttgatgttacatgtttggtgtgtgtagtatacagaattactcttatcatgggcttggcttaagccatagtgtacatataaggctgtttcattacattattgaaagtaggtctttaaagtagtgacattatggatatttcatgaaataaaattatttttcattgaagatactaagaaaacttaaaactctataatggtagcccctttttaaaaatcatctggctaggcatggtggttcacacctgtaatcccagcactttgggcggccaaggtggggaggatcccttgagcccaggagttcaagaccagccttggcaatgtaaggagacccccatcactacaaaaaataaaaataaaattagccagatgtgttggctcatgctaatggtcacagctactcagaaggcttagttgtgaggatcccttgaccttgagcccaggagggcaaggctgcaatgagctgtgaccatgccactgcactccagcctgggagacagagggagacctcgtctcagaaaaagaaaaaattatccacagctcgagaaagagagaaaatggtaaaagattgtaatttgtaaatatttctgatatgggttttatattgtgtacttttaaacatataacacttattctgtgctactcatttgttaatatatttatgaccttctttccgaagagacaaaagacaaaatattaaaaatatt

SEQ ID NO: 27428 - DNA, 1030 bp, Homo sapiens
actatcgttgtacaacagattttgtctcagagtttgactatattaataggaactttaaaagatgtagctctcataaaataattatttcagtccaatgggagggaaaaacactccttcagaaaacaaaacttttcttcacacaaaagtcacaaggaaattttttggatagaattcttacaaggacctttttgcccagttaaccatgtgctaccttgtgctactatttatgccttaagtaatcagtgtgagggagttttggttttggctttggtttttgttcttactctgatgtcttcccttgtctcactctgtcaccaaggctggagtgcagtggcatgatcatgacttactgcagcttcgacctccctgggctcaagtgatcctcccacctcagcctcccaagtagcagggactatgggtatgcaccaccatgcccagctgattttttttattttgggggcttgctgtgttgcccaggctagactcaaaactcctgggcttggcccgtcgcagtggcccacgcctataatcccagcactttgggaggccgaggccatcctggctaacacggtgaaaccccgtctctactaaaaaaaaaaaatacaaaaattagccgggcgtgatggcgggtgcctgtagtcccagctacttgggaggctgaggcaggagaatgacgtgaacccaggaggcggagcttgcagtgagctgagatcgcgccactgcactccagcctgggcaacagagggagactgcgtctcaaaaaaaaaaaaaaaaaaccactcctggcctcaggccatcctccagcctcagcctcccagagggttgggattaccggcgtgagccactacactcagccagaatatactgtttgaatctaatacggaaatattttgtaattcagcaacttatttgaaagacttggtgaaaagattggtggtggcatagctgtagtttacaataactgatttgatttggatttaattgataaagagtctagttcaggaatttcagttactcctcttacttatgt

SEQ ID NO: 27429 - DNA, 1517 bp, Homo sapiens
gcctcccaaagtgctaggttacacgcgtgagccaccatgccggccatttctgacattgtccactctacttatttgttgttgaaatgactttaatgaaataatagtgattaaaattaggttgttggtattttaatgttcttatttggtgaaattaaaagttagcattctgatactgatccctaacatttttgacagttgcaggtataatccaattctggggaaactgtcacattagaacaagtgagcctatctcatagttgtgtgaattacctaatacctcacctttcagggtagcatttgctgctctagataatgattaagagtatatgaagtagtcatctgatgggaacgaattctttgctgtagaacaaggcagttttacatactcttctgcattctcagctgtaaagtacagtgacgtcttttggagtgttatctgaaatatcatctctccttgtagctgctgatgaagaagcatttgaagataattctgaggagtacataaggagagatttggaaggatctggtgtgtatcttggttttttagttactagtctcttagcaagccagttttaaggtggttctctttctagtaaatgggagaagtgggattgagaataagagtgttttttcagcgggctttcattgagaactgttgtctttcttcaacttgtcttaaaaagctcttatatgacctgaatgaaaatatcaaaagttgaatcatttgtctgttcttacatagtatttatcaaaattctgtgattctgtgacctctttagtttcattttgattttgtatttcttgggggcgggaatgtttttttcattgtttgtgttgctgatagctattgggtggccctttgtttttcgttcttttttttccgttttacaatcgtagccaaattattccaggcaatttgttttcttataaattggatcagcttgttggtggttgttttttttccccataatatattttcttttcatttcatagatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaaggtaaatatttttaatgtggttttgtttctaaaacagacatcagtgacacccacacaagtcaaaaagaaataacgtctctgataatagagcttactctgccagataacctattctgattaagatttatataatctctgaagatggctttatgttgatgtattgagcacttaagtttcttatagaccagaaaattgatagatggccacacttgttaccttagctgagacccgctgtatcaaatatgcttaacttaaacttagctgttctttaattgaggaaagtttctttattgtctattagtatagtcttattttacatttt

SEQ ID NO: 27430 - DNA, 1026 bp, Homo sapiens
tagaggtttttaatgaagattgttctcgtatttgttgctttttgggggtgggaagagaacaaaaaatgagacacaaaaaggttaaataactttttcaagaaatatctgctagtgatgattcttaagtttggtgaaatcttagtctccttctctgtgatattattattttatggtatgttgatttatctgcaagatgttatcctcatagttttgtgctctgaaaaggagaatttagaaagtggaaattgaaccattatgtgcaagtgaaagttttggtttctgggcagcagcatctcctattataacagagcttaaaaatagcaaattgttctttaaatcaacaggtccttctcttccaattgtcttttactcaaatatggaatcattgcatttagagcatgtatattattgtgttttttaggtgccaaaagaacatcttttagtctcgattcctctcttgattaatcatcttcaagctgaaagtattgttgttcatacttacgcagctcatgctcttgaacggctctttactatgcgagggcctaacaatgccactctgtgagtattttattctaaagttttttagcctggggtaggggctgtactgtgctggtcaaagatatctgaatgttttcataatttcactagtgggaaaacaaatgtctgctttctattcctttatactctgtttcattctaaaagcatttgaggctgcttactaaaataggtgcattatgacaatacaatttaataaactggagccaaggaaagtaactgagataaagttaataaacagaaatgtgtgtcaaaggatcctatatagtagtccaagaaactccaaattttatttggagtctcttagcagccagggcaaagagggaaacttgggaagttaaaattttcacagggtctatgagataaaagttaaagcagagaatactgtacaatagtagtagtagtgttctcagcaacaatcatgtaacagttattttcatgtggctatttgcgtaaggtcacttatttctg

SEQ ID NO: 27431 - DNA, 1035 bp, Homo sapiens
aggctggagtgcaatggcacaatctcagctcactgcagcctcactctcctgggttcaagcgattcgcctgcctcagcctcccgagtagctaggattacaggcgtgtgctaccatgcccagctaattttgtatttttagtagagacagggtttctgcatgttggtcaggctggtcttgaactcccgacctcaggtgatccacccgcctcagcctcccaaagtgctgggattacaggtgtgagccactgcgcccagccttaatgtccatttctatgagagcggctaactagtctgtaatcttcattactgtgtttttagggtatgtaagaatacacagtatgtaataccttctctgtacggttgtatgagtgaatgaaataattctgcgccagcctagtggaggagcaccaatttatcctctagcccttttaacccaggtcagggaaggattttctctaggaagtgatctctaagctgagatatgacctaaccgaacgttaggtgtgagggataggtagcaatctgttgaagggtggatgagtctttgactccagtagaggaggaaacatgatgtgcagagttcaggaggcaagagcagatagctttctgtcctttatgcttggcatgtatttggggctctgcttagtaaacatttattttagaaatgttatttgtggaaagagagcttttatacatttttagctgacaaatttatttttctcccatgcttcctatttttaacccatttatggtcttttgagcaatatttttgcaatttggactctgtggctttacatgtatttttagaatttttttaggctcctaatctctttttttgagggaggtggataggcagttttctcttcagtttcctgtagtttgtgatcatgtttcctttaggctagggctaaacattttctgatgctggtttctttttctttttcttttttttttttttttttgagagagagagggagtctcgctctgtctcccaggctggagtgcagtggcatgatcttggctcactgcaacctcc

SEQ ID NO: 27432 - DNA, 1874 bp, Homo sapiens
gctcacgcctgtaatcctagcactttgggaggctgaggcaggtggatcacctgaggtcaggagttcgagatcagcctggccaacacaatgaaaccccatctctactaaaaatacaaaaatttgccgggcgtggtggtgggcacctgtaatcccacctactcagggggctgaggcaggcaaattgcttgaacccaggaggtggaggttgtagtgagctgagatcacaccgttccactccagcctgggcaacaagagcgaaactccgtctcaaaaaaaaaaagaaaagaaaaagattatggcatttggctacagggtagaggtgtgatggggtttttttatgttttgactttcagtctcttcagatgatcaaaaacagcagtcttgttatttagtaatttatcatattcataagaagtaactaacatctaagcattttactatttcattatagtgataatctaatattaagttgatttattttgctttaatagaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggtaagtacttcattttaatatttttgtaagttacagcttccttcccatatgactgcaaaattaacaaagcttattctcttgggggccaagagaatcttggtctgatctcagcttctccacaatcagatccaagacatgatttctggatccttctgggcttagaatgatcttgtttcctgcttctttttcagggggattcatggacccctttaagagtctgatctaggtgatctctaagacaattttatgacagaagcccaactaaactgacttatctttaaggggaagaactgaataagccaagaaaagaaccatcttaatttcaaaggtccccttttattcttgagactatgagtctgtaattttgtgtctctgagcaattgctggttttaagtcttccgagtattttcttgacctttttatctcttgctttcttccaatccaggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggtaagtgtgttgtcaaagaactctgtgataaatggagactttaatgggagggcaaaaggatagtagtagttctggtgtctgttttcattggtgggcgtaataaaactaaatctcattgagttacagcaagcttattttctttaattaaaaacactgagccctttttttcttgtattatgtactacaaatatattttaagtgaatggatttaggagtgagaacaaaggaggaaaaatcccttcaatagaaatgtaataaggctgtatagttgcattttgtcagcactttataataagagtttatttcccagatcgaagtaatccatctattattaaaatgtggtagcatttttttatttttatttttatttatttatttttttagacagggtctcactcttatccaggctggaatgcagtagtacgattatggctcactgcagcctcaacctcccaggttcaagtgatcctactgcctgtcagccttccaagtagctaggacccactatgcccagctaattttttatttttttgtggagacagggtctccctatgttgtt

SEQ ID NO: 27433 - DNA, 1072 bp, Homo sapiens
tggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttcttccttttcctttcctggactctgtaaaatcctaatttctaaatcatgtaaactcagattatttagtctttttttttatatgggggaaggggacattaatatagatttggggcttatttactagaattttctgtagcagttcctaggtggcagtgtgagttttgggtaggtggctcctctgggagaaatgctctgcctcgcttaatgggatggcggtcgagagtacttgagactgtggatgttttgatctctttcatctctgc

SEQ ID NO: 27434 - DNA, 2375 bp, Homo sapiens
ttcatttttctactctacttttcctttcccctcaatgacccccaccccaaaactgtgcctaaatactattcatgcagtctttgagaatcaaacaggttcacactcttattcctgagtacagaaacttaccgaatcacacagctggataaagccgggattgaaaccctggcagtctggtttccagagcattctggcttagccacttatgccatggtttggcaaaagttagaaacagctaatcagctaataagggcatgatcacaaggcattttgctaataagtttttaaaatatacactatgggtgttttttggttgtgacaattcttgggtccctattcataggagcatcccccgcaccaatccctaggcacaatcctgtatccagcctgctggacatgaccgtttattccatttcgtaaaccctaagcatttgctctgcaaacctcctcctgcttggtccttgctcttactccttgtctgagaaacatggtggctgagctttgtgactgcaaggcagggctcatccttagggtctaccctgaggtattcttagtaggactgctctttgatagggcaaaggagtttcatggaccctttgaaaataatttagaggcattttcctttggtttctctgaatgagctaagaacccctgataataaggaactgctgtgggctgatggtcagttcctccagcccctccattctaggaaggtgtctggtaaagcagctcactgtgtggttggggaagggagacaaactatgaagttgtgccgatttctgggttttttcccttacacatgggatggtgtgagataaaaatctggcaacatagacgcagtgttcatgtcaagaaagagccacaataggtaagtcccaagactgttttctcagacctcatggaaaaggagacctcttggagaagtgagaagcaaaacgagaacaggtttattcaccttggactggaaagataacgccttgtaagcagttagaggcaacgcttttggatccagaggggaaaaggatcgctgctcccagcaacctgtgcttctgcagcaaatagcagagaagacagatcccgagtccctcttaagtgggtccagcagggcacggggaggagaagcttggcactcgccaggtcctccccatccaagacagaggaagtcttggtgtcctggaaaggccaggcaacccctgccacaggtttgatgtccaggtggaggcagccccacacaaagagcctcctctgccatgtttatcgatctcaggcgggaaccagggaagacgtctctaaagtggtgcctgcacagcatcctggccagtcaggaggaagcagcaacctaagccaactgccacaggttggcccttccaaaccccagccatgggaacacctggccctccccactgtgcttaggaactgagtgcttaggaaactaaaggatggatttggccacgggatgggccagaggtgctccagagccagctgaggcacatcaggccaaagtcaccctgcacttcccctgaggcagcagttcccaccaggattcacaagatttggagtgctgtcagaggaaccgcagtcatttatggctgtatattttgtactagaaaaaagtcactaggaattcatgggtgatattgcttaggacagtggttcttaaagtaccgtcaacatcacttagcacctaagtgcttagtagaaactacttcatcaaaaactctgggaatgagacccagcaaccttttaacaacccatccaggtgatgggatgcatgttcaatttggtgagccatgacttaggataaagctaagtaaaagtaagtaagacatagacggtagcaaaaattgtgaagatcaggtttgagaacagtggtctaaagcttcatgaccacaaaaattggaagggaccacattttaaagatgtgaaattaacagctttacttttgtgcaagaggtggcagaaaaaagatgagctgtggtaattagggcccatggggctgagcatcatcaccccgggagctatgggcctcgctgggccaaaaataatgtggcccctgggctgcagaagttctgagcatttccagttttcttagctgaagtttgattcagccttgaacggtgtttacattgtacttgttcataaatccaaggaaccaggaaagaaacttactaagactcagaattttcaggcacacattacaaagttgccagcacattttcagccacccaccaggtgcacatacactctgcgtacagaacagacaccagtcagaggtttgcacagcaaaagggccaagcgacttccaaactacagagaatctcaggccatctgccttgggaggtcttttggcagccataacaaatagactcaaaaag

SEQ ID NO: 27435 - DNA, 1077 bp, Homo sapiens
cccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaa

SEQ ID NO: 27436 - DNA, 2738 bp, Homo sapiens
aaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggttgggagccacgtgtaccagtgtgtgttgatcttggcttgattcagtctgccttgtaacaggtgaggtttctgctttctatctgccaaaccccaccgcaaaatttgtccaactgggcctaacctcaggacccatttccaagttgggtataaaactgggagaataagtcattaggactgacattggcctgttggtattactaggtctttgttggaaataagagcttggagttccaaagaaaacgagcacttgaacaaaagatttctcagcaaggcaaatttacttctgccgtagggtgctgctgctggcattcctggcaagagcacacctaacaaaagagagaaagggtttttattcctaacaagtagtccctgcttctgtgtcctatccccattggctggagtcgacagcgcaatctaaactagtcctgattggctattttaaacaggaggcatgtgggttacagctgtgggaagggcaggaaacttgtttacagagctggttgctaggagtgagggggacttttccaaatagggaacaggttacaggttgagattggccggagaagttgtttatagaacgggtaactcggagcaggaaggtatgaggaagttgaccttaagaacaaagaacaaggaagttaaaactttgaagagaaatccattgtatctaacgatttcccccttttgatttttataattatttctcttcagacttgttttagcgtgtcttgattttgttcctcttggtcctctgaaattagaagcttaactgaatgatgcgagggaggattgaggaagattttggtgggtgagagctgttaaaataagcttttgtattaatcctcagatacagggtatgatacagcatcctacaagaatgagcaaacctattctgatggcaggagattgaggacgtaagtcctttccatttgcggaactatttttccattaaaatcgtgaaggggtcatttattccagaatttctagctagctcattggataaagcagtaagtccttgggcctttgttatggttccatcgggagcagtattattagggatgaaagtacaacactgggttccaatcatgacacaaactacacctttctccgctagtatcatgtctaatgctattgtattttctcaggccgtttgactggtgggccctaattgttaaactgttcccttaatagcatccctagtataattaatgaatcgttgctgggttacattttttgtgttttttttgagatggagtctcactctgtcgcccaggctggagtgcaatggtgcaatggttcactgcaacttccacctcctgggttcaacctactctccttcagcctcctgagtagctgggggctgtcaccatgttggtcaggctggtctcaaactcctgatcttgtgatccacccgcctcagcctcctaacatgctgggattacaggcgtgtgccaccactcccggcccaatctacatttttatttagagttgaccaccagaacaacatggattcaaacttgcagctatttgattttgggccttaaatctatctggcactcctcgtgggattccaatggcatctatataaacatgagagtcacgagggacatccattgttttatgatgttctgtttttatgtatgttttctggatgaaa

SEQ ID NO: 27437 - DNA, 1063 bp, Homo sapiens
aggtaaaagagacagcccctgacctccctattttcctggaaggccataagtggaatattttttctttttcccatttggggcattctcttttgaagtgacctactcttccacatttgaaacatttgttttcccctcttccctgtcctgcactgtgacttccaggttttattcccttactccttgtatacagtttggtcgctggtggcctagagggtttgtaagttttacttccttgtgtctcctactgcagagttctctgttgtaaggtagacagcatgatttttgccttttgtttctgctgctctttgtccctacttatatgcttctctaagaagttagtctctgggacaatctttccaattctctatcttttgtagttgtttttagaggtgtttggccaagtcttagtaacaaaatgaagctttagcatcccttgccccagtgggtcttccatttctaaacctgcatattttctcatctgttctttaagcctatttaggaattcatgggtccttcatccatcccttgtatgttgaatgcttgggaaatactctcagttcgggatactgatggaacattttgaccggtagggtgttaatgttcccagactaccaaagcagccctatggatcatggttcttctcccaagaagggaatgcctaaaatggacataagctcggcccatacaactggggtcctaaaaaatgatttgatctgctaccccataagggtcatctaacaagggcttgagtttttctttttttttagattttgtacttctgagctggttaagggggcatttacgaagctgatgcctcctctcccaaggggcacttcttcaaggggaagagagttgggggcaattctttggaggtggaaaggggaaagggaagttctgagtatcctttttacattgttctatttcatgctgtagggcttaagtgtgtggctagggggaacatggggtattgattcaggattatatgggggagggactgatgagtggggggatcctgtgtaccggcttgatgcatggggtttggcagaggcaagtggtctggtgg

SEQ ID NO: 27438 - DNA, 1077 bp, Homo sapiens
ctgtgttgctgagagtctgggtttatgtgtcaccttgggtgggacccaatctcctgtttgtgaggccaccgcaaagaggtggtgggatgcctctcctcaagagaggtgatcgtgggcttctcctgaaggagaacggtaatcccagatgagctcccaaattgttggcaataagagctcagagttgcaaagaaaatgatctccaaaagatttctcagcaaggcagatttacttctgcagaatggtgctgcttgcactcctggtcacagtgagagcaccccgaacaaaggaggtgaagtggtttttatccctaacacagctagttcctgcttctgtgttctatccccattggctagagtccaatctaaactagtcctgattggctattttaaacaggaggggtgtgggttacagcagtgggaagagcagttgccacgagcgagggagacttttccagataaggaacaaatgcgggttacaggttgggattggtgggagaaatgtttacagaatgggtaattaggagtgggaaggtatgaggaagttgaccttaagaacaaagaacaaggaagttaaactttgaagagaaacccatcatacctaacagtcttgtaagaaaggatgacaaagtgattgaacattgggtggagctaattttccttggccaattcacttagtaagataaggagctccaaatcatatttaagttgggagtcaattgattttacttaattcttgtgaggttcagttataagattcatcatactactaccatgagccatcctcagctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctaacacagggaagcttttttac

SEQ ID NO: 27439 - DNA, 1044 bp, Homo sapiens
ttttcttacaccttttgagtatagtgtttttgccatcatagatgtggctcctcataattctccaacttttatattaaaaaaccaaaacctcaaaaattgtagttcatgtcagtcagtgatgactcatcttagaagtattttgtttttggatgtgtgaatgtgcatagttcttaaagtccaacattcatgtaataagacatcttgcatataacaatgacccttacgtctaagatgttaaatagatcctaagcctggtataactttattcaagtatccttatttgcccctaaaatgtctttaatacacattacttgggttatttcttgaatgaacatacaggtatcccaatttctgtttttaagagaatggggtcttgctctgtcacccaggctggagtgcagtggtgcagtcatggcttactgcatccatgatcctcctgcctcagcctcccaagtagatgggactgaaagcacacactgccatccctggctaatgttttcatattttgtagagttgcagccttgctacgtgacccaggctggagtgtagtagctattcacaggcatgattgcttgaaactcatggcttcaagggaaactcccaccctcaatatcctcagtagctgcaactacagccataccccccactgctcagcttctcatcctttaaaagatttttactggtagtgtcctcattctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgagaggagccctctggaaagaaaaggacagaccctgtgctttca

SEQ ID NO: 27440 - DNA, 1035 bp, Homo sapiens
ggcaccaaaagttgcaggatgaactctgaccacctggcgacctcaactgggagtggggtggaatggtgttgggagtcagccagagctctccatctacaaggttcatttcttcactgatgttgcagaaataattgtagcctgaatagctaggtcttgggagaagtgatggaaaggcagtcttgctttcaatgcttacttgctaactcaggtgactggaaacccaagagcacttccagggagagtgctgaggtccagaaagtactttttaaaaattatgttagaggacatttggttagaatttgtaaatgctgacatagctatcaaagtaattctgtatttcataaagctaaagaaatggaaggaaaacgtttttctccagctggagcaaagtgtaacaaaatattgagatatctaccatttcaagaatttccaactttgtgccaaaaaagaatctagaagaagttgccagagaaagtatggttttcgttctttcagggataaattttcctctcctgccagaagttgctttgtagcttgcagtcatttcgagacattactggtcttttgctttatagttaggtgttcagcattcctaagaaattctcagtatagaaaaggaccatctgcactccaaaagcacatgtcccctccttctaccttactgtatttttaaatgagtgtctgtctggccacttttcattctttataaaaatatagtatcaacctgaagttctaaagagttccttggcccctgttcgaagctttcaggatactttccatactttatggaattctgtagtttgggccttttaaaaactaatttcttttgcacagttaaacaactactatatatagaaaaaagaaaaatcttgtttattgacaattatttttatcttgtttcattctcttccagtccatgtgtagacatgtccgtatgtattagatgcctttgtatagtttaatttgagtttatatcattttttctgttctttccatgtattagttgagttcacatatttatttatttatcttttt

SEQ ID NO: 27441 - DNA, 1022 bp, Homo sapiens
atttttagcggagacggggtttcactatgttggccaggctggtctcgaactcctgacctcgtgatccgcccaccttggcctctgaaagtgctgggattacaggtgtgagccgccatgcctagcgtgtccttcccttttaagcagaaaatgtgacacttgtgaaaaagcttgtaagacagcacttccctttttttccctttaaacctttaaatggcaaatctaggtaattaaagttgtgaatttttatttttgctttgtttttaatgaacacttgtctttcagaataggattgtgtgataatgtctaaatggcaaaaacaaaacgtgattttgcacaattaacaaaactactgcaagaaaaataaaacatttcttggtaacaaaaaaaattaatacatttgaaacatttttcatgtaaccttactgaccaggaatacttatattttacagtcataatggtagccctgcagtgcactctgggagtgagcgagcgagcattggcagttcattgtagtagtgtaggcagcctgcagtagtgcagtctcctgtgtctttagcatgatgagatggtaggatgcacccgagccaacgggccagcatccttactggccctaagctctcagaaaagcttcttaaactctctgagcttccctacagtgttcttttgaggattagaagtaattgaaagtgacaaatcctgaaagaagcagctcaacaaataatcattaattgctcctgatcctctgaatgaattgaggggtgtccttaattaggtgtatgcacaaagatcaactaggagcaaaggaaaatgttagaacttgtgtttctatttatttttaacctcactcttttacaatttctatttttttgtgaatatttttaaatataagctgggcgcagtggctcacgcctgtaatcccagcactttgggaggctgagacaggcggatcacctgaggttgggagttcaagaccagcttggccaacatggtgaaactctgtctctgctaaaaatacaaaaatt

SEQ ID NO: 27442 - DNA, 1031 bp, Homo sapiens
attttttatttttttgagacagagtcttgctctgttgcccaggctggagtgtagttgtgcgatcttggcccactgcaacctctgcctcctgggttcaagcgattctcctgcctcagcctcccgagtagctgggattacaggcgtgcaccaccacacccagatagttttcgtatttttagtagagacggggtttcaccatgttggccaggctggtctgaactcctgccctcaagtgatctgctcacctcggcctcccaaagtgctgggattacaggtgtgagccaccacgcccggcatcagcccacattttctcaagcaccttccttgagcccggccagtctgagttagttacctacccaccctgcttttctacagccctctacccctcccgcggattgtcattagtgttcatcttgtttttctccctcattagcctgaggggaggagctccttaagggcagcagctttgctctcatctctgaaccccagaaaataacagtacctgggacaaagtaggtgaacaataaacgtttggctgactgaatgaatgatggtatgaatgaatgaatgaatgagcgaataagcaagaaatgttttaagttaatttctaagaactttgtgtatataacattttaatttatttctgttttctttcatttcctagcacagctgaaggtttaacaagaaaaaatatgtcagatgtcagtgggtggcaaacatttttacaagcccttgactacttcctcaaaatgttctttggctctgcagcgctcggcactctcactggcttaatttctgcattaatatccttttaatgtgatgaacatgcagggttaaaattattcctgataacttctgtctctagccagtttctcctgttttttaagggggccaattttagatgaagattttgcttaaaggaggatttttttgcttagtttttgtttgagaaacactctaactcaaggattttttaatctaacgtgaaatttaggatgtcacttttcaaagtttaaaaaacatgtacactg

SEQ ID NO: 27443 - DNA, 1067 bp, Homo sapiens
tcagaatgtatgagagagtgccagttgcttcatattgccaccacacttattttaatttaaaaaagtttagctgtcctgataggtgtgtagcaactgcatttagatgtgctttggtgtggttatttttatattcgccttgggttcattgagttttttgggtttatagtttatatgagtttatagctttcatcaaatttggtaagcttttgcccatttctttatcaatatttttttgttccgccttcctcttccccttgagacttcagtttactccagttatgagaggtagcatgctattggcccacaatatgctttgcctttttttctttttttccctatgtgcttaattttggttatttcctgttgccgtatcttcaaagtcactgatcttctgccatgtggaatctcctgctaatcctacccagcgtatttctcatttacatattttataattcatctacagcagatccctttaggttattttcatttcttccatttctctcttcatcatgttcatgttttcttctatattctggagcatatgaaacatagaaatttctgatagctgttttaatgtccttgtttgctaattccgtcatctctgtcaactgtaggtctgttttgttgttgatttttcttgtgcttataggtcacattttcttgctctttgcttgttattaagttttgattggatgtcagtcattgtgaagttttatgttgttgagcacaagattttattgtattcctttacggagttctggacttttcttttaaaaacaattttttttgtgtgtgtgtgttatttctggacttttcttctggcacgtatctaagtctcttgacatcagtttaatccttcttgaggcttacatttaaacttttttagggctggtgcagagtagcagggccctaactaaggtgtctcaggtaccgtgagctcactccactctggctggtgggaacgcaaactattcccacccatgtcagcttctggaattgttcagcctacttctttttaatggttctttccccagcttcttgtttcatccgacatatttactgatcag

SEQ ID NO: 27444 - DNA, 1053 bp, Homo sapiens
ctgcagtcatttgctctgaatttttgccactttgccgcagttggggcccttgctaatgacagtgttcagcagattgacagattcttgtgtttatcatcttccctgggtgggatcgtgtttatttgcagaagtatttgacagttgactcattacattaagagatttctgaataccagggacatgtagcttatgtaatagaaaagaatgagagaatttaagcacaagtttgaccaagatattggctgcaggattttcaagaaaataaggaaagtgttgtattggattctgactgtgaatgtttgcttgcttaatagtttagtaccatattggaatgaaatcattggggttgaataatccattctttggtttgtttcagaaacatgtgtgtttgcatttcttggcctgtccatttttagttttcctcacaagtttgaaatttcctttgtcatctggtgcatagtaagtattttcctttttttttttaaatttaattacttatttgtagatcaataaacacatgttccggattcatttatgtaactgttaactgttcaaagtcaacagctacatagacactcttttgtttaaagtttcttttgttaaaaaaaaaaaatcacaaacatacagtaagggggcaggggtagaattaagtgaataaatatccccagaaaggacttttgcttgttttttaagatttttaatggccttgaatattatggtctttaaataaaagtacaggtttgtaagtttttgtgtgaggaggtaaaagcagatttcaaaattgaatatgtaattgatcataaccatgtaaaaatattatgcacagaaaaaagaaaatatgtaaagaaaatatagccacatgttcacagtggtcatagagttgggatttctttctcttttctgctttttctggataatttattatgtacttcttactgcagttttcttcaaatttgtctatttatatttgtctatttgtctgtttataagatattgttcctgcaacctgggtacttccatctctcagtcagcaagagctcattgctcttggtc

SEQ ID NO: 27445 - DNA, 1845 bp, Homo sapiens
ccaagcaggacaggaaaatttcacaggaggtttcacaggttttaattatcttcaaaaatacttcaggtcaaatagcatatatccactagccaaatacggctgtcaggtttatattctttccctagagctggatggtttcaaaggggcacactgttgtcttgccattatagtagtaggtaactttggccaactatatcaagtaaacctcttacttacatatatagatgtcaagttaggattttagagtggtattcggtcttgatggctgaatttcagtatctaagaaagaaagctctctgctaaattgtcataaagaatattttttctcagtctgacagtgtctgaaactcagacttcagaataactgccctttttgttaatgtgacacagatgaattacattcatctgtgtcacattaacaaaaatgactcattaaaaatgagtcctaaaaatgactcattaaagagggctagttgcgctatagtttctgctgtattgtatggctctaaaaatctgattctgtactgtgcactgattccacctctcagaaacaactcttcagctcagtgcatctgcgtgctctgttccgacagacttacaaatgttctgagcacttggtctgtgccagcctccattcgtgtgctgtctgggtttctcaatctccatttaagggaggcatccttaacttcatttaagaatcaggcagcagactgggtgcagtggctcatgcctgtaatctcagcactttgggaggccaaggcgggtggatcacgaggtcaagagattgagaccatcctggccaacatggtgaaaccctgtctctactaaaaacataaaaattagctgggcatggtggcgcacgcctgttagtcccagctactcgggaggctgaggcaggagaatcacttgaacctgggaggcagaggttgcagtgagccaagactgtgccactgcactccagcctggcaacagagcgagactccatcaaataaaaaaaaagagaaggcagcagagacagattaattttcccaaagttacatacctagcatcacaaacagttgcactggggatccggtccctggcaacctgctccggatccagttgctaggctgtcctgcttctactgaaagccagtctttgcatctagaaacagttgctgaggctgcatgtctctttttgcccttaggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactac

SEQ ID NO: 27446 - DNA, 1029 bp, Homo sapiens
aagcttcagagaacccttcccaaaaggacaaaaccagctcagtgttttagcactccgggatcatatggcatgacagcatggctgctttatacttttttgtgtatgtgaaattaaaaccaaccactcaggaccaatttctctgaagctttttgtcaatctttcatttgcttttctcgtctagattgtaagctccttgcagccagtgtctgttgattcagtcattcaaaaaataatacatgaacagctactaggtaccaggctctgtgctgggcagttgggatatgtggtgaggaagacaaacttggtccctgcccttaggaagttcagtagtccagcagacaaagtggctgaataaagataatctcagttcacagtgataagagctcttacaggcctaggctccaggtgctgtggggatgctcaggaaaaggtatctaattgggattgggagcaggcaaaacaaataaaggatagtgtataaaggtaatatctagttgaagttctgaagggcaaggaggagtgagcctgtatattctctgagtctctccctaatctgggattgacttcttgtccgtctctgttcatattaagtgtcacctaggcttgaaagggtgagatcatatttcacttccttcctctttggtcttaacctttctctgctaccccctcacacaatgcatatgcattattctcttattgtatatatttttcctctcttccttttcatgtttcctctgccattacttttaacctcgactgccatatggcctctaaacgcttccagaagggtagcctagtggaggttattccatcatggccttgagctcatgcgaccagatagtgaaggcatctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaatt

SEQ ID NO: 27447 - DNA, 1082 bp, Homo sapiens
ttttgcatcctaattttaatgcagttcagtgtggtagacctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaaattgtggtggtctttgcctctcatggagccttgcatatgctgtttcctctgcctggaatatcctaccttttacttaactgattctcgttcttctttccagtcacattttgtacatttcttctgggaagctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcttaaaaaaaaaaaaaaagaaaaaagaaagaaaatacccaataagtagttcctgaat

SEQ ID NO: 27448 - DNA, 1061 bp, Homo sapiens
gctaaagtgcaatggcgcgatctcggctcactgcaacctccgcctcccgagttcaagcgattctcctgcctcagcctcctgagtagctgggaattacaggcatgcgccaccatgccagactgatttttgtattagagacagggtttcaccatgttggtcagtctggtttcgaactcctgacctcaagatctgcccacctcagcctcccaaagtgttgggattacaggtgttagccactgcacccggccgaagctgtcatattaaatagcactttctgcttttagcaaatttaatccaaatgagactttagattttcttgctctgacttaccagcagttccttgaaacacatttaattatttttgccagaaaatcactcaagcacttacgccatttttttaccgtgaaaatatgctgcattattttaaaatatattagaagtcagtaaccataagattttatatgttttctaatgtattctgtaagctttctgctgcttttgtttggaaggtgtattttgtaacgtagaggactgctttatctgcttgtaagcttgatttttgtttttactgtaatttttttttcttttgctgtattgagaaatacattgagtaattataaagtcagtggcatgtttataagttaatatttgtatctattccttagttactctaactcaaaacctaaagtaatcttcaactctaatttactctgacatccagttgactgccaagtcctccaacttaatccttatccttttttttttaaagagatgcagtcttgctttgtcacccaggctggagtgcagtggtgcaatcatagcttactgtaacctcaaattcctgggctcaaatgatcctcccacgtcagcctctggagtagctggggctacaggctcttgctaccatgcccagctaactttttatttttattttttatagagacagagtctcactgttgctcaggctggccttgaactcctgccttcaggcggaactcctgccttcaggcggtcctcctgcattggcctcccaaagtgctggaattacaggcccaatttta

SEQ ID NO: 27449 - DNA, 1093 bp, Homo sapiens
attatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttgatttttcaatttagtacttatcagctgacatatattttgtctctctgtctctctctgtctctcatagaaggtaaattctataaaggaaggaatttttatgtttggttctttgctgtagctccaatattcaaaacagtgcctgacacacagtaggccctttatatttgttgaataaatgttgacactctgatatctaatttttgtctggtgactaatacgaaaactatagagtgataataaaagcattaccttagtagactggaaagggatgagcgctaggatgaactttctgcctggcgatcttgctgaatttaggaggcagattggggttcaaaggaggctgaaatggctaggatttgcagagcagggtactaaggatgagcaggctatgacagaaagaactccagaaatctgcaaagggatcaccttgagtctggctggatacagtgtacactttgtagggtgtctcttcatgagcttggataaagaacaactgttggggagtggataattcccagcactcattcaagcttgcatcggccagaacggagagagacagacctctgtaatacgtaggatatttggtagaaacattcaaccgaaaaccatcagatatgcaaaaagtaataataataagtaaacaatgtgatgcatagctagaagaaaaatcagacattagaagcaagcccagaaa

SEQ ID NO: 27450 - DNA, 1029 bp, Homo sapiens
cctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaa

SEQ ID NO: 27451 - DNA, 1023 bp, Homo sapiens
accaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatccgaagggaaatgaagtctaagcaggcgcaccctgcaggttcagtgtcaagcccagggcctggccccagggtgtggtatttgttgactgggtgtgtggaccctgggagaaagtctgagaatgaatgttcctcttagaggtagagagtggaaggtgactctgtgtgtacttggaattagtgatttctgtacagatgattcttttagaatcatcatgagtatttttctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtccca

SEQ ID NO: 27452 - DNA, 1128 bp, Homo sapiens
agtgatccgcccacctcggcctcccaaagtgctgggtttacaggtgggagccgccgtgcctggccccaagtgatttattttattttattttattttattttttttgagacagagtcttactctgttgcccaggctagagtgcagtggtgtgatctcggctcactgcagcctctacctcctgggctcaagcgattctcctgcctcagtctcccaagtagctgggactacaagcgtgtgctaccatgcccggctaatttttgtgttttcagtagagacacggtttcacgacgttagccaggctggtctcaaactcctgacctcaggtgatccaccctcctcagcctctcatagtgctgggattacaggtgtgagccactgcgcctggcccccaagtgatttttgaaaagcaaattgcaaaaccattttaaaatttaaaactatgtgatcttttaacatctgatactctactaaaatttctttaaagtgaaagcttacaattcaatgtgtaaactactttatagtctgaagtttaagatagtgttgttggatatcttgaaaaatttttataacaatttattgttagaagaaaaaccccatactctattcctagagcagttatcatgggagcaaaaacaaagcacaagaaacctggtatcttaaaagttattttcatgcagaggatcccaatcccccattccctgttaagagtattagagtttatcctaattgattcgggagatggggaagagaaggtacagaatagactttctgctctcattgttgaggttattgctgtgcactaaaaatttttaaaaaaatatttaaagcttgcgccttttaaaaatactcaggtcattcctgtcagtttggaattcagccagggaaatgtgtatttttaaaagcttcccagccagtcctgataatcagccaggtggaggatctgttgatgtgctacagaacagacccctctccagatctagtcagaatctctacatccagacttcttgctataacaccgtctgtttttgattgacaccagacacatatgtttacctcttcgatttattctcgttttattaggaacactagaaaggctttgctttaaactttgtctctcatagggcatgc

SEQ ID NO: 27453 - DNA, 1042 bp, Homo sapiens
ttcgccaccagcctgaccaacatggtgaaaccctgtctctaatacaaaaattagccgggcatggtggtgcatgcttgtaatcccagctactcgggaggctgaggaaggagaatcgcttgaacccaggaggtggaggttgcagtgagccgagatcgtgtcattgcactctagagcgaaactccgtctcaaaaaaaaaaaaaaaagttgccagatctatctcatttaaccattttatattagagcaagagttggcaaactaaggcctgttggctgcttttgcatataaaattttcttggaacagggtctcaccattgcccagattggagtgcagtggtgccatcttagcgtacttcagcttcgacctctcaggctcaagtgatcctcccacttcagcctcccaagtagcttggactacaggcacaaacaaaccaccatgcccagctaatttttaaaattatttttgtagagacagggtcctgctatgttacccaggctggtcttaaactactaagctgaagcagtcctctcacctcgcccttccaaagtgctgggattacaggcatgagccatcatgcctggccacataatattttatggattgtctgtggctgcttttacaagagtgattatatagcctgtaatacctagacatttactgtctgactcttgacagaaaacggttgtcaacccctggattagaacattttaaaacattatttcattatttgatttcttcctctgatcttcaagtggggcataatcttgaactttgttgatggctgtactataatggttgctgttttgttactgtatggggatactgatggagcttatgtagaagtttttttttttttctagatttgctttttactcactgtgaagcttttatgtcttacatctgcctgccacccacaaatggatccttaccctttgctctgaatgtgtggtttatgaccctctatgagcaaaggaatgagattactaggcttttcagaattaatgtttaaagagtaagaggttcagagggaagccctgcaggat

SEQ ID NO: 27454 - DNA, 1522 bp, Homo sapiens
ccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccaatgcatccacttagaacaagctaagagtaaggctgctaactttaattccttgcctgattttattgtacagtgtgcacaagcacaatggtatgcttgtatatagaaactaaaaatactatgaagtacataagttccctatggcttatggagagttatttattaattaactttatggtagggctagtatgaatacctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccgaagttcttccatttatatgctatttttaatggcattccggctttaacattctgtgagtcttacaaatttgactcttgaatggcaaaataatgttagtatgtagaaggttaactttcatttataatataagtggtgcaggggttcaacattttaagtaaaaatatttttacacactacctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatattgtaaaaccaatagatcctggttatacgataaaatatcagctcattggtaggctgaa

SEQ ID NO: 27455 - DNA, 1071 bp, Homo sapiens
ctacttaaaatagaaaaattagctgggttgtggtggcagccctctgtaatcccagctactcaagaggctgaggtaggagaattgcttgaacccaggatgtggaggttgcagtgagccgagatcgtgccaccgcactccagcctggatgacagagctagattctgtctcaaaaaaaaaaaagaaaaagaaaaagaaaacctgaatggatccagatgaaagacatgtgttttctatatccatgtgttccgcatctttgattgttttccttttgaagaaacaatagaaaatggtgacctggcaccagtattctcgaatgtcctttgcttaaccacatttctgaactcagtaatgactttctctggcattggtctgaatgaaaagaaagcacccaaatgatacctaaatctgtgactaatggggctggtcagtagtcagagtgttcagagtgggaggatgttgccttgggattctttggcttgtgaatacacctaactccaattgacgtctaacttagattcaaaggaatggattggctcgtgtaactgaaaaatcagggctaagatttcagcacagatcggacacagtgccatctgatagaattttctgctttgtccagaggggagtcactagcccccatgtggctgctgcatacttgaggtgtggctagtgcaactgagaaactggatttcaaattacatgtcattttaattaatttaaatgttaatagccacatgtagacagtggctactgtattattttacagcacaaactggaatccctctccatttcttgcttttgttttcccctgttaccttttttcccttaggccaagtccctccttatggtggcaaagatggcctccagcaaccctggcaacattccgtcacattaccaaccacctggcagggagcctgtcttcccccatggtgacagccaaagcccagagaccaccctcactgaccctgtctcagtcatgtgcccatccctaacccaatccctataactcctaattgtcctagtctgggtcatgggcccaattctggacctattgagggagggatggtcccctaa

SEQ ID NO: 27456 - DNA, 1030 bp, Homo sapiens
ttgtagagacggtgtctcactatgttgcccaggatggccttgaactcctgggcttaagtgatctgcctgcctcagcctcccaaagtgctgggactaaatgtgtgcgccactgtgcctggtctgttttcatttctttcgggtatattgcttggccataagttgactctgtgttccttttgaggagatgctggactggttttcagagcagctgcacaattgtacccttcccaccagcagtgcgtgaggcttccaattcctccacatcctcgccagccctcatcattttccatttttgtgattgcagccatccctgtgagtgcaaagtggtacagtggaggatttggggtggggagagcttttgtcttaacaggactgcacagagtagattgaagggcagtaagaacaggaagctgggaccagcgagcaggctactgcaagagtcctagcaagagacgacggtgacttgcgccatggtgcttggttgtatgggagagagagtgaagtagttggatttgggtagagacattttgaaggtagaaatgagaagatttgctggcacattggatggggtggaaggtgggagagaagagtcaagggtgctccgaagtatttggcctgaacgagaggatgatggagtttccatttgttgaattagagaagatcatgggtggaggacctttttttttttttttttttttttttgtgccagccccttggtgagcagggccagcccctcttcaatgtttgggcattcccagctgggaagcttgcactgccactttgtgagaagcggggatgtgggaaaaaaaagtgaaaaccatgattcgcaggtgtttgtttaaaaaaaaaaaacccactcaccatctccactggtccttccttgaatgtcacttaaagtgagcctctcgcctccttcccctctgagtggagcagtttatgcccagggggttgcgaagaacagcgagggcattcatctgctcacaggctggttaaaaaggcacgtgggctgcagcctgcgggactctcattt

SEQ ID NO: 27457 - DNA, 1034 bp, Homo sapiens
tttcttcttcttctccttttttttttttttttttttttttagatacgggttcttgctctgttgcccagactggagtggagtgacataatcatggctcactgcagcctccacctcctagactcaaacgatcctcctgcctcagcctcccacatagctgggcccacaggcacatgccaccatgcttggctaatttattttattttttatttttactagacacaggagtcttgctgtgttgcccggctggattcttgaattcctgagcttaagctatcctcccgccttggcctctctctctctttttgcctcattctttcctccttatccctctagttttccttctctcttccccacttcccctcattttcccctcctttccatctgtttccgctctctggattctgccctcttgtttttggcacttgctctcttttacgtttttctcaagccgccttttgtttccctttgtgtctcctcctgtctcatgatgttcatctctgtttccactgtgctgtctccgtctctccctcttttcctttctctccctcttaaaaattattccccagaccttgaaaaccatccatcccttttcactctcaggggcctggatggaagaaaatgtcttcatcaggcaaggacagtgcaggagaggggtcgcaggtgcatgtgcaggcccggcagtgctgccggggagaaggacgggcctgggctgagatgcacgggcacagccagacctccaaggacacctcatgtctgaggaaagggggagtttgagaagaggctgccagggctccctggaggcctggaatgggggagaaggggcacaggggacagtccaggccttgtctctgaagcaggtccttcagctgcacttgggctgtgcttctctgtagggagggggcatagctctagggaaggaatttctccaggcctggcaggggcctggaggaggcatctgagcacctgctggttccaggctgcctctcgttttgcactcagggctttttttgtttgtttgtttgtttttgaggcag

SEQ ID NO: 27458 - DNA, 1108 bp, Homo sapiens
gtgctctgccactgtggtgggtgggtggatgctgcttctgttgcctccagacctcggtgcccacagccttgaggatccttccaataaaggtgtcaagagctcagccctggtctggtgtgagaatgacggggagtgatagtttccttttcacctgtgcagtgttttctagaaggttcctcctgtgcctcacctgcgagggcctgatcctgggcacctgctgatgaggctccagctgagggaggggtagtcccggcctttggatttccagcaagagtgcagaggtcattaggacccccagggtcttcaaaggcttgtttacccacatttcttcccatgcagatgagtttcctgctattgtcctaacactccggatttctcactgtggcttcaacctgcaatgggtatttctggaattcctcgaagagccaagaacacacacataattcccctatgcacatacaggactgaactgtaaatctgcattagaatttcaagataatctgcctgggcaaggtgactcatgcctgtaatcccagcatcttgggaggctgaggcaggagggtcgcttatgcacagggtcaagactgcagtgagccgtgattgttctactgcaccctagcatgtgcaacagagcaagaccctgtcccccacaccccaaaaaagtttttcaaggaagcctaaaataatgaatctggcaagatagagtagaggccaggtgcagcggctcatgtctgtgatcccagcactttgggaggccgaggcaggcagatcgcccaggagtttgagaccagcctgggcaacataatgagaccatatctctaccaaaaatacaaaaattagcctggcgtgctggtgcacatctgtggtcccagctacttgggaggctgaggtgggaggattgcttgagcctgggaggttgaggctgcagtgagccatgattgtgccactgcactctagcctgggtaaccaagtgagatcttggctaaaaatgtttttaaaaattaaaaacagaaaagcagggaaatagtttagacaatttttggaattcagagatataggtagaccccttgtttctggaaaagtcagcatttttattctcttttctttt

SEQ ID NO: 27459 - DNA, 1073 bp, Homo sapiens
catagtttcaactttaacttgcacatgaatggggagcgtctccagcagtgtggccgtatccatattgctcattttgtccgagaaattattttgtccaagggtatcagactgaggtccgttcaaagacattatatacatacacagagacacagaagagaaatctgagatgcgagtgggaattgctgatatatttgtttccaaagcaaactccatgaatgaaatgattcaataatttggaggcatttgaaagtcattaaaatggccatttggaattttcagttgttgcctccctcaattttttacgtttcccctgtagaaaaagacatcctctgggcaccctcaaatattctgggatgctaaagtcatgctaaaattatttacaattttagaaattaaaattcaggaggcacagcaagataatccgattattaatatatcagtattatttagctatgcataacaacaggaaaacgcacaatgcaaaagttttagagataatgagcttagagaaattacatggggggaagaaatacctggatcatatttgaaagcatttgtcttgaattctgctcatctaaatgagagctctctttctacctgtgtcatttaaaaaacaatttcaatatcctcctacctgctaccccagcctgaagcagggactaatgaaactctctctggacacacagatgtaagacactatattacacaacactttttaaaaaattgtttcagaaaaccaaatgtgggcatgcaaaccaaaagaaaaacctcaaggatcttcgtaagatagctagctcagggttcaagatcaagagaactttgttgcggcaggataagaagacaacagcattgcgttttagctaaacatctcttcttggcaaatgagaagcggtgaagcagggaagatttttttaaggagctttttagctcttttgcatctctctccaaagactaatttaattgaaaagctgtagtgtccatttatgattaaggaaaggcctcatgtttccacaacactgctagacactaaggtgggtttgaagaaaaaaaaaaaaaggccagcattctgcagt

SEQ ID NO: 27460 - DNA, 1032 bp, Homo sapiens
aagcactggctacattcaggttgtttatatacaatctctccccgagacatcctgtaagctggttatgattattggccaattgaatagatacggaaacctaagttttggaaatttcaaggagcttgactaagatgatgacaagcttttagataggatactgaagcccaggcccacctatcagagtccaagctctcagacactatgctttgttgcttctcatagtatttcatgcttaacagcacagactcacataaataaacttccacaatatagtatagatacatggaggctaaggccatgaactgaaatttagtgtttccccaggttgaagtaagtcaattgtgttgtagaaaaaaaaaaaaaagatcatccctacttatttaaatccccaaacaccatctttaaaacttgagcctatgaagaaaaagaataaagacttttgaaatctcttatgctatccatgatggcatttttgtaaatccattcctgtttcactaaacaaaagtagaaaaaaatcatgaaaacccccaacacagtccatctggggcgtctcagtaagaatcgtgctcacccactccacagcatctttgaggatgtggccttaagtcagacgctgctcatctgttcctgataaatctcttgtaggctccaggactcttcctggccatcaaaaaatatggaacgcatgcaacgacactgccctcttatttattttagcaaatgaaaatctgccctcacaggtttatggtcaagatgtctaaaagatgtcttgtatttgtatttaagagtcaccttaacagtaggtgactcttaaatgagtactccaaataataggataagaaaggtgatcatgaaactcaagggatcctatctgagagggagaatgttgtctacaccagaaatcatgatagactctgtctggcaaaaaaaaaaaaaaaaatcaattgtttttagttattattggtgatgtttttttttaacatttttgtttatttatttcctttttagtgggtcacattttaaaacaaccca

SEQ ID NO: 27461 - DNA, 1061 bp, Homo sapiens
tctggatcttcgtccaatttaaaaatatgttaagattatttttagatcctagtcattagtgctatgagactgttttcaaacagatttattcttttctctcatttgctcaatatttgattccctatttaaagtgcttttctcctttcaagctttctacaaatctaaacattgggagaaaaaaaatgagggaaaggaccaattctctatatttgtgtaattgtaagcaaaatgtgctgtactcttttctggccacttggcacataggttacaggtcatgaactatatatgaaggcctgcagttcaaatgagatccacagatctggtatgttcctcccagactgtgtttcaaatagacaagtgttagttgcctgggtttttttttttttcttttaaaggagacttcatttaaatttcagggtattttatatccaaatatagaattagagccttctttaagacttgatttgaaagcactgaagtcactatcctatatggcaataattgggtggagctttcactgttggggcttaccactcccactgtgactgctgggacaaggctcaaacttctgaaactctgtggccaaggagaggagactagctacagtttcttactgaggaaagggagtggtatcagggggttgggggagacccctgttgttgaatgtccagaggtggtgcctgtgatattgacccccataggtgagctcgtgtgatgtaatggtcaggtcttggcctttacgtgaatctacgtgaattccaaagtggtgaatatatattccaccactttggaattacatcctcgtgggcaagttgcctacttcctccaagcctccgttcttgtttgtaaaatgaggacattgttacaatctactcgtagaattgttttaagaattaaatgaatccatgagttgagtccacaaagcattgagcacagggcttgtccagtggagaaagtctcatgaaggttggttatcactctcttcctgtattagtctgttttcacactgctataaagatactacctgagactgggtaatttataaacaaaagaggtttaat

SEQ ID NO: 27462 - DNA, 1037 bp, Homo sapiens
aaattctggcttttaatttttttaaacattttatagtaagagcaaacatttaatatggttcataatttttgaagatcttggtttattacttcatcatatattgattcaaagatctggttgtcaattattattattatgtttagtgacttcatttaaatggctgtactagctgagatataacacaaaaatgcatgagttcaagtggatccaactaagcccagatgatgaagtccatgtatccagttgcataggcacattgaagctgcccttcctggaaataggctgagatttaaggaaggagccaaggatcacatcagccctccaccttgatgaacttccccgccccacccctgggtgcctgcccccggcagatgacaccttcacatctagaacaagtcaggacaccagtgtcaacctgtattttcttactttcagataaaaattactatttcttacctaaaaagaaaacacaaatagatataaattcaatttcttatatgatcttcctgtcacaaaatgaatcctctcttgaactctctgcagtgcacacaggcccccaaagggagacttactaaaatgtaatatgagcttccaattctctcctatttataggatgaccctcacctttaggagctcttcgactgccagtgatactctttcagccacccccacccataaaaacatgtagttctctttcacccagacagtagtccctgagaaaagcgacagaagtagagcccgttaggattgcaggaggctgtggtatggcagtgtctggctggtaggtgtcccatgtacccaacaagtgctctttgtcatttgtttttcctctctaagcaggaaattattcccaaccctaagttagtgaaaccaaagcttcctcttcccaacacacacacatacacacgtgagtctgactgcttgaattcagaggcaggttccatgaatggaaccataactggagctggtttgagaccaagtttataagaaacaggatccttctcattgtgcctgccctcctgtgacctgtctgcaag

SEQ ID NO: 27463 - DNA, 1017 bp, Homo sapiens
tggttcaagggaaagaggcaatgcagcagagactgatttctgggatgaggttttttgtttttttgttttttagttttttaattcaatatttacatgggtccacttagtgtcataaaaggttttaaaggaacttgctataaaaactcaagaggaaattaaatgcaaaccagtacacaccagatgcaagataggaatcaagaaatatagtgaatatttcctgtggtatattaattaaaatattatttccccgtaggaatataataggatgccatgatctattgatttatttattcaactagaatttgccatatatgtcgctccaagctggatatgaggaaagggaggtagataacagtccctactctcagggagctttcagtttaatggggaagacaagtatcaaagaatctctataaaagaaagcagagttcattggtttcatagcagagagtagctatttgtgtagcagcggagtgtaggtgacagacacattaggatcacttttatactacaaagattagaagtgcacatcaaaccattagcatcagatagatattcctgactgaagacctattcataagtgtatattttttatacatatttgttagaatatcagtgattaagaaaatatacacatattattcacttaaatataaaatatgtttattgatctttaggaaagacatttcacaaataatccttcaatgccatattaccaagtaaaattttcctctaactcaatgactaattccgcttctcgaccacagaaaaaggttgaatatgctattgtgtgcagagcaacaaatgaagtaaaaatttatgatgtacccacttaatttgacccacatgtactcaggatttcacgtgaggcttgggagttatttattccttgctgaaatgattctattctcttaccttgctttttcttttctcaatatgataaacattaattaagtatctgctttgtgcaagacactgtgatccgaataagcaagtcatgttctgtgatgttaaatg

SEQ ID NO: 27464 - DNA, 1048 bp, Homo sapiens
ctacagggaatatcaggccaagttttttattgtttctggttgtgcaaactggaccaactatatacactgaaacaggtgatgcctaagtaccagacccttgaactggatgaggaaaagccaagatgggaaaccactggaaaacatcgcagtctattgattctgtgtatcatttcgcccaataccgttgtcgttatcaagggctaactcttatttgtcaagtaaagaaagactacaggttcaactgacttctaagttagcaaacattttggttcctccctatctagttaaataaatgagtttctttttctaaagcctcaactcacctaaggacagggttctttgtttttctctgcttaattgcgtcatattcctccataccaactacacaaaccccagcacacactcagctgcagattaccatcctgtgttcttgtcacctcatgcattttacctgctggaaataaatgctcacactctgcccaatcccatctttccctgcacctggacatgcttcagaactccttttgtctgttcctctctctcatgtgcctgaactcttctgtgacttagaatctctagcacatgattcagaaccttaggatctgtccagtggcttcttgtctgttagtaatttttgttctctcaatgatatggtgtggctgtgtccccacccaaatctcatcctgaattgtagctcccataattcccgcgtgtcgtgggagggacctggtgggaggtcattgaatcattggggcaggtttttcctgtactgttctcatgatagtgaataaatctcatgagatctgatggtttcataaagggcagttcccctgcaccgctctcctgtaagatgtgcctttgctcctccttcaccttccaccatgattgtggggcctccccagccatgtggaactgtgagtctgttaaacctctttttctttgtaaattacccagtcttggatatttcttcatagcagtatgaaaatggactaatacacctagtaccttgtaagcatgcaccatttttactcatatttatatcttcctc

SEQ ID NO: 27465 - DNA, 1024 bp, Homo sapiens
gaaaagactaggaaaaaataaatacccccgtccctccccaaatgaaagatgatttacaaaaatgaaaatctgtatcgataacagagtcttacagatgacaaaatataccagtgatggtttgtgactaggacatgagctgccatttctcctgaattcatatccagttttagggataatgtaatgaaaatgttttagtgtgattagtaagaggttattaattggttaaagaccctcctacagctttgagatttattttgaggacaatgaagaattctatctcacttattttgtttcacgttcctattgactttgaaatgttgtccttttttctgtttatgtatgcttaagaagaagaactaaagcgactgtctttcttcttactcaggaagatttgccagaatttaacactaacacttcatccctttggaatacccagtcgttcaaaattttttgttttgcctattagtgatttaaaaataccctagcttcatgacatttgcagatgtagcattatggttttgtctatcaaggaggcagccaaaggccgagggtttgtattgtgcagggtggcatttatatgtaaaagtgtgtaattttactagtgagctgcccagagctatgtcgaaatgtagatttgcggcttctctcttgggctacattgtctctgcctgccagtgtagttgtaaagcagtacacacaaaacaggtcactttttacaaatgacttttgattctacatttatacggccattaagaaactaaagaagtcaaaatttttcagatctacctcactgaattttatgaaggaaaagatatgctttggtagattcataaatttaggggattttgagggctgtagaatgtatctccaacaaatggcaaaggtctatggcaaataactctgatttctcaggagctgtttccctgctactcacataaaaaacacttcactactaatacctaaaacaaccccatagttgcttattctatccaaactattatccaaagttatttccttaaaaagt

SEQ ID NO: 27466 - DNA, 1065 bp, Homo sapiens
ttctgtttctgtttttactggaaggaattataaaaatttccagtttgcattgataacttgaagagggaatgtctattttttttataagttttcttccctttctatgtgaatttttttaactgtaagcatttattgcattttttttacttctgtcttttaacatcatttgatttatcttgggtaaaatcataagccttctttattattgtttaagtttctctgatttaaaaaaactaaaatattattaaaaattaaataagataacatagctaaggtatttttcataatgtttgccacagaatagccactaatcaaatttgtcataagtaataagatcacttccataactacaaaaattttataacccaggaaaagtaaagaacgacaaaatacacagcaattactcaaaagatttttcattccacttattctggttaatttcaggtcctggaatcaagaacaagtgtttatatatcggttaaattgttttataatgaattttgaagaacccttggaattatttttgtgttggaattatattgtattaaagagtgtttgaagcaatttggatattcaagtggacttagttttgtcggggttttttccactaagatttttcactgtttgggcattatttaagattcagcccaacaatatgtcactagctaaaactgaatgatgctgtaatccatacagaggacaaatgacaaatttgttgactaaacttctatcagtttggttagtgaggagcattctgattataggtgggaatttttgagcaagattgactcttaatttcatgttcaatttttaaaaatttattcatcctttcctctgtttttcttcctttccaaccaaacttcctccctccctccctccctctctccctctctccttctctccttctctccctccctccctccctccctctctccctctctccctctctccttccctccctcccttccttccttccttctttggttaagcacctattctgtattttaaaaccagtagtcaagctcagttcatacttttttatgcaagtgcctttcaccaagacaa

SEQ ID NO: 27467 - DNA, 1051 bp, Homo sapiens
gaatatcatgagtgcagactgtgacttcagagcatcccttttgggaagtctccattagcaggtgtaccaaaaagggttccatatggctccaatatccagtaggattggatgcatatttgagcacaacccaaagagatgaaataatccatccttggtttatttctagatgattaatctctcctcaatatccaagacctgttttatgattaatttgagttttcccacaaccaagaatctgtatcacatcctcaagagtaacagagccccacatccaatgtgatttatttaagaaacaaaagcaaacaggctgctgagtctctaccttcagtgtccctggttcgccaacaatttcataccattaatttctttttcttccttccctgcagtttctgaagaatacacaactctcccttctgcccctccaccctctaccctccaagaactcaggacagttcttgggattttttcattatctcttttcagctggaggtattccaaatggacctcttgaattcccaccctctcatctcctgacttctcctctcctgacttctcctctctccatacaaacattctcaaatctctcttttcaacaaatagacaaataactgaaatacaaaaatacacttccgtacttcagttttctcattttaaaatgagcttaaatatagtatctactttatagggttttgcaaggattaaatgagttagagctaaagctcttagaagattattggcccacaggaagtgctcatctactctcaggtaataatttcatgggagggtgtgtctgtctcaatcacctatcatctgtctgtcggtctctccgcctgtctctagacctatgcttctttctcaatccaccctatctctctcttatctttcattaccaacctctttggaagagtccttctcattttctccctggagctcctcctctcccactcactcccatctctttcaatttgctttggccaaccctagctggacctgaagacgtagttgcatggcccatcctgtgatttctcttttgagctcatccctccagaaa

SEQ ID NO: 27468 - DNA, 1047 bp, Homo sapiens
aattatttaacacctgctaatgattaattaaaatggtatacattttgccaaagaatctctctaacttttggtaatctgaacttctctctttccctttgataaacgtgctcagagtaaaaaacaaccaactaccaggagggttttctgccaaatttgttcccagaatgtttaaagatgagtgtctctcatcttttcctctgtaattcattctctctctgtgtgtctctcctctctttgaacagggatacagcctatgtgtgttcaatgttctaataaccccaaatttagacacaaaccattatttactgatatttaatgaagtcacctcatggcgttttaatgattgctagatggaacaaatctaatgattgttaagatggaactttacaaaccctttcagtcaggacaagtggcctgttctccccacttctccttgaacttggtgtactgagcaaaagacatgcaagcaatgaggttgagactcatttttcaacattacccaaagaacagtgtgtactggatccctggcagctgagaaaggacccttcccctggctgggagacaaaacttcaatgaaattagggcattctcccaacccaaccattcccaccctgtgctgatgtgaaaaagttcaaaggatattacgggcaaagctctcaagatgtgtttccctcgagaatatttcaggtcacccaatgtgtaagggcccctttgaagtcaagattgattgaaaaagcacaagggtgtggagtctaagaatttggatgtggccatcctctgcgtccctgagtgaagatgctgctcgggtcagtattcatattagcctggcccattccctttgcctgcggtatttacagtaacccacatgcagagcaggtggaagccaaagcggggcatagccagggattgtggcaggggcttgaaaaagtgttttcttttaattgtagggggatgattctgtttggcaggattcaaggctcagctgtgtgtgagcagatccttcatacacaaccacacacacacatatactcagcttcctctcacatt

SEQ ID NO: 27469 - DNA, 1127 bp, Homo sapiens
tctcctgaaacaaaaagcagagggatccctccacatggccctccaagaggccctcactccaggcctggctacccttgagaatagctcagcttccttgaacactgaatcctatatctctttactcagcctgccaacatgcatgccaattagtgccaataataacatacatactaacagacttttagaccacagtcacccaaacactagagactcatgacagggagctctcattccgagtcatcattttttgtacctactgggtacacgctgagaaattctcacgatctcctcatttacgtctgccttgaaccctgtggcatcttcctgtgactttaaacagtcatttagtgcggtagattggcgaaaacgatcctgtcaccatcggatatgtttttaaatgaggtcttggttgaattctggtttagtttttaaaaatcagccttcttgagttttaaattgttcttatgttatgattccacttctgctgccatttttaaaactgtcagtgtttttactgtaaacactattgtggactttcaaggtgactacagaaacgtatacctagcaaaagtctgatatgtaactccataccacccatgaattattttgcacaatttcatttaaatcattctgactagaggtttggaaaaaattgaggtggtatagttttaaaaataattgttttcctccttctgttgttgtttttttgggacagggtcttgctgtgtcacccagactgcagggcagtggcgtgatcacagctcactgcagcctcaaccttctgggctcaagtgatcctcccaccacagccacccaagtagctgggaccataggcatgcaccattatgcctggctattttttttttattttttttgtagaaacggtctagctatgtggcacaggctggtctccaactcctgggctcaagtaatcctcatgcctcagtttcccacaagtactgagattacaggtgtgagccaccatgcccagccattaacttttcatatgaaagaaaatttctctaagaagaaaataaaatataagggtttatttctaatttttacccacatactattagggtaaaacaaatgcagcatataaaatattcttctccaataatatttct

SEQ ID NO: 27470 - DNA, 1031 bp, Homo sapiens
tttaggtcataagtaatctaaaacaatttcaatatgtatttgtatatagctttaaaagccacatgctcttgactaatagaaattaaacagagagcaaatcaatgagtctgaaatgcataaaggcttgaaattatagtcatcactgtgtaatatagtgtacaagcttaacagcacacctagccttgaaattgttggcaggaaagtattctagtccaatgagctgccacttctgttgtgggcggcttgataaaaacacatattcagggtgaaaagcgcgtaaggttgccagacaaaatacagaacggatgtccagttaaatgtgtatttcagataaatgacaaataggttttgagtataagcctggcccaaatattgcatgggccatacttatatttttaaaatattcattgtttatcagaattcaaatttaactgggcatcctgtatttttattagctaaatctggcaaccctaacagcatagattatatggcagttgggaagaacaaaatagcctggacaaattaatatctattaatggcatcaaccattccttcctccattaaataaatattccttcctttcatcctcttttccctcctttgttccttcattccttcctctttcccttctttccttccttccttttttcttctttccttccttcttttcttccctccctgcattcctttcatccttcaacaaatactggttgtgcttttactatgcaccggactctattatatttaacaatggaagtataatactgaaccagaagttctaccaattgtaatagcaaaacatgccaagccttgcagcaagcactttgcaaacattattttgctttattctcacaaacagccgtatgaagtagaggttgattcactcatgatagggaagagaaaatggaggcagagagattctgcctgaattccccaaggtcctacaatctctgagcctcactcattcattatgacatatctagaaagccatcgttccacagcaagcactgtgctaattcccagggagtaag

SEQ ID NO: 27471 - DNA, 1022 bp, Homo sapiens
gatttgcctgcctcagcctcccaaagtgctgggattacaggcatgagccaccacgcccggcctcgatgatgattatataaccacacaggtaaacgttgatggcactggtaagagtaccacctatgaggctgcaagggccacaaagtctctagcagaggctttgacctggcactgagatcaggataggcctcgagggaagatgggaagggcctcagagctagtgagctgaaacaagaagtgtgtcccaggcagagggcagagcctgtgtcgaggctccgaggccagtaagaagagggacaagtacaggtgcctgaaagaaagccagtgagctggaagggagagggagagcatggatggtgtgaaatgaggctccagtgatgcagtttcttttaatatttcagcctctgctcagatccttaaaggcgctattcacatctttcaataatctcacaggatgggtgatagtcatccattttacataagaggaaactgaggtttagaaataatgaaaagccccagcctcacagtccatggcagagagaggatgggagtccagcttagaccctacacatgtgttccttctaccacatgactcttgtagtcatgtcatctcctgtctgtacctacaaagggctgtttaaagatgcccagtgtatgttagatgcttgcaatagtcaaggtcagatactcacaaacacttagtaaataaaactaagtaaggaataaatgagtgctgacatactcatcaacactgatatttattgaatgcctcatatgtgctaagctcaggctaagcacttttcacatagtatccttcttaattcttgcaacaactttttgaaataggcatttttattactattccccctgtgctgctgagaaaactggagctttaagagctctagtgattgtccaaggtcacgcagctggtgagggttgaaggtgggactcaaactcccagccagagcctgaatcttaaccctccctggactgcttctggtgaagcaaagcaaagtccatgg

SEQ ID NO: 27472 - DNA, 1005 bp, Homo sapiens
tgatgctggagcagaccagggaacaaggacttggtcacaaggccatggatggttgaaccaatacgagcaccaaattatctcacgcatcacacatgcagaaacgttgcctatctttctttcctcgctagcgctctttctctttctttgcctctttttctctatctctatcactgtcttcatccccttccctagagatgggcacgttgaatactctgctctaagtcttctaggtccatttccacccagagccagtgatgccgtaaatacagccacaggtttttcccccaagaattcccataagctctttctggtcttactgttctggtctgtttggcccctgctggagctcaagcattgatttttttctgctttgcttgctttctgacagcacggcttatattggaaaggtctgtgtcaggaattagagaacattcctaacaatggggaaaagtaccctaatataaatataccatttgtggacttgcactttgacaagtgcaaatgaactggaagacactggaaaagctctgaagtcatggaaacatgtaacagaggcatttacttaataactcatctcattccttgagctcaccttatcaagctttaacctctgagtctctaagttcctagttcaaaaatgcagagtctcctctgtcctcatgttaatttttaaattatatatcattgtagagaggcccttatgttgaatattatgagccattttcatatctgaaatggggaattataactgaacattagcaattgcctataaatctcagcaagcaaagtggcatctataatacatggcattaactggggagaaatgtggtgcacaaaaagggggatttagaggggtggaggtgattttcaagaggaaaggctgcaggtcgatgagcacaagccccctgtgtgctgtataattcctaaaatcttagtggacctgggtggaagtttgttgacacttttggaagcaatggttaaaactgttcagcatgttgcctgggc

SEQ ID NO: 27473 - DNA, 1027 bp, Homo sapiens
accttggctaatgactgattgactccacatcaatcagtcattggctcaaggatagccaggggtacacacttgaaggcagcaagggcactctgtgtgtactggcagagcagcttcagcgaccaggggacatccccagaagagagctgcaggtgcacctattagaaagtaaaacactcagaagccagacgtgggcacaaggatatagtatccaaaatccaaaggcatccctactgtgtcctctacagatgcatttccctgtggccaggttcttatctagctctcacttgcatagaaaaatgtctcagtttccccaaagttacctttgtgaataaaggtagactctccacctacctctcagagctgatgttaaaatatatcaagttcttttgtccaaaaaaaggatcaaaagaagaggtgactttcacctgattgtcactgataaaataattaatttacatagcaattcaaaatagtgcaaatatacaggaatcacgtttttgaaagtgatcagagaagcctggcctctggcttagcctttcatatgcagatcagtgagggagagggaactggcattgactgagtacctgctgtgtgcattgtgtcaagagcttttctatcttttttctgatttaacccttaccacacgctttaagtagcgatattacccccattttatggatggggaaaccgaggttcaggtataagcccctcaagggcagaacaggggctgtaaaatttaaaatccttaactcatattcaccgaatggacctcagaaaggtctgtaacatactgagggtgaccatgactgacaggtgacagagttaggatttaaggccggttctgacactgaagtctgtgcatttttctagtggcacctttcagactggtgattcgaaggaataaatacaaaatggctagccagtggcgtcatgcagtgctctttgtataaggaggtggcattcctgtgccaagcatgtgatttgtgtcaattgcttgctgtcgtgaggaggccttgccgagactcct

SEQ ID NO: 27474 - DNA, 1040 bp, Homo sapiens
agtgaaggtagaggtatatggagtgcagttgttgtagcatttacttctcgagctcagtggaaaatgttttctgccattaataatgccaaaaggttatgtgtttggccttcctggattcttgtttacatgtgttttaaaattaacattgacttcttgccatttgtgtttgttcctaagcggagtgagcggcttattaatgattagaattattgttgctattatgaatgcactaattaaaagaaaattctgtcatgaggctttgtgaggcaacacaagactttacagttagagacgtcaggtctggaagtgtggagacaaaagtgtgaaataagaaaacagagttcaggatgaggaaaagagttctcaagatgtctacagtccttcattagagattctttttcagggcattttccctagtaagggtatgatgaaaatccagttgttttttgattggaggtgtcacctttattgtttttctttttttttggtcttagggcagaaatagccggcttctctccaacttgaattctaagaacattttatcttctacagctttattcaaatatgtaaaaacaggcacagtagctcacacctgtaatcccagcactttgggtgactaaagtaggaacatcaacggcttgagcccaggagtttgagaccagcctgaacaacacagtgaggtcctttctctacaaaaataatttatttttacttagtcaggtagggtagtgtgcacctgtagtcccagctacttgggaggatcacttaatcccaggagttcaaggctgcagtgagctatgattgtaccaatatacttcagcatgggtaacagagcaagaccctgtctcaaaaatacacacacacacacacacacacacacacacacacacacacgtaacacttctgaattgatgaccagatgccagaccaaggatgccagaccaggacacagttcctccccgaggttcatcatctaggggacaaggaagtgaagcgaatgcacaatcgtagtgcctggacacattgctgtgatgggaaag

SEQ ID NO: 27475 - DNA, 1127 bp, Homo sapiens
tgggctacttcaagaagtgtttcttctgaaatcaggttctgggctgaagatgtgagaattttaggatattagctcttgtttctgccctcccaccccacttctataccaaagcatgcaaagcctttcactgaatgcaatgaaaaaagaatttatcaaaaaggaagagaagcaaagagaaaggagaaagaaaagaaagagaagaggaaaagaaaggaaggaaaggaagataaaaggaagaaagagaagaaaccactgtacattagacaagtgttaatgggagagttcaggagaaggagttttacaaataagaagaagacattttattctccagggcaacaagcatgatgtgtatttccagtatatgtcatgtacatctcccaaattagcatgctaccaatggagtgatatcaccatattaatattgctgcttcttcaactgtgtcagcctggcttttgcaacacacgtctgtcagccatgagatgttggatctcagtgcatctaaccttcctgtcattcaaagtcatttgaaagtggaaagagtaggaacccttctgacttggaagggcatttgcagaccttcctttagtgtgctctgtgtaacatgaatcccaaaaccgaggaaacaaaagcaaggagggctcatgatcaaatgagtatggataatgcttttaactccatctcgttattggacattcccagtggaagtgagcaaatgaatagctctgaaagccactgaaataaagaaaattgttgagcatctaacatagtacctcccaactctctctgaccatggaatgttttttctccacctggaattcttttaaacaagtattctaaagaacatgctttgaaataaaagcaagagcccaggagacaggagacctgactaaagactaaattgcctttgcaggtcagctagtccaacgtttcattttagagataagaaaatgaagaaacagaagttgtatggtcagtggagggtcacagaggcagaattagaaccaaatgacccagaacaaatgcatttacctctgtgggcctcagtttccctgtccctattggactagatcagaggatatcaactagtaggccttgaaacagtcttagatgtgtcacctaattctga

SEQ ID NO: 27476 - DNA, 1033 bp, Homo sapiens
ctactttccttcttctgcatccccatcatcttgacactaaaaaaagaaaaagaaagacagaaaatgtgtgcatgaaatgtgaccagggaatcaaagatgacagagctttgataaggtccagaaagtctcagcccctccaaagcaagcgattaaagagaaaggtgacgttcggtttattcaaatatgtttatctgacatctgtctgggtttcatctgaagtgtgtaggctccttctggatccttccccacaagagcctggcttcagtatcatacactttgcgtgggatgaagttctcaagcctcaacagctaaggaaatctgccagggtgtctggcaaactgtgtaagagggagaaacaccccagctctgaattcagcctgctgtgaattatattataaccaactggttataatatatggacagagttaccaggtgtctatgcgggatttggatgtactaatgtttgcttgtgttgagtgaggctgggctaatgagcctcggttacaggtgtttgggagaagtatgaatacagttggtagggcatagtgataaagctttgctctgttttgtttttaacaaaggctacttaagaagctggaattataaagcattgtggtctgagaaatttatagggcagcttgaacggaaggtagtaactaaccagggagaagccacggaaagctctgaatcctctcctggacaccagagggtgtgccagaaaagcaggcaaaaaccgaggtgcttggttcttcttccgggacctggtgggggccaggagatttaatgtgagggagcacagccgggccagggggaaccaaaatcctgataccaggtggcaccgccaaccatgcacgacctctgaggggagaggggagagggccaacaggaaagccaggcaggagccagaagaatgaggagcacaaaagagccaggcgtagagaatggacagtaggtgtcagaccctggtgtgtgtgggagaagtgaccaccatggctcaacggaagtcagtccctcagccagatgatgaatattc

SEQ ID NO: 27477 - DNA, 1051 bp, Homo sapiens
tctttccggaacaaacacggtaactgctgtgtgggcacacaaggcagtggccagaattctcaggtcacttcctgactctctggagctccaactgtcggcagataaaaagaaatctaggcactgagaaatcccaggcactaacattccggacgaccaattggcaactccaacctctccagcagggtttgtaaagaaaacgtaatgagcccaggtgaggctcattagagccagcctggaattctgccagtgctaccatgagctttatgccaacccttgattttcatatcagtggcagtactgacaaggaagctggaaggcaggctgggaggaagctttgtacccatggagtcctctccctcctccccatccagtagctctcgccacgaggtgaggcagttggcttcatcaaatcagaaccagctcatgagtaattttcactgtcttccctttctaacaggctgggccccaggtgatcctaaaaattaaatgaagctcagaaaatgagacacttaggagagccaggcatgaatagcctatccccggctctagcggaactctttacttcccttgtcaatttccttggacttcctttgggcctttgactagtggcaaagtttcactccagaatctcacagctctggagtatttctgccagagggtcccagtcccctgtgtgttttcttgttctcaagcaaaatttaaaatgggcaatggtagccaatgctgtcttttctccttgtaaattgagatatttatgctgatgcaatattttcagaataggactctaggctgcctccaagcttccaggtacttcccagattccagcaaaaaattcttactaccatcaccctcctcctcctcatcatcatcatcatcatcatccccattatcatcactgtcattactgggaatttattgcatgttaagcaccaggcttgcattttgcttgtattttctcaattaatacaagcattgaggaaggtcatattgttattcccacattaccaaggataaaacaggcttaggtaaaatagcttcccaaggccaccct

SEQ ID NO: 27478 - DNA, 1055 bp, Homo sapiens
ttcttccagaaacagggaaatttatgtggggagcacacagttgggagccgtgagccagttcttgcttacaaatagcaggaagaaactagacggggaagaaaggaagacattcattactgaaggcgagggatttgactgggcctggaaactccaaaactgcagccccaaattgcttcatgaacgaagccattcacttttagccacacgcagacccgtttatttagatcaaattaagatccgaatacagcaatcttaatcatttaattgtttggtggggagagcatcatatagtctgtatcttctttgtttatggcttcaccttgacgagctgtgtctgtgactcatgcattgggtttgccatccactgtcctgacgtctagtccctgcctgaccacttcccagctgtgtgacttcagcaaggggcttgacctctttgggcctgtgttcaattttataaagtgattgtgaggcctgcttcacaatcacaattaaaacttgaagttgtaagtaaaaatgccccctgaccaaaaatgagataaagcaataatgatccaggtggtacctgcattacttagtatcctcagtggtttttttagacatcaatggaggatatgtctaagtctacaattaaatgacattgtactttctcattttaaaacataaaggagtcggctggacgcggtggctcacgcctgtaatcccagcactttgggaggccaaggcgggtgggtcacgaggtcaggagatcgagaccatcctggctaacacggtgaaaccccgtctctactaaaaatacaaaaattagccgggcatagtggcgggtgcctgtagtcccagctactcgggaggctgaggcaggagaatggcgtgaacccgggaggcggagcttgcagtgagctgagaccacaacactgcattccagcctggggacagggcaagactccgtctcaaaaaataaaaattaaaaaatgaaaaatcaaaaataaaacataaaggagtcaacccagatctagatatatggggaaagcatgccatgtatagtaggaataatataa

SEQ ID NO: 27479 - DNA, 1028 bp, Homo sapiens
gattccaaaaacggggaaggaggcaggggaaaggggttgaaaaattacctgtggggtactatgttcactacttgggcaacgggatcattagaaacccaaaccttagcaccatgcagtatatccatgtaataaaccggcacacataccccccgaatttaaattaaaaaaaaattacattaaaagataggagtacctcctttacaccacctgaattatcatggcacataaatctcacaccctatttgccaaggccattcgttcctagctgttttacaggtaggttagctttctcaatgcaagtctgtgggacggatggagaaaaattccccgagccctttgatcctgccccagctgggccccgccgcgctgagccttgggcgcgccccctgctgcccgcggccggagccgttcgccacacccccgtgtttatgtcggtccacgggggttgcctgtccctttaattggcatgtaccaagtccttccaggtcacatttcctccctacgtcccagccgtttggactcactggccaaaagtccaagaggacggaatgtggagacagtgttgtatttttgcggggagttctaggccgaccgggagcgagagaacgctcgggggcgaagcgcgccattgcggccctccccgccgcctgcggtagtccagtcccaagatggcggccaccatgaagaaggcggtgagtggggagctcggggctctggatgctcgggcggcgccggatctcggccgctggggcccgggcgcgggatgctgggggtgcgcagctccgaagcccggcgtgggacccgaggccgaggccgaggccctgagagcggtcccgcggcaaggcctgctcgcgcctggcgccctgagcgttttcctaggcacctggccagccgaggcggggcgccggggctggggccgggagcctcgaaggacgcaggtccgcctcccgcgatgccgagggtgcccccggggagtctgaggaacctgcagccccggcctcgcccctgaggtgtgggaagccgaaggt

SEQ ID NO: 27480 - DNA, 1063 bp, Homo sapiens
ttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccag

SEQ ID NO: 27481 - DNA, 1038 bp, Homo sapiens
tgtatacttcaaaaaggtgcattggccaggtgcggtggctcacacctataatcccagcactttgggaggctaaggcaggtgaatgacgaggtcaggagatcaagaccatcctggccaacatggtgaaaccctgtctctactaaaatacaaaaaaattagccgggcatggtggcacgcacctataatcccagctacttgggaggctgaggcaggagaatctcttgaaacctggaggtggaggttgcagtgagccgagattacaccactgcactccagcctggtgacagagcaagactccgtctcaaaaaaaataaataaataaaggtgaattttatggtacctgaattatatcttaatataatattaatatattattattaatataatttatatcttaatatctctatggatctcctccttgaaccaaactgttcattgcgtggggtcattgttccctccctgttatctgctatcgcctgcagcatgccaattacttggccctgaagttaatttctaacaatgataacatttaaaaatgtggactgtctcagccagaaatcagtcagctacttcaatgggtaaatacatcctggtgcccagacttgtggggacgacacatgggacaaccagaggacaagacgctaagtgctatctgttgaacttgcctcagaggtgtggtaaaagaaaagaaaatttaaaaataaaaaattaaaaaatgctgtctgacaagaagatagcggtaagctatcccccacagctggttggggatagaacttgagcctggcttggaagaatgggcaccattttgtctaaataaaaatgcaggccggggccaggcgttgtggctcacgcctgtaatcccagcattttgagaggctgaggtgggtggatcacttgaggtcaggagtttgagaccagcctggccaacatggtgaagtcctgtctctactgaaaatacaaaaattagccaggcgtggtggcgggtgcctgtaatcccagctgctctggaggctgaggcaggagaatcacttgaacccg

SEQ ID NO: 27482 - DNA, 1031 bp, Homo sapiens
ctaccaaaaaataaaaaaataattagccaagtattaggggtcccaaaattagccaaacctgtggtctcagctactcaggaggctgaggtgggaggatcatttgagccagggaggttgaggctgtagtgagccgtgatcatgcccactgcactccagcctgggcaacagagtgagtgagaccctatctccaaaataaaataaatttgggggtttgtgtgtgagagcatttcaaggcttttttcgtgcactgtctttccttaaattgtctttcctagacctggtatattttaataatcttttagccctccatatctgcagcctttgaaaggtagcattgttaaatatgtatatagtgtacagtggaacaaaacagcttccaagccatgaataatgttaaaagttaaccattcagttgactgaagccatctagcatccaagagatacagtagagtatctttcagtggaaatcattgtcaaacttatggtcaaggatggtggttaacttttttcccgtttatgtagtgccagaatctgcacaagaacaggaatgatttccagttataattctcagagtggaattattttacattttatgtttttgtccagggttaaagtacttccagggagttgtttcaaaacacattgctcttctaattagagccagtgcctgtgttctttttttcttgtaattcttctacagtcttcctctcccgactcccaacaagccttcacagccagtagcaaaagtcagcaatatgggtttgatatcgcattacctccagaacagttcgttgaaggatatagtctttgagaatttgttaggatgggatttcatttgtggtaaagactttttagggtgagttggcagcatcccatatatactctttcgttgcattttttatatgtatatattttaaaggaaattcctatgagtaaatagataatggatgggaacctttaaaggtgaacccgaagtattttgccatatattctagcatattaccattttaaagcattaacattaatttaac

SEQ ID NO: 27483 - DNA, 1050 bp, Homo sapiens
gatggggtctgggcacaaatgctggttgtttagattcctgtcgagtaagtgcttggtgccaagcaaaagaggttgcgctgagaactggctcagatgttgcacagagactgtcagatggactgtggctcagggcctgcggggaatgcccccagtttctttactcttggggctttcatgggctccacgtgtggctctcagagtcccctctctgctgcctcttgaccaaggatcagtttctcctaaaactcactctctgtaactcaaagaaaataccatttatttcacaaaaagaaaaatacagattcattgttaagagtgtgtgatcttgtgctctaagtagcatccagggtggctgacaggctcccatcccggctctacatgggacagccactcaggttcctgtgcccatttcctcccctggaacgcaggccctgcctcatcaggacaatctaagtcattcacggggctgggaccagtgtctgcgacagagcaagacagtaaatgatagatgtgttgtgctgtgtctgctttgctggagttggcaattaagatgacgtccgccagcactcacacagccagcaagagaacgtctgggacagagtgactgatgggcttcccttctgaggatgcgaagtttagaatcatctttatcccaaccctgacagttttggctcttcatttttctagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctactgcttctgaagcccgcactgccaccgctcctgccccagaaggttgtttagtttccacgtaggcaggtcgctttgtgcctctgagtgcgctgctgtgtgttctctctatagttctgtgtcataaagctgtcctggccagccttcaagctggtgtggccactcttgatgtgaggcgtgtcggttccaggggggac

SEQ ID NO: 27484 - DNA, 1033 bp, Homo sapiens
aaataggaggcctacattaaaattagaggatctggtatagggaggggggttcataagaggagagcgatagagagggctaggattggagcaataatataaagggtgatagtagatgttaagggccgcgagggttctttggtgaaaagttttattgcatcaaaaaatggttcaagcagtctgtaaggacctacaatgttgagtcctttgcatagttgtatatagcctaagatttttcattcgatgagtgtaaggaacgctatcgcgataagagtggggataatgagcaggaggaggttaattacaggcatgttgttaagaagaggagttgaacctctgattataaagtgttaagttttatgcaatcgctgggctctgccatcttaacaaaccctgttcttgggtaggatgtgtgatgatttaagagactgggatggcatcatctatggagtgagggcactttatgaagtgggccctatttctcttgtcctttcgtagtaggaggaatgttaagtaggtagaaaccgacctggattactctggtctgaactgagatcacataggactttaatcattgaacaaacaaactcttaatagcggctacaccattaggatgtcctgatccaacatcgaggtcgtaaactctattgtcgatatggactctagtataggattgcgctgttatccctagggtaacttactccgtttatcaaattattgggtcgatgtgtaataactcacttagacttgtgtggtcttaggttgttaggaggttgaattatgctccgaggtcaccccaaccaaaatttttaatgcagggataggaggctagggcctgtaggcttgttggagtttttatttgcattgatgaattaaagctccataaggttttctcgtcttatttgtttatatccgcctcttcacggatagatcaatttcactggttgaaagtaagagacagctgaaccttcgtgtggccattcattcaagtccctatttagagaacaagtgattatgctaccttcgcacggtcagg

SEQ ID NO: 27485 - DNA, 1042 bp, Homo sapiens
atcaccaggctcggtaggcgtgtcaccgctactcatgaatcttcccactgttttgccacataggtgagtgtgctctttcagctattcttgggtagctcgtctggtttcgggggacttggccatagttctatgtaaagttatttctagttaatgcattatgcagaaggtataagggcttgtctttgctttttagtcctcaatacagttctttcatccttcccttacagtactgtgtctattgccagaaatatctaccagggtagaaatttctatcgcctatacttttgtttaaggtaaatggtttgattaagatagtttgataatatttttagcgaggtttggggctagagttgtctgagtggtcaggtcatgatgaaatcttctggatgtaagccggatgctttgggttaagctacactttggtttatccaagcgcactttccagtatgcttaccatgttacaatttatctcctctatacctgtgtagaaaattatcagtaatagtgatttctagagtagtattcgaggaaggtgatgggctgtgtgtgcgtgcttcatggccttattcaaccaagcactctgctcttggtttactgctaaatcctccttaagcccttagatttcataaggctgtcatgagattttctggacatagaaaatgttgcccatttcttgccacctcatgggctacaccttgacctaacgtttttatgtgtatacttgtgcttactctataacctttttagggtttgctgcagatgggcatataggccaggggcaagaggtggtgagacgtatcggggtttattgattatagaacaggctcctctagagggatataaagcaccaccaagtcctttgagttttaaattgttgcttgtagtactctggcgaatggttttgttaatgtaactgttagggtttagggctaagcatagaggggtatctaatcccagttcttgtcttagctactgtgtcttcagggtattaaagctactttcgtagtatgttttatttcaactggagttttttacaacttag

SEQ ID NO: 27486 - DNA, 1046 bp, Homo sapiens
ttcaccccagtctggaaaaattgtcttccatgaaactggtccctggtgccacaaaggttggggaccgctgctttaatgtgatcttatttagcttatatataagaaataattctgtgtataaacattttgacatagtttaggggccacagttgctcccattttattcagtagcaaggatcagcttctctgaggcatttttatcacctgtaaaatgtcttcctgacatacctgattaagttattgtgacactacattaatagatatatgaaaagtttgaaaagtgaagcattcatttcatatgcaacttatttttagtttacacacagaaaagtagcagcatgagtagatttgaaacatttctaatgtattttgtctgtctttactgatcgggcaacgggtcagaattagaaagtttcttataaagtacggcaagaaatagaattaactaatgcaggaatccttttgctcaaatgttatctaatggctattggaatttataaaacggaatctaagtttcatagcatctagtgggaggatcagacacaggaatgagagttgtacgttctgacggggaggcaggatgaactggtgctgggtgggaaaaacaatacagaaagcagctgtaaagtttggaaaggcttctgtgaatgctttacagaagacaagaatagaggtaaatttttgtttgtttgtttgtttttgagtgttgctctgtagcccaggagtgcagtggtgcgatctcagctcactgcaacctccacctcctgggttctaagtgattctcctgcctcagcctcccaagtagctggggttacaggcgcccaccaccacacccagctaatttttgtatttttagtagagatggggtttcgccatgttgccgagactgatcacaaactgctgagctcaaagtgatccacccgccttggcctccccaagttctgggattataggcatgagccaccacgcctggccagcagagctgattcttgaaaagtaaaccatttgcctatagctttttaagcattgtctcatccaattgaggc

SEQ ID NO: 27487 - DNA, 1052 bp, Homo sapiens
tgcaggttgtatgagtatggtgccggcatctgctcggcttctggggaatcccaagggagcaggagatggagcaggcacatcacatggcaaaagcaggaaagagagctatgggagagaggaggtgccatactttacaacagccagatctcagagaactcactattgtgaggactgtgctaacacaggagggatccgcccccatgacccagacatctcccaccaggccccaccttcaacactggggattacatctcaacatgggatttggtggggacatgcaaactctgtcagtgaggaaggattggtaaaatgctaagtatgttttggtttttgtttggtatggccccagtatttaaattagtttcttccctttgaattgccacaactaaagctgttcagcacattcttacatttaccttgatctgttttgtttttgtcttgttgaaagcatgatgctcctgttaaaaccatccattggatcaaagctccaaactacagctgtgtgatgactgggagctgggataagactttaaaggtataatgtgcagttgaggcattgtttggccccatcaggattgtcatttatttttgcaccatttcgacttctgctctgaatggtcacatactggcttctcttttttgcttttagttttgggatactcgatcgtcaaatcctatgatggttttgcaactccctgaaaggtgttactgtgctgacgtggtaagggatttcaacttaatatgtatttactttaaaaaaaaaacaaaataagtattctcaccttgtggcgtcctgcagttagtgagtggataatataaaaatcctgctagctttagtaatagatataaaggatcgagttgagattgcctcagtcgtctccaattgggagatttttgtgctgcgtttcttttagaagtactaaatgctggatgtcaagttttcctgccactcgtttgaacatatgcagctagctacatgccatctctagtgtgacatctatcatgtcctttccatggcagtaggaaaacttgcagtaagtttgtgaggtggt

SEQ ID NO: 27488 - DNA, 1050 bp, Homo sapiens
aatggcatacaaatgtattgatgtgcacagcgtcttacaacgatcttaaaggcaatatggttgatgctttcataccatcttgaggtcacagaaagaagggggctcagggcatggcccaaaacaggctttcatggtaaattgggttctcgtggcaagacaggttatgggaagaagagaagaagaggtctgtgtagcaaaggtggtcttgttaatgtggaggaaaccccacaggtagcaccctcggagagaactgagacctttaacggcatcagactgcagttaatcttccctaatcaggacaagggaagggccttggagaaagcctggctgcatcaatgccgattttctctgcagatgcagatctccccaccaaagatagcttttcagctattatttccagcccttctgtatagccatcttgaaatatgtcagagaagtctattttggggcaaaatattttggtttccttgagaataaaattacacatctggatgggttggttccattgtaaattcctagcttccaacttcaactctgtctgcatcatgcctagatgcttgctagctttttcaccttagctcaatcctccacttgccacagggctgctgggcctgcactcttgtcagcttctccttcctttagtctttgtctcagccaatcagatcagctcttgctcagagaaaaaagaagctaatgggaacttcctcctctttctcctgccagatctagaaatctgcccgtgcttgcctcctcccctgccttttcccccatgaggtggaagccgtcctgctaaggccagttttgtggtgggacccatgccctccagccttctcaggaaccgtatgcagagtatcacctctttcccatacacccgtctctcctgccgcgtagtacttctcccttagcactgacactagctcaagtctagttgatcctagaaaacacacctcccttgatccccacatcctcctccagtactgcccgcgtccctattccttccgcagtggggcatcttggatgaaatgtcctttattccctcacctcccactc

SEQ ID NO: 27489 - DNA, 1055 bp, Homo sapiens
ctacggtatcccacaccaaacccaagactacattctgtagctctttattcacatgttacccttgcctcaggattctcccttgctactgccaccagtaccatctactttatacgtatgtatggatgtcatatacatactaaatatttcccttcttttgcctactagaatgtaaactccatgagagcagagatttttgtttgtatttgttgctgcctcccagcacttggaggagggccttaagtgtaaaaggtgctctgtgaatatttgcagagtgaacatttgatctgaacctgcccctctcggccaccaccagcctgttgctcctgatgtgcttcacagcccattcaatgggacctccatctcctttgttatagccagaaatcttgaggtcacccctgattggaactttccctctcctgtctcactaatcctcagtctcctcccctctaccctgaaattatttgggaatctgttcatttttctccctccctcctgccaccacatctaattcaaatcttggaaagcacttagatcagaactctatgacattggtcttggcagtaatttcttggatatgacaccaaaaagcacaggcaacaaaagcaaaaatggccaagtggaactgtgttaaactaacagctcttgcacagcagagggaaccatggaaaagagtgaaaaggcagcctgtggaatgggagaaaacatctggaggctatttctgacaagggattgatttccaaaatacgtaaggaacccctgcaactcaatagtgagaaaactggtgacgtgaaaaatggaccaaagacttgaatagacatgtctccaaagaagacatacaaatacccagcaggtgtatggaaatgtgcttaacatcctaactatcaaggaaaggcaaacaaaaaccacagtgagataccatctcctagctgatgggaccactgttaccagaaagcccaaagataacaagcgctggggagggtgtggggaacatggaacccttgtgcactgttggggggatgcaaaatgccacaaccgttacagaaaactggaggcct

SEQ ID NO: 27490 - DNA, 1050 bp, Homo sapiens
tcctgcctgaatgacagagtgagaactccgtgtcaaaaaaaaaaagtctattgtggtcagagaacatactcagtattatttcaaaccttttatatctgacatttgtttcctagcctaagatgtggtctgtctttgtgaatgttccatgtgcactagtaaagaatgtgcattccgctactgatgtgtggagtattctgtaaacgttaattagctcatttaatagcactgctcctatctccagtgtttttactaacttttttctcttattttgcagtaaaagagtatttgaagcagctctaattaaagatttgtctatttctgtttttaatcaggttttgcttcatgtttcgaagctttcgttattgagtgtatatgcatgtagcattgtttttatatatttttatataacatacatgtcatgtattatatatattatatgtatgaattatatatctcttaaatgtatctgtgttatatatacataaacagaaacaaggtcttgctccatctgtcaggctagagtgcagtggtgcagtcacagctcactgcagcctcaacttcccagactcaagtgatcctcctacctcagcctcctgaataataggaccacaggtgtactcaccacatctggctaatttttttcattttttgtagagctggggtcactttgctgcccaggctggtctcaaacccctgggctcaagccatcctcctgctgtggcttcacaaagggctgggatgacaggcatgagccacctcaccgggcgtcattgttagattttcttgatgacccttttacaaacgtcatgaaatgtctctcttttgtccctggtaagagtgccgttctgaattctacttggtctgatattaatttaagctctttggcattctatttgattatctcttcccatgcatttacatttaacctatttatagctgtatttttcaagtgcctttcttgtagatagaattataggctctgcttttatatctaatctgacagtctctgccttttaattatttagacctccacggtctagtacagttgct

SEQ ID NO: 27491 - DNA, 1079 bp, Homo sapiens
tagtagagacgaggtttcaccatgttggtcaaactggtcttgaactcctgacctcaagtatcagcccgcctcagcctctcaaagtgctgggattacaggcttgagccaccgtgcccagcctgtttaaagaaatcttttccttgattttaaatattttccaaaaagtttttaggctgtatgatgaacatgtagaaggtgataaaggatttgcttaggatgaccatgaacctgtggaacagtccgttgtgcaccactctgctttaagtgggtatcgactgcttgggagagattactatgcagagttaatccttagatctcattagcctaagagatggtggagattcaagaaaaggttaaaggtgtgtgtgactatggaatgcacacaatacttcactgaatttatggatacacttgagacttccggcttcttgaagccactctaacataagccaaatgtgcgcttaaattcagctaaccctcactgagaacccatcaagttctttgcaccattctaacagagacaactttgtgaaggtcccttgatacctctgttagaggaacttctagatgtcatgtgcctttggtctttttatgtctcaatcttggtattcagtggtgtttccatcagtgtacataatccagagatccaagggttgtttgcatgagatttctagttttgagaagtgagaatcctttgttaattgtaaaatgtgctggattgttcatcctcgggaggcactatatgccattatggggatgacaccatcccatatgccatgcaaagaacagggtttgcagtaaagagaggtgctggaatgtaatgtcagagcacacctatgttccaggagagctaaacaagtctactgcagttaaagaaaagaaatgtttaaaataccttgcaacaagttttttcattgagagcacgtactctgaccaaagttcatgactacttggtgtgcatgaagaaagtcatatttttagaatgccatgataaatggagaagtatatgaaaagcattctagctttaggaaataatgctagtatggattttagattaaagacataataagatctgccta

SEQ ID NO: 27492 - DNA, 1029 bp, Homo sapiens
ttcttgttcactggcttagtaaaactgcgtgagcacagtgcctggcacactgactttgtattgaagtataatagacatacagaaatgtgcacgtatcagaagtataaggctcagtgaattttcacaaactgaatatactccggtgcttggcactctggttgggacatggccgttcctacacccaacggtaaccatcctgatactaattcttcagattggtttatctggttttgttttacatatattttgtactttatatttttaaaaacactctgtttcctcttgtgtgtctggcttctttcattctgcattacatttttagaccatccatgtcattgcatctagctgtgaatgatccactctcatggctggtttgtgcgtgtgagtgtcagagtccgagttgtgcgggtaagggggcagtgaagaatacccacaatataattatccattctgctgttgatagacatttgggtagctgtttccaatttagagttattacaaacagtactgctctaaacattctgatcgtattctttggtgaacatctgtacacatttttgttaggtatatttatacccacaagaaaaaatgcttgtcattgagtatgcatgcattcagtacagctttaccgccaaccagttttcaaagtggtagttgtactagttgacaaccataccggtagtgtatgagaagtccgatcaccttctgtctctggtgggtagtcagtgatctccattttcatgacagttaatgaagtcgagcacatttccgaatatatgtttacatttgtcgtatctacatatcctcctttgtgaagggcctgttaagtcttttgcctgttttcctgttgggttacctgcctccttcttaatgttttatagttctttattttggagatgagtcacttattgactatgtatattggaagtatcttctactgtatggcttgcctttgatttttttagtcaactccttcgatggattgaagtttttaatcttcatataatctgactgatccttgttttcctt

SEQ ID NO: 27493 - DNA, 2020 bp, Homo sapiens
gacttctgatgggattgggcccattttcctttcactgcgtccctcatgctgtctcctggttgcggtgcaaggaggctgccacggtgctgggatcctttttctccgcagagctgtctggagcaacacctgcggcgatgggaagccatgaccctggtttctcccagatactattacctctgtaatttgtgcctttatgttttctatgttgttacttttgttttttttttttttttcctaccttcaccagggccacgaggtaaaagttcttgtctgacatgctcattctttctttttgcgtgtatccagtgatgtgggaggctctggggaggtgatggatgcacaagacagataaggcctctgctctcacagagcttaccttccgacgaggacagacaaaccaacacacaagatcattgcagatagtgctaagtgctgtgtaggaaatggaacagtctgactccatggaagcgtactttagattggaaggccgggtctccactatatcgctagcaccggactcacagtagatgctcagttggtatttatgaatgaatgaatggccagaggctctccagtttatatgtcctattgggaagtagtgtagggtaacttacccaaagttacccagttggcaaatggtacatttgaacccagacttcagagttcacgctcttaaccgttttgctgtctgatcgctgggaaatactccagaacggtggctgtcactttgccttccaagttaacaatgtgaaataactctgaatttacagagaaccaaaggctttccaattaaaatgaaaaaaccgaaaaaccccaccaaacctaccgtggattgtaattccaggatagtacttgagctttcatgatgttctcatggccttctggggatgccagattgggaaagaagtccaggtagctaaagtgaaaatagtgagccttagtttccacttgagttgtctgaagttctttctctatctgggaggcctggcttggcttctcctgataattggtgggttcattcggttagtccacaaacatttactgagtacctgatctgtgtgtcagatacccagagaagccaagttatatcagctgtactctcctattttccctcaacctcctcccagtactttagggaagggggcagatgagaataacagccaggacaggacaatgatgtagggtagtccagagtgctccaggagcattgaggaggtcaactcctgaaagaggtgtcatttgagctcagttataaaggtcgagtagaagaaggctcaaagaaggaaagggtggggaacatttcagacagaggaaattgcatgcacagaggcacaaacactgagatgactgggctcctttgggatgccactagtagtttttttttttttgagatagagttctcactctgtcacccaggctggagtgcagaggcgccatctcactgcagcctctgcctcccaggttcaagtgattctcctgcctcagcctcttgagtagctgggattacatacaggcatgtgccactacgcctggctaaattttgtatttttagtagagacggtgtttcactatgttggccaggctggtctcaaactccggacctcaagtgatccgccctccttggcctctcaaagtgctgggattacaggcgtgagcccggccaccactagtggttctgaatgacagcaacaaagaacatttgttgtggttgcctggcaagatgggagacaaggctggtgagtagacaagagtcagatctcagtccctttatgcatagatgcagccagtgtccaagttaaaattgtgttgcttctccttgagcagtccttccttgcattaactttctgaaaacccccaaatcccagtacaaactctgttgtctaatatgttatggaaagaggcactcatttgagaaaatttaagattttgttcaattgttttactgaaagatgtgtgaccttaggccacttcactcctcaaagcctggggtggttattcggtcaatggggatgatgctcgt

SEQ ID NO: 27494 - DNA, 1033 bp, Homo sapiens
acagcattaattctttagctttagcatggcactgattttcttaacacttcatgatcacgtggagcagactgtgctttacagcacaacagagcgtcagccatgtgctgaagattcttcgtggtagtggtttagatccaccctgaatagattatcttcatttatttaattattaagtagcttgcttatcaaaagcggcattaaacttactaaacttgagtcaaacgtaaatcttcatagatagtaccatttacttctgaaatcttgttcctgggagaaaaatgtggactggaagttaactttcttttatccacctattcactcctttttcttcacagttaactccttaggggaaaaaatgtatagttcttgaccatgtgcttatgtttgtaaagcaatgatgtttccttaacgtgagtggttgtgacatagatcactgttatcttcataattacctgggagcttttcatccaagtgtggatttactaaaataattagtctgaattgatgcttattaaagagctgaactcttaaacgttaacactatcttgtatttattaaaattgtatgcatgtttccttcaaatgctgaaggcagaatactgagaactttgaccctgtgttattatcgctaagtagttgaaaattaggggaggagtcaagggagtatattatattggttatcactcaaatactacccctaggcatgatttttagaaccgaaacttgaatttttacataaagaattatctccaaaagtgtcttttttttttttttttttgagatggagtcttgctctgttgccaggctggagtgcaatggcactatctcggctcactgcaacctccgcctcctgggttcaaacgattctcctgcctcagcctcccgagtagctgggactacaggcacatgccaccatgcctagctaatttttgtatttttaatagagacggggtttcaccatgttggccagatggtctcgatctcttgacctcgtgatccgcccacctcggcctcccaaagtgctgggattacag

SEQ ID NO: 27495 - DNA, 1077 bp, Homo sapiens
ccacattgccctgcccatctttccagcatcgtctttcctcatgcttgtgtttcagccttttagttctccttggccatggggctttggcatactatgtatcatgacttaccctgtatgtagtcataaagtaacagtttttagctgtttccaccactaaaaattagttgattccttttcctcttgtttgtttcactgcgtccccctgcttacctttgaggctcagcacaggcttcacttcttcaaggtaactgtcctgacattcttcactcacattgtatctgttcctctggctcccacacatgtcacagcatgttgtcattggcaacgtgatacgtgactccctttcgctgttagtcagcaagcccccccaccctttttttttttttttttttagattgtgtctcttctccccacatcccagtgcctagcacagcacagtgcatggtgcatggcagtttctcagggagttcatggtctctgggtctaaggcataggcgaggaagggttggtgtttaggagaaagctgagaaagatgccaggcgcaatggctcacacctgtaatccaaggattttgggactccgaggcaagcgaatcagttgaggccaggaatttgagatgagcctgggcaatatggcgaaaccccatctctactaaaaatacagaaattaacctggtgtggtggtgcatgcccataatcccagctactcgggaggctgaggcatgagaatcacttgaactcaggaggtggaagctgcagtgagtcaaaattatgccactgcactccactctgggtgacagagcaagactgtatctcaaaaacaaaaacaaagctgagaaaggagagaggggggaagaaagaagactttcagtggtgaagagtaatgaagcctgtcggcagggcccgttatgtacagccgatcgatgtagacacagtgcattttgctcagaaaatatttgaagattttccactaaatgctggttgcttttctctcttgtggaaacttatgtttttacttctcctcctcttctatttcagagagtcaggactacctcttaggtgtgtgttcttttacccc

SEQ ID NO: 27496 - DNA, 1044 bp, Homo sapiens
ttgcccaggctggagtgcagtggtgcgatctcactcggctcactgtaacctccccctcccagttcaagcaattctcctgcctcagcttcccaagtagctgggactacaggcatgtgccaccacgcctaagtaatttttgtatctttagtggagacagggtttctagattaaatgtagaggaatatagaggaatgtagattaaatgtagaggaagagagactgcttttggcctaagcagttgggtgagtggtggtttctttactgagatgagaagcattgagtttgagggaggagagtgggactcaagagtgccgtttggacatgagaaacttgagatgctcagtacacttgcaacgagagatgttaaataggtagttgagtctggagctcaggggagagggccaggctgcagatataaatttggcagtcagcttattgttgtgacatagaacagtaaggagtaatttcttctgattaaagagatttggtaaacctttccaaaagagaagacgtttgagcaaaactttgaagaatgagcataatttccaaaggcagagtaagggaaaaatagaaaatatttttcatccaagtctcacagcctttcccctggcctcttcttgagtttaagaagctgctgacctggttgataatctcttatcactggtatagccacttaggttctttattgaaaaggaaccagaacagattacacactaactgataaaccacgttctactgtttctcatcgttcacagattgaaaattccagttggatcatcaaggtgcagaatgctaaacttgttcttctcccctgttctgtatctggtgtgaattggatgtgttgattttcgtatggaggctttttcacatgctgtcatctccactaaagatggaacactttggagaagttttacttctgttgttaatgactttttgcacttgaactgttaaaacaactacaaccatgagaaattgggaccccatgctattttatcactcatacccctaacttgagcatattatctgtcttgactcatcctgctt

SEQ ID NO: 27497 - DNA, 1716 bp, Homo sapiens
tatctgatcgtttctgcaaactcttattccctgcatctcgtctctctcattatggtgcacccatgccagctctccccctgtgcttctcttgagtctgcaagacctgatcttcgaatcaagttattatcttgaagtcaggagggtcgaagccagcattgattgaggggcttctatgtgctggacctgcacatgtactatctcatgtcatttctcttacctgccctgtaagggatgcattgtcacctccattttactaagaagtagactggtggtcatagcatcgtgaaactagcaaataacagagccaagatgtggatcattctgactggctctgaagcccatgctctttgaactgcagcactctggagaaaggaaggaactgggattttggcatttctgtatcctctggatatgtatggtttaaatttttctgttgacatcaagggcagctgaaatcttttgttcccctcttctatctactttccccccctcgatttccatgcctgtatcaaatttgagcaagtttgtcagtagatgaaaattaccaatttttataggaagaatagggaatgcagcatggttttctgaataaaagaatctcagtaggtggttgtacaatgttagtgtgttttctgatataaaatataaatatgtatgggtgggtgtatgtgtatgtctctatctctctcttttttttttgagacagtctcactttgtcgcccaggctggagtgcagtggcgcgatctctgctcactgcaacctccacctcccagattcaagcaattctcttgcctcagcctcccgagtagctaggattacaggtgcgtgccaccacacctggtaatttttgtatttttagtagagacagggtttcaccatgttggctaggctggtctcaaactcctgacctcaagtgatccgcctgcctcggcctcccaaagtgctgggattacaggcgtgagccaccgcgccaggcatctccgtctctctttcaggaagatccattgtttccccatcataggaatttttaaaaagtaaaagcgaactctgcctttgttctgatttatgattgcttactcaaggaagaccaagactttgtggttgtggccttcctttggcagataaagtaaggcacagagtgtggcacagtcatcaagggtcacttggatggtcatggcagcactgctatttgaagctagtggcttggctcctgatccagtgctctttctgtcatactaaactgcctcagtagtgttagaggatgaccccacttatgaatgaatgtaaaaagtaccatcattctcaaagtttaatgtatttgggggaaaaagtagttgaataataaaatgtccatgtgtctgtagactttcttcctagatgagacaagatcatatctgcaccttagaaagagctcctttgttattatttggtatttagctcagtgcttggggggaaccaaggtgaaaccagatgtcattgcatttctaggacagccttgcaagtcagcaaaggaggccagccccatttgctgcagttgtatgtgctgagggaccactgcatcatttattagacatgcatagcttgggataaaaagcactgcctttttccaggagtcctcttggtattaatacagctacatgatgacatcttggtgagtcactagagtcctcaggaggaggaggataccagtcgacaggcagtgcagattatccaaa

SEQ ID NO: 27498 - DNA, 1027 bp, Homo sapiens
aaacttaggtggtaaagtaacagttggacacaggcataacctaaactttttgtgtcagtggattataatatgtgggctttcccaaagagttgctttaggccctggccccttggacctgtgatttgaatccttttctttgtcctttacatgggtgctcgtctcatctcatttttattgtagccccttctgaggtttgtgctttttggatgaggtcacatggtagatagggggtgcagggggctttctgtttgcattcactggcccagaatactgtggttttggcccgttgctccatgatacatactatcaactagagatggttttgaattatttaatctggacctcagcaaaataggtacacttaaatagagattgaagaaagggaggttggaattttttcctcctgagatttcaaatgtaaggaataaagaactttttgaattaacgaattgttttgaggcagtggggatcttcccatttgttctagctttacaaaattaaatctattttctgaactgtacggtgggaaaatatttttaaggtacataatttctgaaaatgtctttgtggtaagctgttagtggttgtggatttttttttttttttagtgcttcagttaataatgagggagttttccattaatattccaaaccatgtttgccagcggatacagcaggtgaagtggtaaaattatgggcccatcaaaaatacttatgcttcctgtaatatgatattaagtttaatatttttataaccttcactgaattctaatttcactaaagtagcaagcatgcgtccatttgcagttcagttatgcacattggttgcctgtgtcccaagcaaattagaaatgcaaaatatctgtgtgtggaggggggcattggaaagagtcattaaagataccgatatttagttacagatacactttactaagtgtaccttgggaattgaaaatggattaaagacaaacacaaaactcccagtgtctgaatctgtattttaaattagaattcaaaggattaaggag

SEQ ID NO: 27499 - DNA, 1040 bp, Homo sapiens
gagggtgggggtgccttctttttctatatcataaccttgctgctatcctggtctgtaatcctagaataccctggaattcccatcttctgctgccaaaaggagaagtaatcaggagcgtatcctcttaggacatgggatttagctaggaaggtgctctcactacagcctggagggatggagatgggtcttggggtagacacagcccacacactgccacagtgacagaggagggatttggtaatgaatgtgttccgttggtagttggcagagtggttctgaaactagtcccagatagtatgcgcttatactttctagatatgcctttaaaataagtttcattttctcattttaatttaatttattatttttgagacagagtctctcagtgtcccccagcctggagtacagtggcatgatcatggctcactgcagcctccacctcctgggcccaagtgatcctccctcctcagcctcctgagtagctgggaccacaggcatgtgcctccatgcttagctaattttttaatttttttgtagagatgacgtctccttacgttgtgcagactggtctcaaactgctgggctcaaccagtccctccacctcagcctcccaaagtgctgggattacaggcataagccaccatgcccagctgaaaacaagttttattttcataaggagagccaaggttacctggtcatccagacattgtttagaggattcctttttgttcagtggtgggcctgtcccacagagtagcaacatggggagcattggttgactttgaggagtcaggcagcaagacttcagggtttatgaagtgtaatattttgagaaagtgagtgtatttaatcttgtcatgttacaaatattgaaatctcagcagacttcagttctttatttgatatacatcagggctttctcattaagagtatttttctgaaattgtcagttataggaagaaagttattcttccagcaggtttataatatcttgattattaaatttaaattgttttagtggaaggaggcaaaaccggaag

SEQ ID NO: 27500 - DNA, 1050 bp, Homo sapiens
ctagcttcttgggtggggaagttgatgagccagtgaatatatagatttctttttgcttttggtatttggctatttttttctccccagggagaaatttccatggctttcatgagagtctcaaaagggtccttggatctgcctaaattaagaaccactgtcccttgatcagaaatttctcaactgttgaagctcttgtccccttaaaaaaaaaaacaaaaacaaaaaacttggccgggtgcggtggctcacgcctgtaatcccagcactttgggaggccaaggcgggccgatcacaaggtcaagcgttcaagaccagcctggccaacaaagtgaaaccccgtctctaataaaaaatacaaaaaattagttgggtgtggtggcaggtgcctgtaattccagccactcgggaggctgaggcaggagaatcgcttgaacccaggaggcggaggttgcagtgagctgagatcgtgccactgccctccagcctgggtgacagagctagacttcgtctcaaaaacaaaataaacaaaaccccaaacaactcaaactctccattattgtaaattgaaaataaatgttgagaccaaaatagtttttattttgaatatgcatttttaaaccacttgggtgagaatcttttttcagagagtgaatactgacctatactctgttttaatgcaagtatagttctgattttagaagactctaaataggtctgggcagttgtggctcatcaaactattgatgtggtgatgagcttggaggtggggtgcctcacagtgggtaggaggtggagattatggaaggaaaatctgagcttctagcttctggatgaggcagttggcattggcaatggaaggttgtattgtactgagtgatgaagtggggaggcagggggtgcttcttttggcttgtggtggtgtggaagttgctcccatccaatatgaaacagctctgaatctgtgctggtcacagcatctcttaggcctctgtttgctaaacacctctaaggccccttccagctttaaaagtatgagttttcttctctttt

SEQ ID NO: 27501 - DNA, 1101 bp, Homo sapiens
gcataaaaagtatagtttgtgggaaataaaacatggttaaaaacaaatatgaaaaaatgtaaatggatttaattaccaatcaacagagattatctaattggatttcgaaacccctagctatgtgttatttataacagacatacttgaattatagggacacagaaagtatgaaagtaaaataattcataaaacttgccaaatactaagtaaaaggaaactgggtggctacatcaaaatcaggtagagtaggatacccaataaaaagcactattagggataaaggtggtcactccacaaaaggtccaacctgccaagaaaagatggccatatcagaacatacaaagcaaacattgctatagctagagggaaatgttgacaaatccatcgttataatggcatagttttgcacaaggcttctgattatttatagaccaagtagacaaaagatcagtaatgacaccaaagcttaaaaaacacaatgaacaagtttaattcctttcatatatatgtgcgtgcctgtgtgtgcatccgtgtgtgtgtgtgtatgcaagtgtgttgtgtaagcatagtgtatacagtggtccccccatgtgcggttttgctttccatggtttcagttacctgcagtcaaccatgatctggaaatattaaatggaaaattccagaaataaacaactcatacattttaaattgagtgctgttctgagtagcgtgatgaaatcttgcaccattctgctgcatcccaccctggatgtgaaacccccttttgtctagtgtatccacttatacactacctgccctatacaatgcaataataggaaaaaacatagtatacataggatttggtattatccacagtctgagacacccactgggggtcatggaatgcctcccctgaggataaggggggactaatgtacacacacactcacacacacatacatatatatattactgtgtccaaaaattagagtatgaacattcttttcaaacacatgtgcaacatttacaaaaactgtccccatactaggccatacaatgtctcaacaaattcaaataattggtattatacaggctacagttctgattacaatgcaaaga

SEQ ID NO: 27502 - DNA, 1172 bp, Homo sapiens
gcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggtgagtctcctggcggcctctccgacacacggaccgtgtgcactgcggctctgcctgtttgtctgtctctgtctgtctctctgtttaaaaagagaagataagaataataagactaagaataataagatctcttggctagagtcagggggcatctgtagccctggatgaggaagaagcggtgctgtgaggccgcagctccacctctgcccggtcttctcctcacttccgcagcacccccccccccgcaccccccgccttggcgtcactgcgctacaggccgcctgtaatttacatatgttttaacgctaac

SEQ ID NO: 27503 - DNA, 1465 bp, Homo sapiens
cagggcagcatgaaataaaggaaagagcactgagaattgaatctgagaattgaggcctaagtcctgttctgctgcaggctcagagtgtgtccttaggcaagcctttaatcttttcggacattttttgcctcatttgtaaactgaggggtttgggttaggtgatttccagcagccctatcgattcaacagtattttctcaagttctgttttaatacattgtttctcctgactttagctttaatttgaaaaggagaaattcatagtcaacagtgttgtagctgtcagtccaaggttactgacagaaatccttagaagtagccccagtactgtgcaaaagtaactttcacattattatgccagccaagtgcaggttttaaggtagcaactcattcaagcagcttggctttaggaaactgaaatggatttatgaagctaaacaattattcaaaacaaattgtaaagtcataaagaaatgaatgaaaggtagatattgagatgctcttctgatctgatgaaattctgtatggatttgtgtggtttccttcgatctccgggaatggatctaatataggggttggagctactttgttagtgtttactgcctaatctatactctgctttaaaataatgcataatctataattggaagctagcgttaattggtcttagattagtttgaaacataagcacattatttttaataaaatgtgtgctttaggaaaaaggaaattaaggattaactatggttataagaaacctgaggtccttattcaggcttgactacaatattagctaagatttatggagagtttactttgtgcctggctctgggctaagccctttccgtgtgtaagctcagctcatcttcacagtgctctatcaaataagtactattgtttttctcagatacagataaggaaacagattttagaggaggtaggaaactggcccagtgtcacccacctgatggctgggggctgtgattggaactctggcaaatctggcttcagagccccgtgctcacctcctgggccactctggtgttggctgcattttcagaacttgtgctgcagatcctggaaaatggaaggacctattgttttaaaacaattttttttcttgcaataggctagcatctttctttatctcactttatgaaccttacatagtcaattttaacttgcagattgaagattctaagttttagtacaagctgagtctgttggaaaattagttctctgtctttagaatccaagtatgaaatcattatatatttctctttagatctacttgcttttctgcttttaaagattccatgggagcagtgaggcttactttgagaataagggtactttgttggataaaagtgaagcaaacttttattttggcagtaacggaaataaagtaaatatcactatagcatagacctgtgtttccaactcattttgctcaacttttccagact

SEQ ID NO: 27504 - DNA, 1465 bp, Homo sapiens; identical to SEQ ID NO: 27503

SEQ ID NO: 27505 - DNA, 1465 bp, Homo sapiens; identical to SEQ ID NO: 27503

SEQ ID NO: 27506 - DNA, 1052 bp, Homo sapiens
aaatagtgaggcccatccatgagagctgcagtggaataagccccagacacatggcggagtggaaagacccagatgcagagcagcatggataatatgattcctgctccttttttttttttttttttttttttttcaggaaaaataactcatatttatgcttgtgtgtgcttaaaaaattcctgaaaagatacacaagaaactgttaacagtggatacaccccaagaaacatctgggatagaaaacttcctttctattgcaaacccttttcttagggtggatatatatttttaaaccatgtgcatgtatactttgccactaaaaacaattagttaaaaaaaaaaaacaccactcaacgggtagctgactgagccaggtgtcatggtcatgcctgtgtgggggtttcctttcccattcaggaacctcactgccagctccccgcctgggcacggggccctggagagggcttgggggcttggagagcaggcgttctgagttaaaatagatgttgctactggctgaacagtttgaagatatggagcttatgacctcaaaaggaagtgtataggatgcgagggagggtaacaaattatggaaccacttaggttgaagaaccatttgaataatgttccaaggaggggcacataagtggtcataattacttcggggtctgctgtctgaaccgatttccagtctttcctacttcctttttcaggcagcaagttccagaaactggctactcactgcatgaacttggcaggcccttttgcttttcttatgtttcacctctaagggcttaaaagggagtcttcacgctctgtgatcagaggccctgcgtagagagcactatctcctccacgctcaccccagtgctattagaaatgcaggttgctgcctcatcgtgggtgcccacggccacctcatttccttgtgcgtttcacttgcctcttttgctcttttgtgcagtgccgttatctttttcatgaagtgtggcttccacaattgtctgtgacgtacattttatttacctcgtgcattcattccactcgtttct

SEQ ID NO: 27507 - DNA, 1052 bp, Homo sapiens; identical to SEQ ID NO: 27506

SEQ ID NO: 27508 - DNA, 1052 bp, Homo sapiens; identical to SEQ ID NO: 27506

SEQ ID NO: 27509 - DNA, 1048 bp, Homo sapiens
tttcccttctaattttggcaggttattgtgtaatggcaattggaaccactagcgttcaagtagaattaaattgttgttcaccgttaaaatctgattagggcattttattatcttgccagcagggatttgggtcctgatccccctgaaaccaactgcagaatggagtgttcaggctctggaagatccagttacattaattactccagtggttcccagtgaactgctatctcttctaatccagcatgtttccaataaaagctctgttcttcctcatagcccagtgtccccgtcttccaatttaattgtttaagagattaaacaattaaacatcttccccttgagtccaaatttttaattttaggtggtagactggagtttaccatttcctgctctgacccatagagatgtggatccacgtttatagacgtgatagtcaatttgcaggtctacttatgacaggggcgagcttacctggtgttctctgcttacttgaatccaagtacgtaggcagcaaatgggcgcagagcttctgtgctgctcagagcctctgtccactggaccatagatttcttagggccccaggaagtccgaatatggcatttctatggcagctgaaaccaataaggaaacctcagtctgtcagtacttctttctcgtgagctagatgtgatggcactaaccagcattctgccatcgagctcctgacactgcttgagggtgaactccagagccctccgtgtgtacctgcagcacacagggaaggaaaacatcatcttatggatgatgatgtctgtaatttgcatatctcatttttgacgttcagttttcccagttgctattgttgattgtctgtaactgtcatttattacctagggtacagtccttgacagaattgactataacgttgaacagtcctgtatcaaaactgaagatggtttgaaacagcttcacaaggtaatatgtctttcaagacttgggaatcttaggaactattttcaaataatcaagaattggtaagagggttcttttccaccataacgatcttcag

SEQ ID NO: 27510 - DNA, 2473 bp, Homo sapiens
taaataaaaactagtgaaatatgttttgtaatataacacagataaaaggaaaagctttctctgcgggagtgagcaaatctagtgggaactaaaaattttgttttaggttctactttataaatcattttgagaggttttacagtatattatttagtattggcttccctggtgttctgggttacttattagaaaagtcagcgtgctccatcttccctccagccacaaggctgtaggcagcacgcgcgtgctcggcagtcggctagtctaagggtgattgagcgtcgggagctgctccccatgaccggactctcggtgctgtccccgtgcctgatgtttcctcctggtggatgaggggctcctccaggtgggcgggcaggctcacttaggaaacaagcccaccgcgggggatggagcaggagagattgccattctcgccagggctgccttcccgctgtctcctcctccctcctgtgccatagcaaggtctggaagaggcagcgcatgctctccctggacgtgcctcccggcgccctctgaactctgctgtcctctggctctcctttctcagtgctctgcgtctttcgccagccaggtggggccctttggcatttctctagcaggcatgatggagttcccgctcctgccgagcttccaggatgcggtgttaaggtgaagagatgtgcagggtgcagcctcgtccccagattgagcttggagggctcctttgctgtatcgttagcggcactgggaggacgcgcctcagagggatctttctgcatatgacatccatggggcacacgtgtctgtttttatttcaaaggatgagtttttgtttccaaatttaggggaggtcgaaatggggcctcttccgggtgtctgttgcctacctgccaggtacggtcctccagcccgttgtttccttccgcggtgaaggaactgtgcattcgctccaggaacacggaccgggaacaggcgacccgtgctgcaggggcacttgccacggcctgcaggaggaaaagccgggagaagcaggcccagctgcacccggaagcatgagctttcacttccctgtcaggctttgtcttagtagtaggtttccaacaaatccatttccacgtccagggtaaataagcagcaccaggatcatggggctcttccactcctggtgattgaattccgtgggattgattggagggattacaatcatgtagcctgtagcagagacctcagtcactgtgcagagagatctggaagcctcattctggaaacgagtgggacttgatttgggattttggggaaaatgacggccttttttccctcctctttttgtaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaa

SEQ ID NO: 27511 - DNA, 1032 bp, Homo sapiens
tagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcga

SEQ ID NO: 27512 - DNA, 1060 bp, Homo sapiens
gttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaacaatgggttcatgttttcttccagtgcatttgtgttaggggagggcttggccagttttgtgatcctctgggcccctgactctgttttgtgcctgaggcctttgcctcagtgtccgaaagtagatctatctaatggatgctttcaaagggacaatctatttactatctgatatacaaaaagaacaactgcctaaaaggcagataagtatttttcttatgaaaatatatgctttatatacataccaagaaacatttggaaatctccaaataaaactgtgatgtgccttgttgagaagcaattcttacacacaggctgtaagagacttgactttctaaatgattttgtttcctactctgttacaccaaaaacttgagagacaagtgtctgccagtttaactcaaagccaagactatgtttccccttgattgtgcctgtcctggggtcctccgaggaggacctttgtcctgaaacttgactttgatgcatttgttttgctggtgggagatgtggacctgagtgatggtaggggtatgtggtttcatcaccagaacctatacaaacaaaaaatagcagctgtcatgccaggtctctttggcacccttggcgtttggtcctgaggtgttgcgg

SEQ ID NO: 27513 - DNA, 1034 bp, Homo sapiens
gggggcaggggtgggcaagtggttctggaggagccgtgtggccagccctctgtggccgtctttgccgttcacccctggttactcctccaacagagggtctgtcctgcctctgggacaggctggctgggaatgccccagcaggaagactcttctgagcttgaattccctgttcacaggaagccacttgacaaatgatcacagattcatcaggcagcagccgtgagtgttctcagcactcctccacctctagaggtgctgcggcctctagaggtggaggagcacctctagatttgaggggtgctgaggacaccccacccccactctggacaaagatccccctcccacaagagctccagcctggaggctccactgtgaacgcgaatgtcctgcttggccttcacatatccttgttggcctcttagaaaggaatacgcctctgtctgagccacagaatcaatcctcagggtaatgcatttacccagagaataaaatcagcatccacgtgtccacactggtaggaatagatcactgaaggaataaatgaatgggggagaaccgtttctcacactgaatcccagtttcaggctgcagaggtagtgatggaaacaggaagtcgtcaccccacagccaggcttcattccaggtgagagtggcccacagtgctggaactggagcatgagagtgggatgggaagaggacagtcaaatgctctcagagtgcctctcgcagctttatagtggtgacactcacaacccagcctaaccaggtgtcccagggcatgtcaccagggcagggacagagccacctgacatgcctccagaggcagtgtacagggaaggacagagcatttctgcaggattcccaccaaaaatgcatggcctgcctgtagtcacaaggacacgtcagacaaacccagcactgaaagtgccaaggccacaaaagacaaagccagactatgcagtcgcccagattaaggagggcaagcaggccaggcttgatgtgtggtctgatctgatctggacgtctgaggagca

SEQ ID NO: 27514 - DNA, 1034 bp, Homo sapiens; identical to SEQ ID NO: 27513

SEQ ID NO: 27515 - DNA, 1034 bp, Homo sapiens; identical to SEQ ID NO: 27513

SEQ ID NO: 27516 - DNA, 1096 bp, Homo sapiens
agctgccccccccacccaccacgagcagcgcccccccaacactattttaataaaccattaaaaaaaacacattttcctgctggctggccacattgagagtgctttgtgaaaagaaaaaacaaagacattcacaaatcagataaaactggagaatgacatttgtctgtaaatggcttcttggtctggaaatggcgtggtttctttttttttttttttttttttttgtcctcctcaaggtgggaggggggattgagagtgctctaaggagacttttcctccaggtgggaagagataaaaagacattaattagttgtttatcaagtgacatttagttgtttggttttgggttttctttttttgattgcgatttttcctctgattaaaaaaataataataaaataaaaaaaggttaactataaggagatggcctttcctccttttttttcttaaggtgctgttttgggggaaaaaaatgtaatgaaatgaccaaaagaattacacagcattaattaaaaatggaagttttccacttccttgataatttggctatctgaataaatttgtgaatttgctaggttaagacctagttcgtggtcacatttcaacaaaacagcttgagtataaagaaaataataaaaggctgttcttatttattttcctttggtggcttttggtttgctctttttgcataggtcatgactttgttctcctgggtccagatttataaaagcagaaaattactaattaagtcaaaataagtgtctttggtgtttatgcatttgcaatttcagtaattaaatggtacatgtgttgctgtcttgtctaaaacttttaaaggcagaattatgctgttgggatattagtatgcgtataacttgatttcaaagtataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacat

SEQ ID NO: 27517 - DNA, 1050 bp, Homo sapiens
tggtctccccttttcctcagcaacatagttgtacccagagggaatttatctttagaaagatatagtttgtgaggaaagaggaggatggataagtggataaaatgtaatgcagttttaggggtggatttttaagtagcccaaggggtaggaaacctgcacagaaagaagctgcgttgtgaaaatgttgaggaggaaagtgctgcatcgctacgtgatgtggaagagactgcagtgtctgggcattgttgggaatcccgggtattttaaccatgaaacatctgacaacaaattatgtgtctagatatgtttatgtgtgaatgttcatgtatcagggattcagtttcacagttttaacttcaattttcttgtttaccccacaaatgacaaaattgcgtcattccttctctttgcccctttccaacaccaccccacaattttttaaacaatcaaaagaaaaattaaaaccagcaaaccttaaattcttgtttgttatttggatggtgaaatactgcaggtagacactgaattggacattgatttccttttctctgcgtcgaaatgtcaaggaaagttgcaagtctgtgattttgtgtttggttttttgcatgttgcttctatggaaaaacaaaacaacaacagcagacctccctgcccaaagtgttaaaatgcctccttcataacctgagacttactttcattttctaggtgctggagaatctggtaaaagcaccattgtgaagcagatgaggatcctgcatgttaatgggtttaatggagagtaagtgtcaaatctgtgcaggggggcaccaagtaagaggaacagactttatactaacctttaggaagtataggtgggctttgggggctgggcagccagttttcacttaatttttcctgatttacatattagaaaatcctgggaagggctctttagggtccctcaccccccacccccttggatctttggtgcaacaaatactactgatgaaagcaccagtgtttgtgacaaacatctccctatcccaagaaaatcgtgcctggttgcagggg

SEQ ID NO: 27518 - DNA, 1071 bp, Homo sapiens
tcgttctcgtgtaacaaaacgtgtaaaaaaaaaaaaagaaaaagaaaaaacaaaacaaaaaaactaagttgaccagtctgttttcactggtatgagagcattaaccgcactagatttcaagcacctgaaggcactagtttgtaattactagctggttggcacagtcctgttccctttcttaaacttggattcgattgaaaatttaaccttgagttgcttcagcttccatttcaaaaggggagttggagtcaaggtggtagcgtttaattataccaaccaccccccaaaaaaacaaacaaaacaaacaaaaaaacctttactagtcactaagcatccaggaaacaaaggtgaactttttcacctttcagagcaaggcaggcagctccttatagagaattctagaatttgttagatcaaataattgtttagagaaggatgacatcacccatacgaatagtcctgttagttgaggatgctttttctactttaaccctgaattcagaaggattggttgggatgcacagggggcttcttcactcatctgattatgactctcaatgggttatcaacatgcacatacgtgctattgagtaagtcagcatcacttgtcaccaaccaattccgaaattaattcttgacacacccctcgataaagccctgccagcggagactgccatcctgacaataaataaataaccctgagacagacttccaaccatgaatctgtcatttgaagaaaaatcttgcataaattttccccctgcaacttgcaggagtacttacttattcatgagagtagttaagcaaaaataatttgaccatgtatcctctagataaatattttgatgaaaactggacatggctagcatttttcaaagatgcagcagccactgtttaccttagcttgagtcggatggaagctaagtcacctttgaaataaattactgacagcttcattacagattgccctaaaatttaaaaatttttatagaaaggattctcctccctaagcgagccagcctgtaacaccaggcaagggttttaaaccagaacttctcttttctgttttct

SEQ ID NO: 27519 - DNA, 2132 bp, Homo sapiens
cgcacacacagccacacgcgccgcgcacacacacacgcatgccaggtaaccactctagctctgctgtgtatttagcatgcagtggtggagtggctatttctcatgagaccatccagaaccattgacttagtttagggcatctcaaagaaacagcttctgtggccggggaggggaggggcaaagatattggggtctggggacaaagtaactgacacatgtttgttcatctgtttcttttagaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatgaactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaatccctgtatctcgcgtctgtcttctgtcttccttcctttgtctgtcttttcccaccaaagcacaaggattaaggtggagacctgaatagcttcccccaccacttagttagctgaagcggggggaggggaggagctcttaaaaactgaacgcatcccatctgctgtatacatagaagggggaggaggaggaaccaagaccctaaaagtacttccagccttagtcccaattttgtagcgaatcagaattctagctaatggcatatgttttgcctttgttgagtagtttaaagacatctaaggaattttctctgaatttcacaatcaacgttaaattcattaagcaatagtaaaagtgatgataaacccgccaacccccagtataatatctccatctacatagtaattgcttcaatggaagaattttatgttttagtattacacacccgaattagattttagatttctattttagctgttttatacttgatatactcccacacctattcacatacgtagatgaatactgaacacgttctcaaaatatccgtattttaagacgggaagttttccaattatcatactactgcttagaccaaaatatcaaactgaatgaaagaaacttgtttctggaaatactttctcttgctgtatgcagatttggatatttagtacccgaatgtatttaattttactattgtggaacctcaaaaccaaaggttaatagctttcattacctgtgaagtggagcctgcttttaatgaatgggaatagatttgccctagggggttttgggtaaattctgaattcaaaagtgaacattggggaccatcaaacacatgtccttttaatttataacatctaaataatcgatgttagactgtaataccaaggccggggattcttaatttcagaaatgagctttgattctgcacatacaaagcagacagtcgcacagagcggtcaggactcactccctttcactctaaggtggttgctttaagagtctgggggccagaatcagatttcagatttgtacacaaggcctgaagctcgctcacctccctgtcatctgtgtttctgagattctccggacctgcagcacttttacttaaatggccctgaggggattcctggcaacatctgtcccccctccccaccccagacaccccccaccactaatgagcgtggcccctctgaacttccccagctcttcacccaatgtagaagagcagtggtgcagtgacctgtgaaaggggcttcacgtaggaagggggcgagatgggatccttcagcaggtgaaggcccagaagtacacagacatttattcagaaagaataaatttgtaagtataattctttgagaaaggaaagaccaaatgatttgtggaaggcctgtcgacaggcccgcacttgaccccaccgtccgtcccc

SEQ ID NO: 27520 - DNA, 1050 bp, Homo sapiens
ttgttgatgattcctttcttagaagccaaccagttaccccactggcagaaagttctaatctgattcaattgtttatttataaagtccttaattgcattttttttcttttagtgcagcgacattattttacataaacatttaaagcctgttagagcaaaatgatgatgagtttcatagtattcctaattagtaggaagtaattaattgaattgaccctaagcatttagggaaatagggctgtgctcacattttgaataatgtaaaaatactatattttattgctgtaattttaaaacataacaaagaggaatggtgaagacatagctacgcctcctctctccttggtagttgttgattgatctatttctgctctcaggtaagcgactctagtagctgcctagtgttactagatcctagtgactctaggtagagtttgtttttgtgttgtcttgacttttgaactctatttcatatccttatttattccttctcaccgggtcttgattcaaggatggtaagtggtcaatggattttaaatcctaaactgtacacctaagcagtacaataccgtggtggggttattttcaaataaaacaaattactacctgcgaggaggacaggttaaggcctgcagtagcaatgggaaaagcatctttctccaaagtcactcataaaggtgggctcacctggttggtgtgttggcaaatgaagaagggggaacttaaaacacagactttattgcacaactctacctgatgcccaggctgcttcccttgctgcctaacacctgacttaccattgcctcagggatcgccctctgtccctgtcacccaccatggtctctcccagaggacatcgtacccgatagctagaaagttgcctttgaaatagtttatggcttccctcatcttgcacatgatatagcaagcatgtggtggtcagggttatttaaaaaatatgtaaacattattattatttttttgaaacggagtctcactctgtcacccaggctggagtgcagtggtgcgaccttggctcactgcaacctct

SEQ ID NO: 27521 - DNA, 1118 bp, Homo sapiens
cccgtggctcaaacagccctgcatctgccgtggccggcacgtttctggttgaactgcctttatgttaaagttcagatactggtagtgtgcccatttcttaagctgtctatttttatttgttgagctggggtttggctggctccactccagatgtctctctcacaagatttggtgctgatgatctatttatagaactgtggttctgttgccatggtaacatgctggaggccagggcggctggggagctatttctggactggtgctgtaatgtaagattgattgggcaagttagtatatcctctaagccagactaactctgaactagtaaaaaggaagaggggaacagaaaacttaggcagtttctttaaataaacttttctctctttatgattttcttttctcgttagcccgctttaaaacaattccaatctctacatgcccctccctccaaaaaataactggttttaacattaattttccatattaattaccccaatctttcaaaagtaaattttcctgtgtgtctagtcaagcaacacaaacaagatgctttttttaatgaaaagcgtaatatctggagtgttctatttcatggaccaaacagaacggaagagaactttgtgtttgtttcctgttcaggatggctagggcgagaagggcccctttgtgccaacctcttttgttctctttaatcaatgagattcttaaaaagtaaaaaggaagggatacagattctcagtaactaaaacaatctcgtgtgcccttgaggggaaagtccttgatgtttttaagaatgtcactttattgttttttaactgaatgatatagaggtatacaattttcaaactgtttgccattttaatcaagcaatttgaaaattaaaatgtttttgtcaggcattaccaaatggcacagaatgtgataggccagcctggttttggggtcctttctctactggttgatatgcataaaaccttctaaaaatcaagaatattgccagagagcaacaggaataaagaagctaagtaaagaataaaaaagaaaaatagaaaaaataaaaataaacacgaagaacaaagccccaccaccgtgctgtgctgtttgtgtggccccactgc

SEQ ID NO: 27522 - DNA, 1073 bp, Homo sapiens
ggatctataagagaagcaagaaaaacgcactcccactaattctcatatggaaaaatcagggttttgaagacttcaggagctacagagatgctagcaccccagctctgcttgaattttaaattacattaatatgtattccctttttatatagctactcccgagcccggagaggacccacgcgtgacccgggccaagtacttcattcgagatgagtttctggtgagtcgagcctgtctttagtttcctctcttgttcctcctctttttctcatggatgtaaatttacttaattccaaattcaggggttcagctacccagttccatggttttagttcacgcacatccagtgtggatttgagctctttgcgcccctctttttgcttttgttttcatatgacatcagaggctggctgacagccgtccctggtaggtgtccccatcagggatagggtggttcctggcgagggtgtcactgacaagtccccttgtttgtgcccgcagaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaatgatgggactcccgtgagttatttgtggttctgagcaaattcccgtcattcatggttttgact

SEQ ID NO: 27523 - DNA, 1075 bp, Homo sapiens
ttgcccaagtttgtgcagtcagacctagaccccactgatgggagattggggagtctcatgtttggggaattttaatcatgatcctaatttggcccactgacaccagtgggctctcatggatgaggggggtggaccagacgttcatttcatgtttattctgtgactctgcttggaagaggtacagaaagttaggaaaggtgttaggagggtggcaagaactggattttaaaagatagttggtgacccaaattctgttcgcctgatgccatgttacatagtgggaggtaggaagatgtgtaaggaggccaccgtgatgttcagtctggatggtggaaactaagagctgcagacatgcaaatagatgagtcctgctacagattgcaaatggggagtggtgagaggtcagaacggacaggggaagtgggaagggcacgctcttgctagagctggggcgttttttcctgaaggagatgggaatctttaagcaggagagagacgtcagttttgtggcttacaaagatcactgtggccacggtgtgaaagatgattgaaaggaaggaataagactgagacttcaggggaatgttgctactgcaagcatacaaaaaataaggaagagcagaggcaaatgtggaaagaaggaccaccttggatagacagatgggagatggaactgatgagtctttgtgacaggatgtgggggtggggtgagggagagaagctgaggatgattttcaggtttggggggtaacaagtagatatatgaaggatacctttacggaaatatgggttgtaggaagaagatctgtttctagggaagagatgtcagttttggacctaaagagtttggatacttgtgagacatctgactggaaatgagaatggaatgttggatacctgagtctggagcttaagagaggaaagacggagagagagatccaggctaattctagattggtgagcaggtagatagcatgacccaagaggtggtggaagaggcaggtaggtgagtgcccagggtggaagcccaagagaacagacaacgtgggaatgaagctcggggtgaagtccggcc

SEQ ID NO: 27524 - DNA, 1028 bp, Homo sapiens
aatttaagaaactatactttcccccatggaatggtcttatacccttgatgaaactcaggtgaccatagatgggtggatttatttctagacacacaattacattctattggtctagaggtctatcattatgctagtaccacataatttcaataatgtaggtttgtcgtaaattttgaatttgggaagtatgagttctccaactttattcattagagttttttggttatgctgggtctcttccattttcatatgatttttagggttagcttttccatttctgcaagaagaccattaggattttgatatggattgtattgtatctgtagtctatttcagggagtattgccattttaacatatcaaatcttccaatccatgaccatgggattacctttccacttatttaggccatctttaatttcttgcaacaatgttttgtagttttcagtcttatacctcccttggttaaatttattcctaagaattttaatctttttgatgctattgtaaaggacattgttttcttaatttcatttttgtattgttaatttctattatatagaaatacaactgatttttctgttgatcttgtatcttgcaactttgctgaatttgtattagcttctaatgattttcttgactctgtaggattgcttagacataagatcaaatcacctgtaaggagaaatagtttcgtttctcccattcccacttggaaatctttttctttttcttgcatcatttctagatctagctacaacttctagtacaatattgaatacaagcagtgaaagcaggcatccctgtcttattcctggtcttggcagggcaggggggcttttagtatttccccattgagtattatgtaagctatagggcttcatacgtactctttatcatgttttggaattttccttctacttccagttttttgagtgttattataaaagggtattggattttgtcaaatgctttttgtgcatcaactaagaatatttctttttcttccctcattctattgatatggta

SEQ ID NO: 27525 - DNA, 1047 bp, Homo sapiens
ttttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtg

SEQ ID NO: 27526 - DNA, 1029 bp, Homo sapiens
taatcacatgtgtattttctatcatttttccccttttgcacttcaatgtgggtatttttctattctatcatccagctcatgagtcctctttttagttctatctaatgtgctgttagacttgtctattgagtatgtaatttcagttactttatttttgagtttttggatgtccagtttcaatttgagactctaattctctactagaactccccattttattatttattttcttgtatatgttaaccatagttctttaaaaatccataccttatgactgtaatgtatggatcatctatggatatgcttctgttgtctgctttttctctgtgtcttatttcatggtatacatgctaatttttgaactttttcttgaatgatggtgcagagcctctctacggtattacagtcttacagagaagaattttattttatttgagtttatatcaggcagttatatcaggggaagaccactcaggctaatcagaatttggttgatcacttcaggactgggtttctactctgtaagacagggtcttttttcttctatttgccgcttttcccaggtatacctctgaacttcactttttcttttttagccctgtaagactgctgaaagccatgcttagtttctccgacatctagaactgtttgtgcttgtctttctaaccttttgctagtccccacttacgcattggcaaatatctcaaggggaaaaccagagtagaaatgctgggcttgtgtctcaatgcttgccttccctccaagatcttggacctatgtgtcctggtagccatcatgtccttgaatataaccttcatctcccatctctataaactgccaaaagctctgctcagctcccacttcatgcttggctttctgctcaggttctcagccttttgcccacataacttgcaaactaaataaacctcaaagtgaaagcaatggagaatactcgtctcatctaaatatgttttctttttctccgggatcttggactatctgtcttcgtttggtagacctttctccaac

SEQ ID NO: 27527 - DNA, 1037 bp, Homo sapiens
tttgtttgtatttctgtggggtcagtagtgatatcccctttatcattttctattgtgtctatttgattcttctctcttttcttctttattaatctagctagtggtctattttattaatttttttcaaaaaaaaactggattagctattttcctgaagggtttttcatgtatctatctcatacagttccactctgattttggttatttcttgtcttctgctagctttggggtttgttcgttcttggttctctagttcttttagttgtgatgtcagaatgtcgatttgagatctacttttttgatgtgggcgtttagtgatatcaatttccctcttaacactgctttagctgtgtctcagattctggtatcttgtctctttcttctcattggtttcaaataacttcttgattttggccttaatttaattatttatgcaggaatcatttaggagcaggttgttcaatttccatgtagttgtgtggttttgagtgaatttcttaatcttgagttctaatttgattgtgttgtggtctgatggactgtcatgatttcagttcttttgcatttgctgaggggtgttttacttccaattatgtgatcaattttagagtgacatgtggtgccaagaagaatgtacattctattgttttggggtggagggttctgtagaaatctatcaggtccacttgatccagagttgagttcaagtcctgaacatctttgttaattttctgtctcagtgatctggctaatattgacattggggtgttcaagtctcccacaattattatgtgggagtataagtctctttgtaggtctctaagaacatgttttatgaatctggatactcctttattgggtgcatatatatttagaatagttagctcttcttgtttaattgagccctttaccattatgtaattcccttctttgtcttttttgatctttgttgttttaaagtctgttttgtcagaaactagaattgcaacctctgcttttttctgctttccatttgcttggtaaatttttccccgtct

SEQ ID NO: 27528 - DNA, 1101 bp, Homo sapiens
tccatgcaatgacaaaaggtggccttcagcagctccaggcacacagcctcccagctcagcaccctcaccagagaaagcacagatccagcaaacaattagaggatggcttcatttaattgcattaggttatgtgaccatctctgcactcattcccatgattagatgtgaaaactattcttagaactagcctgtgggtctgcaccatccttaccacatggtctgagagtagggaaggggtgaggtccccaaacaaaatgatgacagcacacctggaagaaggggaatgcttgctgggcagtgaagaggtgtctttcacattaaggctgagaaatggaaaattaatcggtgatccaagtgaggctcaagaggaaattctccctactgcctattcaattggaattcccctgaggttggtgctcaatgaaactttgttaaatatgttaaatgaaataattgttcaagaaagcagaagatagcaaactgtcatctgtaaggcaaaattgcaaactactggagatcggtacagtggctgactcccttccacctgactggtttgaaaatcaaatgatttgacacatgggctccttggagagatgaggcgccacagcgtttgggcagagttaggcaaggttcccacaagatctgctgcaacccaacactgaaaacccagaatgatccagccttgctccccgtcctgatgtctgccggcactgctgggcagaggaagggctcctgtgttataggcagctcccccacaggcccctgggttgtcctgacaaaggagaggatggcaccagtcgcagaagctgcctgccaactctcacagttgttctgggcagataactccgtcctgacaagcctgacttgccctagagtctctccaaagcaagggctgtggctgcaggagggagggacatggctgctctggacaccctcagggtattgttcttacgtgatctgtggacaagcagatttggtcctttaaactctgcctttacctgtgggctgctatttcccatccacaacccttcttcaccactgtggttccacttaggtgactgcagacctaaagccctactgggagcattgcattttccagct

SEQ ID NO: 27529 - DNA, 1031 bp, Homo sapiens
attgctctgaggagttttacaaaggtgacccagaccctcagccacagtaaaccaggctttcaagccttcctcccccaccgcctttccacccacaatgaccactcaaacacggagcttggaatcctttgaaatgcctggtggagctggctctgtccctgatgggtatggctggtgtgaggaactggggacatcagggagaacgcagaactgaacttgaattactcacatcacacatgagctgaaacccccagaagtttaacaggacattattcattataatttatggaaatatattagagaatttcccaatgtaactgaaaaggtctaaatgatattcaaaggagaatatttaatgacatgttagaaggtactacatttgagagctgtttgttaaagtgctcccaattttgacaaacgtttgtagaagtgtttttttttttaaatcctgagggaacagaagtaataatgtgggtaaaaactttgagtaatatttacaaatgacactgggaaaaataagaaagcatctgacgtattttctcttgtttgcataataaaatcagacatcactggcttatgtacataattatcaggactcatctttataaaaccaataaggaatgttaaatcaagaatttttgttagaattttaagttaaacagatggtaaagacttactagtgccgattcatctaataaaaaaaaatctcaggataacttcatctaatttcataaaatcaaagcaaatagagtaagtgctttaccattttcttttgagaatatatacgtgtatatgaatatatatgtgtgtgtatatgaatatatgtgtatatatgtatgtgtgtgtgtatattgcattaagtacatttacaatgctgtgaaaacataatcgctacccacttccagaacttccttatcatcctaaacagaggttctgtacccactaaacaataacccccattttctccctctcctcagccactgattatctctattctcgcttctgtctctgtgaatttgccaattttagttacc

SEQ ID NO: 27530 - DNA, 1065 bp, Homo sapiens
gcaaagctgcttttgtaactggaaattttactatggcaaacagtccagtctccttacgtgcataactcctggttcatggcaaattggttcatggtaaatttcacacaggcttctgtgccctagagggccttaatttattttaccagtcctattaacaatgtttacattgcttttatatttcactactaaacgaacactgcagtgagtatcccttggatttttatctctgcatacaagctaatatttatgcaagataaacctctagaattggaataattgctagattagaggaaatggccaattaaaaaagtgatagatcttactaactcttcctccaacataatagtaaccatttattatttattatttttatttttttaaagacgaggtctcactctgttgcccaggctggcgtgcagtggcgtgatcacaggtcactgccgcctggaactcccaggttcaagcgatcctcccaccttggcctccccagtagctacaactacaggtccatgccacgccaccgtgccaggctaatttttattttcggtagacacggtgtctcactatgttgctcaggctggtctcaaactcctggacttaagtaaccctcccacctcggcctcccaaagtgctgggattacagatgtcagccactgtgcctggcccatttattctttagatgaccgagttgggcattcagctcatccagggatgggtgtgtgtgtgtgtgtgctggggaaggggtgctggtatcggagcttctgaatcctgaaagtgtcggacggggctgaaccacagggttgagcgtcctgcctgggctgtgaagtttctcctacagatggcgctgttgcctcgcgcctgtcactcaggccgaggggcagagtggtaattctaagacaaaaagaaattaagcagcacgcaagcgggctgccgcatttttatgtttatgccgagacgacccaaatctatgtttcttcaccttcctggctgtacaactcagataactttgtgatccactcttcttcagaaggaagaaagaaaagattctatttgaccgtctttttt

SEQ ID NO: 27531 - DNA, 1036 bp, Homo sapiens
ccggactgtaactaccaggttcagaacatgcttggagttaggttttaaatgtaagtggtaagactgtcctctctgcccgtttgaaatgagcacaggccgtgttgcaggtctctgattcggagtaaagatgagcctggcttcctctgcggaggaggccagaagcaggtgcggagggcttagcagaggcctttgcactcagagacttgcatctcctgcatctttttaggcctggaaggcacccgcatgctcctctcggcgcaaaggttccaggaggtggtgaccttgatgaatctcagtcaagattatgaataatttaggagtaacacaacccagccagagaatgctttcccagacagcagacaggctgccgttcttccaggcgtccctaaatgggcatcagatataggaagactggtgggcacagcagcggagggcttttttcttggcattattaaaagctgacgtgcttctttgtgtgagttgcttgttccactgacatagaattgttttgttgtcactgtagctttagtgtacacataagcaaagcaagctctttaggtaccgtgaaaaagcgatggtggatatttctgtgtgtcttgagcataaattgtaagaaaaccaaacagattttaaagggtttgggggggatggcggggagatctgggtgtttgcagaagaagggactgtggctgggggttctgaacaggcactgccatatgtcccaggccacgtttagtgcacagtgattatggcaaaggtgggaacttgaaggggtgacctggtagcattatgctagaacctgagtggcagtggtcctgggctggacacaggagcctggccctagtgaaggatcttgggcagcggtcagggagcaaaggccttggggtcatggccagaggtcaagagctaagtggtatctgggagccaagaggtcaaggcaaagggcctcctgccagtgtttaatgttggccagaagcaaactcaaggcttgggaggcaggtcagcaaagcaggaaggaatgggccggggaggaccc

SEQ ID NO: 27532 - DNA, 1082 bp, Homo sapiens
gactgagatttcttggtttataaaatgggggtaataaaggtacctgctttgttaagttgtttggcaggttaacagagttaacctatgtcaagtccttaaaagtgcctggcgcctgacattcactcaagaaaagttagacgattatcattgtcctaagagtcttagttttccttctagtatttttgccttaaaattcatctggagtttgtacataaggtatggatttaatgtaattgtttccctatgactagcttactgccccagcatcaggtattgaacgatccatgtattcaccacagttttcaaggctacttctattccatatcagggttccagatatcaatttctgtgctaccctgttccaaggtcctaatttttttatccccaggacaaaaatgcatgtttaatttcatatagacttaatagccgataaccgagtggtcagtactcccttgtacatttttctccaaaactgtcttaatcattcttcatgtaacttacctatgtggattacaggagctgctcgtcaacttccctgaaaaccccgagaccaacactcaaccactgaactctctctcctagacacaccacattaggacatttgtttacctgccattttgtttgtttaataaggttttatttcggaaaatgctcagtttgatgaacttttgtatgtgtcttcactggcaccagggacaggtcttttctgtgtcggtggctcaggtgtcttgggctgtgttatgagagtagcttgactggtccttttcacagggttcctggagctcactggaaccagagaacttcaaaactcaggtactcagagataatccttgcatttctgagcatgctggggacttcctcacaggacaggctgtctgtggctttggtgacaagatcaggctgttgggtaagctctttctgggcttgccccaacgtgtctgccgaatttctggcatgtttctgcttttcatcttctcatcttcctcttttttggtgacattacagctctgattttaactgcatttaggtggatagattctatctcaaaatttctgtcttctaactttagtattttaccaatt

SEQ ID NO: 27533 - DNA, 1022 bp, Homo sapiens
ttcgtgattacctaatcacatcttttaaccatctttttattgaggtgcttctcactttcttatttagaagatctctttgggtattaataatattatgcacatataatgcagatagtttctccaagttattacttcccatttgaccctgcaatcactcatactcatggattctattttggtgcaagccgccagtagggatccaactttgttttattataaatgatctcacatctgttgaattaaccacttcgtgttaattttaaaaataattttactattattttaactgacatattataattatatacagttgtggagtacaatttgatgtttgggtatacgtatacaacataggctgattcaatcaaccaaattaacatacccgtcaccttgtgccattcatttttaatgtcattcttatcacacacaattcatgggtttgcttctaagttttgaatctgtcctggtgatatttgtgattatttctggataataagagactattttaacttactgttcatattttgttaagacaatccacctctgcgcttcccctccctccctttctccttctcttgttttatccctccttccctttctctctctctctctcataactttttggctgactttatccactttttcatcttgaaaaactttaaaatcatattgttaagattcaaaaagccttacataagaactttcattggaatttcactaaatttaaagtttgatatttttacgacatcagaccttctcacttaagactatgatgccctctccatttcttcattgtcttttatatttctcagtacagtgctataatatttttatgaagtcctgtacgtttctttttgagattagcctgaggtatgttacgtttttgtggccattatccctggaatctttattttatttttttaactggttattgtgggtaaagacacgcattgattttctatttattaataggtgatttaatgagcccttgttacgtatctcagtagctcttctgttttcca

SEQ ID NO: 27534 - DNA, 1044 bp, Homo sapiens
atgggtgaaccttaaaacatcatgctaaaagaaagaagccagacaaaaaaggccatatactatgtgattcctttcatatgaaatgtccaggatagggcagtctgtagagacagaaagcagattagtggttgacaaagagctggggaaagtggaaatggagaatgactgctgatagctatgagcttccattttagaatggcgaaagcatcctaaaattagatgatgaggatgcttacacaactgtgtcaatataacagaaagtattaaaatgtttattttgaacaagtaaatgcttatgttgtgtaaatgaaatcttaaagccattagtatagctgatgatgaatacttgtccttcagtgtccatttgtgcacatagagtgccatgttcacttttatatagaatgcatgcatttatgtatattgtatacaatgtaggcatttgtaggcatggtctttttgttttcacttgcatggactactgaatctgagggcaggacctttgtgtgcttagaaactcttgattgatctgtgggtcccacccacagatggaggccaattttaacttgtcaactgctcagaagcaagacagaaaattatcaaagagacttgcaccatgaatacttactcaggatagattaagacagtggctcccagatgctaatctgtggattggtagcatttttagtgatgaagtgtctaaaaattagaaccaagtgattaatagtattgtctcaatatgaatttattagttttgacagccatactatgattatgtaagatgtcatcattacaggaagccaggtaaaggatatatagaaactctctatttttgcaacttttctgtaaatatactttttttctacaataaaagtttacttacacaatctactaccccccaaaaaatccaaaaacccaaactaacaacagtgacaaaataaagacaaagacagaaagaccttggcagtaacttaaaataaaaaactctcttctattctaaaatgatcatcttgatattggtaacgttaaatgttccttttatggaga

SEQ ID NO: 27535 - DNA, 1048 bp, Homo sapiens
ggctaattttttatatttttagtagagatgggatttcaccatgttggccaggctggtcttcaactcctgacctcaagtgatccacctgcctcagcctcccaaagtgctgggattacaggcatgagccatcgtgcccagccagtgtttattttttaatatgtcattggactgtcatattggattgaaatcttgacaaaggagtataaaagaactaacatattagaaacatatcattgttgataggcacttaaaacgaatagacattgtacctccaatagaaatgcaagtccatggaaaattgctacttgggccaggtgccgtggctcatgcctgtaatcccagcactttgggaggccgaggcaggtggatcacgaggtcaggagtttgagaccagccttgccaacacggtgaaaccctgtctctagtaaaactacaaaaaaaaagttagctggatgtggtggtgcatgcctgtaatcccagctacttgagaggctaaggcaggagaatcgcttgaacccaggaggtggaggctgtagtgggcccgggactgcagcactgcactccagcctgggcaacggagcaaaactctgtatcaaaaaaataagtaaataaataaataaataattgctagtcgatgtccctacattttgcactaccctccatatctccagaaacaatcatttgcataaagtagggtccttatcatgagtgaccccttgctccagagagagatactgctcagcaattcttaatccaaactggcccaacctctctctcatggagggtccagagagggaagggtgaacaaatcttgcagatattttgcaactgaatagctctgtgatctgtatgtgatctaataaacttggtggtttatcagaatcatttccgtgacagaatctagaatgctggatttaatgacaaccatgatagggacacagcactgatttcttttagagacaggttccacaatgccccttgagggctggctagtaatgacatgcagaatcggtttctctctgttggaagggagaagcctggaacacca

SEQ ID NO: 27536 - DNA, 1024 bp, Homo sapiens
ggagagaggttctatatgcatttttttctgtgtgcatttccttaatgggtaatcatttgatgagagattttaatgtgtgtggaggcagagatttaagatctggaatgtctgagtactttctatcccattcattcatgaaggtctgcagcagcgtcttcagtttgcacagcatattgagtcccacctacctgataacttcctggacagaactgggttatatcaaaacattatgtgaagtaattaaaaagcagtgcttctcaaagaagatgccagggtctgtttctgcagccagctccctcctccctaccctgtgatgggcacagaagaggtcagttcacatctaactagagcagacttcaagaagcttgctgtggtgggactccccagtggatggtaaaatgataaccagataagagtgatctttgagcaacaaaggaaatagacagacccaggctctttctaagcatacgaggcacagaacttacacttgtcggtgctgatggaagggccatttcaagatggcgccctctccttgcctaatgggacctacagcccaatgatgccttgtatttttaagtagagggaaaactctctatagggatatctcctgaactgcagtgtgtcaatatgcttctgatttgagtgtgttcctgtagatcactgtgtagacataatcattaggcaggcactctatatactgaagaattcaactcttccccagatttttcttttaccttttgccattatcgttctcaatgagagatgtgctgggagatctgtaaaaaatggggtgtcaatgccccaacgtggctcctggtcattggtgtggccatgggtggtgcaagaggccgccggttgttcatctttccatgatccctcatgtctccgcaatgcatacacccggagtccccccaagacaaagggaggtttcttgtcttgctccacaacatgaccgtgacttatctaccatgagtaggtaagtcctttggagggattctagtaggggaaaaatacaatatttctc

SEQ ID NO: 27537 - DNA, 1050 bp, Homo sapiens
cctgctgacttgcttcttgggtgactccatggttttttgcctcagtctaattatgctcaacagtggcacacgtcagtaaaaaccccatctggctctcacatcacaaaagactgtatacgccttgaaacttaatctgtgctgagctgagcacatgctgctaaatcacaggcccccgaagagtcaaggtgacatggcaggcagagggaagaccagccgtcagaaccctcagcaccacggggctacatttcacctttagttgggaggaaactgaaggcatgctttctggtttatctggatgttcagaggaaatgagggaggtctggaaacacacattgagaccaaccctgtgccaggcactgtgtaagaagcacttcccccggaaggcattattgcccagcaatttacacttcatttctgtttgatttagttgatgaccctgtgaaatagaccacaagtcacagattcactgtctaagaatctgcaggccttgtaagcccccaaaatgcttcatgggacaatgttagtcacatgtcgaactggcgctcccaacttcagaacctccctgtgcctttcctgacctcataaaagatttccaggggagagaaaaccccaggcaggacaagaagtttgtggaagcctggattccagaatagagataaatctgatgtcaaaaaaggtgttttaaatttttttcagtgagcaggtgggtaggtgggtacagacatgcccttactttctgagtaaatgctttttgagaatctgtgatgcctgattcctgagctgaacattagagaaacagtgctggtctacataaggggaaatatatttctaaaagtgtggaatcgttctcatttataaaatgcttatatttgatagttcaggatttttgctttttagggtttcactaaaatttaaggttaccaaggattagaattctagttagcacataattctatattcaaaatgtgccaaaagatgtgttattagtgagagaaaaaataattttgtgtaatttagaagttatctgaaagttaattcaaattatggact

SEQ ID NO: 27538 - DNA, 1054 bp, Homo sapiens
ggtgctttgcaaagcatgactttgcatatctattctaattttatctttgcaataacctgtgggatggaaaacacttccacccatttcacagatgtaaaaaatgaggcccagcaggggtaagatgctctcaatcacacagtgtcaaagtttcagcctctgggagtgcttgttcctccttgtgttggtctgaaatctgatttcccaaacttctgcccacagtccaggcttcctacttgctcagcacatgcctgacctatcctgggggacagacctttaggtggccaaagatggcactcacttccctgcagcagtttccttccatcattgccacatccttcaagcatccttcatgcatctttcccacagcctggctttgagtctctccaacattttattttaaatctacctccagctgattgatatcactctgcaaaatttagtatttagaacctcatgccacaccacgacctggttttaaaacacctgaattaagtttacaatgatcaactgtattaactctgtcgctagggttctcttattgcaagctaagtttgtgccagcattgtcagcagccaataatagcatgaacttacacggagatccttgtgcattcattgggtcacagagcgctgttgggtacctcctacacaccaggtcttggtctctaggatataatggtgagcagcagaaaattcagatgcagagcagtagggagggcagaaaggaaggaaacaatcaaactagtgcgtgtcaggttgccactctgtgtgtgctgtaaagggaaggacgtggtgcgctcatcgtgtaaacaggcaggcctggcgtggtttgaatggggatggtgagaagacactcccctaaggaagtggcatttaatctgataggtaacgaatgagaataaagtgggtgaagtggtcaggtggggtggctcacacctgtaatcctagcactttgggaggctggggcgggtggatagcttgagcccgggagtttcagaccagcctgggaaacatggtgaaatgctttctctactaaaattatgtaaaaccagctg

SEQ ID NO: 27539 - DNA, 1048 bp, Homo sapiens
ctgcactccagcctgggccacagagcgagactccggctcaaaaaaaaaaaaaaaaaaaaaaaaaaggaggctgagatgccaagtagcttgtcacatatcacatggctggaaagcagtggaggcaggcgtgcggtctggttctgcatcccagcttttagaaggtctgttgagcttgcatggagtaaaaaggtgctctgggacacctgctatcaggaagccaaaggcaaaactgcacagacatgctccttcaaccagcgcacacggcaaaactcaggccactttggctgctcttacttgttctctataaaatgtttgtactttataacagcggtccccgacctttttggcaccagggactggtttcttggaagacaattttttttttccatggaccagggcagggggatggtttgggatgattcaagcacattacatttattgtacactttatttctattattatattgtaatatatcaagaaatctacacagctcaccataatgtagaatcagtgggagccctgagcttgttgtcctttaactagacggtcttagctgggggcgattggagatggtaacagattgtcaggcattagattctcatagggagtgtgcaacctagatcccttgcacgtatagttcgcactctagttcatgctcctatgagaatctagtgctgctgttgttctggcagaaggtggagctcagttgggaatgtgagccatggggagtggctgtaaacacagatgaagcatggcccgctctcctgccactcacctcctgctgtgcagcccagtacccgtccgtggccctgcgattgagggcccccgctttataaagaaccttacacttacttcactgtaaacacaatttgaaattctcattcttttaaaatacttagttctcatactttaagatatgtaagtttgacaagtgatcaacttttgaaaaagcagcatttaggtgtttggaaataaatggcatgactgcaaggtgtttagccgatgctgtttcttagtgatgcctgtggaaatagctatgttagattg

SEQ ID NO: 27540 - DNA, 1028 bp, Homo sapiens
aggagaatcacatgaacctgcgaggcggaggttgcagtgagctgagatcacaccattgcactccagcctgggcgacagagtgagactctcttctcaaaataaataaaaggggttttaaaatttgttgtggggggcggggaggattggtaaaggctaggaaattcatttaaaaagaagacccaatgtttgtcatggcatcttcaacttccaccctcagggatggagggagatgtgcacttggccttttctagttggacaggtgtgcaggtgagggcaggactcctgggggctttaatcggccagggtttgcctggtgcacactgccaagaaggtgaaaagacgcaggatagggatctcctataggcggtaaagggatgggtcaggtgtaagtcatcacacgctcctaagccctgagcaaatcacccaggatccggtggagatgacattgtcatgacaattctgtccttccttctgccttccacgcaccaggtagaggggtagggcgactgtcagagttcactcatgacacagagcccctctgctgggtcaagcaggaagggattcaggaccgggaaacagatgcttacaggtcattgttgaaagtgctgaggaggggctctggctggctccgggttttctcgagcactgtgtagcaaacctgccaggacagcactgactaccacagccaggacagttcagaagcctggagatcaggagtctgccagtggagtcagcacacctgcttttcacctgtgatcccaggagaggaagcagctgcctctgaggcctcaggctcagtggcctatctttaccccaatgcatgcaggtcagaatgtagctgaacagcagcccagggtcctgccctgctgccagcgggaagaagaaaacagccaaagcaggaggtgatcttacctacccctccacctccacctcgggcccaatttgcatcctgagtccctgcacgggggcctgccagggggacttcacatgctcagctgatgcaggtggaggggaagggagaaggctgc

SEQ ID NO: 27541 - DNA, 1104 bp, Homo sapiens
attctgaaatgggcctcttgtgacctgtaattagacaaaataggtcagaaaatatttttgttgctagttcccagagaggcaggggaagattcctgctttggggagaaaaggaagcaagtgaaaggagggaaggggaagatcagagagacagattctgtttctaggcctgttcctgaggcctaaagcacacaaggtagtaagaaaggctatgggagttatgagccatgaatgaaaacctctctctctcgatgtatacatatatatacgtacacacacacacacatatgtatatatagttatcatatatgttttatatatctatagataacctaatatcaccacaggtctctcttgtatctactcaactactcaactctgccaccgtagcacaaaagcagccatagacaatcaatgaacaaatgggtgcggctgttttccaagacaacattatttacaagtcaggccgtaggatggggaggggctgcagaagggttgaagggtctgtctttgtccctttgggctgctataacaaaacactataacctgtgtggcttgtaaacaacgggagtttatttctcacagttctggagtctgccaagtccaagatcaaggcaccggcagattcagtgtctggaggccccactttctggctcatggatgatgttgcatgtgtccttgcatgggggaaggggagaactccagcctctgcagcccctcataaaggcacccattccattcagagggccccacccccatgactgaatcacctcccaaaggccccacctcctaacaccatcacactgaagatgaaggttcagtgtatgaatttcacaggaacatgagcattgagtccataagagagttttatttggagtgttggaagtgcctggaactagatagaggggtacactgggaatgtactaagtgccactgaattgctggctttaggatggttaatgttatatgaatttcacttcaataaattatttgtaaaaatcaggcaatagacccaatttggcccacaagccatagtttgctgaccccagcaagctatcccttgtcccaaactaagttagatgtagatatctgagagaagttagagat

SEQ ID NO: 27542 - DNA, 1050 bp, Homo sapiens
gtttatatcaggatgctgtttgtacttatttatttaacatctgatggtggcagccaacctgcccattagacagtattaataaaatgcacaatgttaacaaggtatacaggagacttttcgcttatccttatccacttaacccaacacagagcttttaatctgcattcaggtaaagcaagaggttaagaagaagcaagaagctgggcgtagtggctcatgtgtacaatttcagcactttgggaggctgaggctggaggatcacttgagggcaggagtttgagaccaacctgagcaacatagagagaccctgtctctataaaaaaatataaaaaatatataaaaaaaaagctggacatggtggtgtgcgcctgtagtacccagctacttgggaggctgaggcgggaggatcatttgagtccaggaggttgagggtgcagtgagctctgatcacaccactgcactccagcatgggtgagagaccaagatcttgtttcaaaaaaaaaaaaaaaaaaaagcaagaactcaagaactctgggatcagatggatccaggtttgaatcccagctcaggttcttattcactgctcggtttctgcaggtttcttaagctctcagagtgtttgcgttcgtgtctgaagtgagagtcatcttagagccatgtcctagagctgttctgaagattacaagtccaggtttaaccatattaatgatggtcattatcatgattattatatttatattcataacctaagtccaacagatatgggctaagagcccagttctgccttttactcactggtcaccttcatcccagcattctccaaggttgtttgggtgcaccccagatgttgcctccagccccctatctcccgtcagctctgaaatttctgcacaccctgggaatttacttccttacagtccacttcagggctgggtttctcttttccaaatctcacttgctcttgtctctctcttctgacttaaatgtaaaatcaggctcttgtcatctgattcacacacacatatacacactcactcactcacaaaacat

SEQ ID NO: 27543 - DNA, 1035 bp, Homo sapiens
atcagaagcccagggtgagaccagcaatccggctttcatggccagcaggggatcctgatgcatgctcaagtttgagaacaactgggatacacattccacattaccagcattcgtaatcttatttacggagggctctaaatttcctgctaactgaaccactctaaattagctgagaattaaaagaagaaggaatgctattacataaatgaaggctattcaaatctccacgccttgaggaacaacttgagccctggagggcagtggcaggggaggaagtattatagtaactggtggttacagagcagagattgaggccagtcctcctgggtcaagcgcatgcaccgctgcatccagctgcatgatcggggctaagttccttaatctctttgtatcttgtttccttcttccataaaattctcatctatagcgcctaccttatgcagctgttggagggttaaatcagttgagtgaagcatttagaagctttcctggccaagactaagcgctccttgttgttgttagtattatttatctgaattaattttcagttcttctcccatttttaacagatctcaacagtgctcttatcttcttccatagcaacacgtcaaaaaacaaatgcaccatcatcctttccgtttaaattaggaatgtgaccagatttaaggaacagacattcagtttaaacaaatgaaaagttatttttcttgcctcggaatctgaggcctggcagttgctgatgtcttttagtgactcattcatgtgactctcctctaagaccccttccttttagctctgcagagtcagaactgggtcactcgtgggtcagtaggcctggggtgggggatgagaatttaaatggccaacaagtctgcagggactgctgctgctgccagcctgcaggctccgcttaaaagccaatgccttgaatgcatcaggactcatcatctgagactgggaacattgtgccttgaagaaaatcaggatggtgttagcacgagtgaagggggacagatgtgaggtctcaacaggcag

SEQ ID NO: 27544 - DNA, 1035 bp, Homo sapiens
taggaatacttgtgttttttgcacattgattttgtatactgagactttgctgaagttgcttatcagcttaaggaggttttgggccgagacgatggggttttctaaatatacaatcatgtcatctgcaaacagagacaatatgacttcctgtcttcctatttgaataccctttattgctttctcttgcctgattgccctgcccagaacttccaatactatgttaaataggagtggtgagagaggggcatccttgtcctgcgccggttttcaaagggaatcattccagtttttgcccattcagtatgatattggctgtgggtttgtcataaatagctcttattattttgagatatgttccattgatacctagtttactgagaatttttagcatgaggagtgttgaattttatcgaagaccttttctgcatctattgagataatcatgtggtttttgttattggttctgtttatgtgatggattacatttattgatttgcatttgttgaacagctgtaaattctagtaagttctagtagagttgaatttgctcctgaccaagctttctgatgatcttacaagtcactactgtgatctgtagttggagggattatcatggaggaaatgtggatagttcaagctcattgccaattaatatggtttagatctgtgtccgtgcccaaatttcatgatgaattgtagtccccaatgttgcaggtagggcctggtgggaaatgattgaatcctgggggtggatttctccctttgtgctgttctcctgacagtgggtgagttctcatgagatcttgacatttaaaagtgtgtggcacctccctcgtccctcctcctgttacagtcatgtaaaggctgccgctcccttcaccctccaccatgatcgaaagtttcctgagacctccccaaaagccaagcagatgccagcattatgcttcttgtatagcttcctatgagccaattaaacctattttctttataaactactcagtctcaggtatttatagctgtgggaggatgggctaa

SEQ ID NO: 27545 - DNA, 1048 bp, Homo sapiens
gaaggctgaggtgggagaatcaattgagcccaggaattcgaggcacttgagcccaagaatttgagtgcagtgagctataagcatgccattgccctctagcctggacaagaccctgtctccgttttttaaaaagaatagagaaaaagaaaataagaggagtgatcttggctgaagatatacatatgagaatcatacaggtgtaagtaaaatggagaggagattacctagcctgaaagtaaaaacttcacctgtgaatggggtctccaatctctccttttctctccctctttcttctatgaatgcagcatttactgtctgggtcaaagaggatgtgtcctaaaaggagaatgagaaataaaacccagaaggagaaagaaaacgtggagaatattgctgattgcagccaagggaagagaatgtttccagaaggaggttaccactgcgaggtcaagtaagggactggagaatgcttctgtatcttggcaggtggggccattggagggagtagttgtgaccaggtgaagggctgaggggcagagcagagtagagtgaggagtaaatgtgagataagaaaatggatcaggggaatagtcttatatttcaagagatgacagctagattggacactcaagtaaaatgtgagaaattttttaaacagaaaatacttgagctatttaacattgatgaaaatgatccagttaaaatatgcaagcaagaaagggacatgaaaattgcagagtaaagacctctgaaaattccctcttccataaaaaaagaaacttgcagaaaagatcagaataagctttttcagaattcgagaaattaaccaaagcttgcagcaatgcaggaagggtttgttttttccccaagaaaagtggctgaatctcagtaagaagattgagctttgtggtattttaattttccattgtctcatctcccactctccaattccataatgatcttgaaaaatagcagctcacatccccagtgcaaactgaaagtcactagagaatgcagaggggagctagaactcttcaaagcctcattc

SEQ ID NO: 27546 - DNA, 1048 bp, Homo sapiens
agaaagtggcagcaacagctagctgcccactgtgtgtgccaatgatggagtaggaagctatgcaccacgttctcacagcctctgagtgctgttgctccttgagaagggaaggcccattctactctgtttctttctgcacagaattagatgtgtcagtgaattgctctgaggagtagattagtgtcagttccttgggtcagtgcagaagggcttgtgtaaaagaagaaaggataaatagccagctccccaccctgtctttgggaatgcactttcagaactctcaagtcagaaagcccatttcctggggaaaccaaactcaccacagacagttaatgctcaaccagatttcataaaccctgttgttttcatactctggaggctccagtatttttaagctggagggctcccccatgcatggactgcacgctgagagctgtgcttcacaccaattgctccataagcatcttgtggagaaaatctccatagcttgtgagagacaacctggagccaaacatcaatgcaatcccagtctggatgagataggacatcagtcaatgacgctgagtcacccaaggtcctctggaggctggagcacacaatgggaggctttttgaggttgatatagctggaggacccagctggaggctcccaaatgggacccttgcccccaggaaaaggtgttcttcagagcatggaagccatgagttagcaacaacgtggatcagatggggacagagagagcagagacactgcactgcgtgttttgaaatctcagtgagatagcctaattcaccacattcgattctgcaggaaatcaactcatttgacagaagaacaaagcatgcattgttcaagtataagaggcctgggctgcagggaacctgtcctgacaaggggataatcatcttagctctgagagaatgaacatcacacattttgttccagtgagatatgcacaagcattccaggtatattaaacccgtgacatctaatatggttggatgttattactgtggtgaatttccccaattattgccaaaatctgttc

SEQ ID NO: 27547 - DNA, 1031 bp, Homo sapiens
ccgtcccctgggttcaactgattctcctgcctcagcctcccaagtagctgggaccacaggtgtgtgctaccatgcctggctaatttttataatttttagtagagatggggtttcaccatgttggccagactggtgtcaaactcctgacctctagtgatctgcccgccttggcctcccaaaatgctgggattacaggcatgagccactgtatctgacttcaattttttattttttcaaatatttttatttttaattattaaggatacataatatgcacattaccctgataatttctgaaatattttgtaaggattaatatacaaaaatttattcaacaatatttattggggtgctaagaaatgctaggacccaggttagacctgggctatatgaagatgaaccaggcagacctattcttgccttcatgaactttttattttccagaagagatggacattaaactcataaccatttgcaggcatgattcataaaaaatgcacttgagtacttctgtatggtcatcttatgggaagaagccccagggaagagtttgttaagctgaattcttgaaagcatggaggactccctaggacattggttctagatatagaaaaataatgtttcctttttatagctctctttacccaaaatcatgtttcttcacttcaacattcagtaagttgtggaaagctcaaattttgagttaaaatttgcaccatcataagctcaaaacagctgtatcaaggagcataagcagggaccattttgcagaaaaccctggaggtttgttcctacttacatctcctttgtctcccgcagtggggtaggatttttgcatacattttcctcccctctgtcaggggacttaggcaatgtctggaaacatttttgattgtcacaattggaggtgaaagcatctaatgaatagagaccaggaatgcggctaaaaatcatacaattcccaggatagtaaccccaccctccagctccccacagagaaccaccaggccagaagtgtcagtaactctgcc

SEQ ID NO: 27548 - DNA, 1094 bp, Homo sapiens
ggttagggaccctgctgttcccagcctgcagggtgcaagacctaatgtctatcctattgttgccaaacatactttattcattcccacaacactcaatatttttccctctgattgtgtaactagttgatgctcattagtttaaaaattgcacaacatataaaaacaaagcaaaaacctcctgagtccccaataccctaatataacccctgccaaactttttggtgactgtatttttttcatgcaaatctttcaacatatcacactcacacattatttctatgtattaattaatactttcctccatctttgtttgagtgtgaaacagcatatttcatttaggaatccctccaagtcaatcaagtatagataaaatgttcaaaatattgttgcatactaatttttctgtgaatatagtttagcgacttttggccctttgatggacatttgcttcatgtccagttttttttttttttttttttttttggccaggcaatgatgccataatatatttttgtgtatatgtatccttatgtacccgttcattcttcacatacccaaagactacaggctcctatgcactgataagaaaggctgacgtttctttgcagcttatttcatgatggatacaccaccagagaaaggaggctatttgcaattccattgtcatcttgtcctgcaaggaattttgccccaattgcaccagggagcttctctggttctcagagctcagtgagttcttgcagacactcgagatcctggatcattctagtggatgtttgaggctttcagctgccatctcgtttactctgtgtgtgcctctcaatatcaaccctcccactagctgtttgcgggggaaccccaggaatgagtagctgatggatccattggagaataggccatagaagccctccagatccctcctggatgccgggcctcaatttacttctgatagtaattatctcctggaccatgactctcagatggctagacctctatgggaaacacattccaggctaaggagaggagtattcctgttttcaggcattcacatggtcagtgggcggaatgggggtagaaattgtgggcccttgttt

SEQ ID NO: 27549 - DNA, 1033 bp, Homo sapiens
acttttgatatacatttgggctgcatccatattttgtctattgccaataaaactgcgacaaacatttttgacatatttttagtgcacagaagtatgcatttctgctaagtatatccctgaaagttgaattgtttggtcatagatattcaagtattctgcttcgaaatccccaaagagattttcaaagtattgtaacatctattcacccaccagcagttcatgactgttcaagttgttccacaccctcaccaatattttgtattttctgtctttttatctttagccattttgttgagtctgcagtggcatcacattttggattgaatttgcatttctgtgacagggaatgctagcaattacctttccacacctgtgatggccatttggcctcctcgttggtgaagtggctgttcaggtcttctgtttcctgctgggacatctgttttgttttgttttgttttgtttttgttttttccttatcaatgtaggcattctctattatatactagatcaaaggctttttttggatacaggtattcaaaatatcttctcccacactgtagcttgcctttgcattgtaagatgtcttgtcaatttaagggcaactaattaatcactctttcttttgtgctcagcgccacttgtctcctgtttcagaatatttgcctaccccaaggtaatgaagatactctctgctttcttctaaaaggtttgctgtttgacatttcacatttagatctacaatccatgtggtcttgctttgtgtatggtgtctgttaagagtcaagatcccttgctcttcccctatagatgcttaaatgaccctctgccatttatccacagcagcatcatctcccctgtgtgccaccattgtcatactcctgtgatcgtgtctgtgcgggtcagcttctgcctcactgctccatctgttcacctctgctttagtgcacacctgcccccgaggaatagcctccagtagtcccgactgagagcctcttgtgcttgctatgtatctccctccttggcagaatat

SEQ ID NO: 27550 - DNA, 1069 bp, Homo sapiens
tggagcaacaggtgagtcaggcaagcatccattagatcttcaatcagctgctccacattgcaaatatgaaggatatgctttcaaaaaaggacaagggaaaataggaaaaggggtcgtaaaagtaaagataatcagccagcattactgaaagtgaagagaaaatttcttttgaaaaagcaacccagatgtttgtccggcatgagtgtggtatttgggatcatgaatgctgaagagtaagtgtgtcctggatgttggcgtcgggtcatcactgaccctaaatctcctcaagtctcacagaaggatgtaggtcatatgttagaggtaatatgtcataaggacataggtcatactttaaccttgaattcagggaataacatttggctttagggtaattgactccaacatagaatgagccacattctctatgcattgggataattcttatttatcattaactaaattattaataactaatgatataaattacataattactgtttattaaacaatttgtattgaatgttattaacatgtcaagcctgtgggtacagtggacacaattttcttgtgaatttcatctgaggattggcatctgttcccacagcgtgaaggtgtttttgctgtctgaactctgcgtctttggctcacccaaacagggagaagaacatgagccaggtcggccaaggaggcctttgcttatggtctggttttctataggggccagagatacgcccccatcccactcgccatccctagaccacagcagccttccccatgtcctgttgttggaccgaggcacgcctgtcttgggaacaaggacctcactatttgcaactttcttggagggccttcaggatctcagagctctgtgcctcagatcccgcaggtagtactgaagactggagcctgttccaacggggctggctccgtggccggccacacactggggcgcgagcctctgctgccctctgtgttgcccatgtcttcctatggctgaggctggcttagcctgaaattcaggaggttcctctctcaaggaagcctattagatactcagatgttcggattg

SEQ ID NO: 27551 - DNA, 1051 bp, Homo sapiens
cttgttttgcttcagcatgtagtcctgattgatgaactctcagtgttaaagaagggattacgaagaatcagcggagtagtttgttctctctccctgggtccaggttctctgttgacctgtaccatgactaccacatacgggaaacttcactgttcacagaaagtcatttccctggggtttttgctgggtcctaaatgtgttccagagtgctgcaggggggactccccaaagcacctgacatgcctgttttgctctttgatccgtgtggttcatagatcactcattgaggggattcaaaattaggggcttgggtgacagtcgccaactgtttggccaggtggacagtatcagcctgatggccagctggccagtgtacaccacctgtctctgtgctgtggtggtggcggcacctgtggggtttctagatcttttctcacgttctactcatttcccctgaagttctaaaattcatattgacgatcttgctgtatgtttgtgttacacatagcaccctgacaagctgaaccatcgccattacccggccctggtccaggttgatgcctgggctttccttatggcacacagctgctgtcagtctgtcattctgcaggtgctgctttccaaatcctgcatgcactctgtgtatctgagttacagagtagtctttttttttcccccacttaaaaatgacacagatacttctattgctcttaggatcagttacctaaacctgctcatagggcaagactttgtttgaactagttggttgtgtaaaaagcagacaagccccttatccatgcccctgcagtcacagtatgatcagcaggcaggcagtgctgtgtttgtctcccggacatgctgagtgagacaatcagtgagaaagtggcccgggtgcattcccgccagaggacactttccagacctctatgcagagtcgttccaacctgccctttgagagcttctcttgatctggttacaaggaatttttctacagtcaattttttttttcatttctattccgtaaaagcagtaagatgagatgcccagtctt

SEQ ID NO: 27552 - DNA, 1031 bp, Homo sapiens
gggaacacgggtcctgccggctcttgttgcctccctggccagacaacatctccccagcctgggtctcagttgcctcctccgggacctgtgcagtgcacagcctccgctgactgtcgccgtctccgtttcgcacaggccatggcgattacgcctaccagcagtcatcctacacggagcagagctacgaccggtccttcgaggagtccacgcagcactactatgaggggggtaaggagcacggctgcgtgctgggctcgagcgtaagcgccacacgcagcagagttaagacgctgcacccttaggagcacgcggtgcctgccttcagtgagtcccttaaatcacagcacagcgcgtgggaggagagacagtgtgttctggaagctggaaattcaggctgtgtcgggagccccgcttgccttatgggtgtgttcgtgagacaggaaaggattcagccggccatgctggggttgggggcacagacttggttattgggtccagccagggagcgtggggcctgcgacaggaaggattcagccggccatgctggggttggggacacagactctgttattgggtctggccagggatcgtggggcctgcgagccactctcagagcttcctcagctggaggccagcagtggctgcgctgggtgtggcctcgcgtttcttcagacacctgcaggccaggaaacgcacatctgtggctgggggcttgccgcccttcatggcggtcctgggcagtgctgcgctgggggctgcgtgtcgggtggacttgcccctttctgtggtgtctgtgcccccaccctggctgccctgaaaccccaacagaacatcccagaatgtggagttgggaagaggtacacacagcccgttccagtcccaccccgggataaagatggcccccagagaagagctgatgatcgcctgcgggattgcgcaacctcgtccgggagggaaggcgggcctgcagtccctggggagaggggcctcgtgtctgctgacgctgaccggcaggcagcagtggctgaggc

SEQ ID NO: 27553 - DNA, 1051 bp, Homo sapiens
tgaaccccggaggcagagcttgcagtgagccgagattgtgccactgcactccagcctgggtgacagagcgagactccatctcgaaaagaaaagaaagaaccctggagtacttgctggttgtggaggaaggccccacatctgcccgccccgttgctgtcctgttgagagcacggcctgggctcccccgagccctgcagatttcatgcaacacatctgaaaacggcaaaggccttttccacagatgtcgtgccccctttccctgcagttatctcagcagccccctttctttggggatagggcggctgctgccagttcccactagatcgcctgagcacccactggggtgtgagagccaggcctggtccctgtgtgctggggctgggtgttctgagctggcactctcacagttgttgcatacctgctgggtgccagggcaaagctggcccgtttcctacaaactggctcctttattttttttttttgtttatgtttttttgagatggagtctcactctatcgcccaggctggagtgcagtgatgcgatctcggctcactgcaacctcctcctcctgggttcacaccattctcctgcctcagcctcccgagtagctgggactacaggctcccgccaccatgccgggctaaattttttgtatttttagtagagacggggtttcaccatgttagccaggatgatctcgatctcctgaccttgtgatccacccgcctcggcctcccaaagtgctgggattacaggcgtgagccaccgcacccggccacaaactggctcctttattatgtaaagaataaagtgggctataaaacatgagaatatgcaggctgacccccaaaagcctgacacccttgaaaacccactcccccatgtctcagatggctttcatgggggcaggagaaaggatagtgaccttaagtcttctcccgtgacggtgacagctcgtttgccagctgttgctggaaccggccctggatttagaggaaggcgtggaagttcaagactcaagatacttcctggatagagaataactggaaa

SEQ ID NO: 27554 - DNA, 1024 bp, Homo sapiens
aaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggatt

SEQ ID NO: 27555 - DNA, 1263 bp, Homo sapiens
ttctcctgcctcagcctcccgagtagccgggactacaggcacgtgccaccacgcctggctaatttttatatttttagtagagatggggtttcaccatgttggccacgctggtcttgaactcctgatctcaaatgatccgcccacctcggcctcccaaagtgctgggattacaggcatgagccaccgtgcccagccttccctgggattctctgtggaactctgtcctctcttctgtaaacagggacagttttacttcttccttttttccccctttatttcagtgtgtgaaaggacattgttgcatagcagtggtatgtgtggaggccctttttctccatcttgggaggtaaccattcagtatttcttcattaaatgtgattagctgtcggccggccctacgtagtgcccttatcagggcgaagatgttcccgtctgttcccagtttgctgagatgttttgttttcctcctcatgagtgggtgttgagacggtggtaccacctgttgatatagtgaagtgcctgggctgagttttgactgcttgatgtggccttgtgttctgagattacccctactaggtcttgatgtgtgatcctttctgaactgctggattcaattgggtaatattttgttaagagttatttgcatctatattcatgaggggtatggtctataattttattttttcttagtgtcagattttggtactagcctcataggatgagttggatagtgatctcacttcctctattttctgaaaaagcttgtgtaagattggcactgtttcttcctggaatgttacatggaatttaccaggaaaacaagccgagctagagttttcctttggggagtgttcttttataagaaatttaacttattgagtagatacagggctattctagattgtttattcttgtgtttctttaataagttgcctttttcaagaaatttgtccatttcatgtaagttgaatttgttactgaatttgctggcatgaagtcgttcccagcattctcttgccctctggctgtctgtaaggtgtgtcctgataacccgttgaacattcctgacagtggaggtttgcgctctctcgttttcctgatcaggctagaagtgtgttagttagcttgtcttttcagtgaacctgtttttttctgttacatgttattgttgtctctttatttctgctctgtattattctcctccttctactcgacgcttactttgctctttctggtttcttgatttggagccttaggttactg

SEQ ID NO: 27556 - DNA, 1050 bp, Homo sapiens
ccagcacggacgctgagttttgggaacctcgcggcccaggcagagcgcgtccttgtggtgctgtgcacaccccgcccaccctccgtccaccctgcgcatgcagtgcctgtggtgtcctgaggccttggtggggccgtcctagtccctggtgcagacgaggagcctgagaggcttagcagctcatgtgtgtgtcagctgggaacccacagcaagtggattccaaagcctgccatgtccctgttgccactagcacctcctcctccactccctcctggcctctctgggtcctctccttgtccctcctggcctctctgggtcctctccttgtccctccctgacctctctgggtcctctccttgtccctctctggcctctctgggtcctctccttgtccctctctggcctctctgggtcctctccttgtccctctctgggtcctctccttgtccctctctggcctctctgggtcctctccttgtccctctctgggtcctctccttgtccctcctggcctctctgggtcctctccttgtccctctctgggtcctctccttgtccctctctggcctctctgggtcctctctgacctctctgggtcctctccttgtccctctctgggtcctctccttgtccctctctgggtcctctccttgtccctctctggcctctctgggtcctctccttgtccctctctggcctctctgggtcctctccttgtccctctctgggtcctctccttgtccctctctggcctctctgggtcctctccttgtccctctctggcctctctgggtcctctccttgtccctctctgggtcctctccttgtccctctctggcctctctgggtcctctccttgtccctctctggcctctctgggtcctctccttgtccctctctgggtcctctccttgtccctctctggcctctctgggtcctctccttgtccctctctggcctctctgggtcctttccttgtccctttctggtctctctggtcctctccttctctccttgtccctctccctctgcctctgctttgcccacccc

SEQ ID NO: 27557 - DNA, 1052 bp, Homo sapiens
tttgaaaattgcacttataatttttattaaatatatgataaactacatgttttatgacaaataaaatatgtgatatatggttatatgataaatatcacacgtaatatcttagtattttttataaattcttatttgtatataaaatttatgcaacttatgcaattttgtacgtcccataaacagagcagaacatgcgtaaaatacagaaaaggaagcaaaaccttcactttaagcacgttatctcaacagtcactgttatcatttgagtagagtacgaactggtttaacaatgctattttcttttttaatagaggcagagtctcgctctgtcacccaggctgcagtgcagtggtgtgatcttggctcactgcaggctccaatttctgggctcaagtgatcctcctacctcagcctccctagtagcgaggaccacaggcgtgtgccaccatgccagactaattttctattttttgtagagaggaggtcttgctatgttgcccaggctggtctcgaactcctggcctcaagcattatcttcctgccttggcctcctgagttgctgggaccacaggcatgagacactgtggcctgccaatgatactattggtattttaaatttattattaggaaaattgcgtatgttttttttcagggaagtctctttaaagataactcatgcttccagcctttggctcagcgtatgtgttgagtcctcctgcctgccaggccctgtgggcctgggcactagaaccaggcagacgaggtcccaggagggaggcggggcaggtggttgactcacacctgagagccaggtggtgccttgggtgccagggagggcatctgagtgctgtggcttcagtcatggggtaggggtgggggtgtctagggattgcgtttgggcggaggggacagtcagggcagagacccctggagtagactagtgtgtgagggcccagggggccatggggatgagggtggagggggtgcaggggtctccagacgacttcagtatttgctgtgagtgacatggggcaccaggagtcatttgagca

SEQ ID NO: 27558 - DNA, 1049 bp, Homo sapiens
ctcagcccttcatctgtggggctggaacgacagccacaggggtgtggctggccagggttgagatggggagcaaagcccctgtccccattccctatcggtttcatggaggagactgaggtgtggtgtcccagaccctcccctcccctcctcctgtcccctggggaggtcaccaggggcagcgtcctgcccctgcacccagctctctgttcccacccataccttggagccatgcgcagcctcccgcccacccatgaagatgtagccctggcctcaacccagcccgggtcaccgcacatttgtccatgtggtcgttcattcgtatagcaactacgaataatcctctatagcctggcgcgccctcgcctgtgggcttggaaatggggaatcggggtcccgtggagccatctcctccggctcagtggccccaagtcaggctggctggtccctgctgagctgtggggccggcgtaaagctcacgtggactgtgaatacctgggtcaaacggaagaacaactcgccacgtgttatgctgataacgggctgagctgatgacatttccgacgcgctgggttagcgtacatcgttaaaataatctgtttctttttccttttcttagcacggccactagcacgtttgaagtcacacacagggtagcgccggcctggacagaggcggacatctgacaagcgggccaatgaggatgacatctcggacggtagtcactgctacaacgaaagtcagtgccccaccttgcccagccgcagggtggaccctaagcagctcgccccacccagccggtcctgcctgctctgtccctcccaaccctgcaatgggcagatttctggggggcagtctctgacccactgtggcccaggtacagaaccccgccttcaagtctctgggcctcagttttctcatctgtgtgttggggacaaagacgccgcccggccatctcaccaggctgccgagcagcgtggaagagctctggctgtgaggtcagaggccctttgtttgaaaggtccaggcccataggggtgcatgggttgtgg

SEQ ID NO: 27559 - DNA, 1030 bp, Homo sapiens
gccctggaggggggtcagtggaggagtcattggcttcccactggggcaggggccgctgaccttggagcactctgggctctcctcctccccccgccccgccccgcccccccgctcccccttccccttccccttccccttccccttcccctctgaggcatccccgctgtgggctctggacagaggtccctcctagggctctatcagcgcaacagctaagcactcaggtgtggtgttgagtgctgccatgcaggcaggaattgatccctctatgcctcagtttccccacctgtaaagtggacccggctgatccaccaccctctcccaccacggccccctgcctgagtccctggctgaatccctccctctccccagggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggaggtgagggccagatggcacctgggtacgcgtcggggccccaagcacccgcggtccctgggcatggaggaggagtggtgcagcacttgggagaggtggttttgaaaagggctacgtcacaggacagcggcaagggcaacacccgctcagcagggcacccggcagcatccacgtgaaaaggcaccatgccagcccccagcagtgcctgcgcttgggtcccggctgtgcccccgggcagtcatatgcctctctgggcctcagcactctgctctgtagctgtgtcaaatggaacaacagccctagtgttcggggtccttgaggctggtctctcggtgacataaaaagtgtcccaggatgtgctcctggagttgccatgtgctgggagtgggagggacacctgctggtcaggtggcaattagggaatatccaaaatacacgtaggtagcctgcacctcggccctgccc

SEQ ID NO: 27560 - DNA, 1054 bp, Homo sapiens
acattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactaggtactgtgcagtgtgaggaagccatggtcagttgcacagtgtgctcactgcacaagggcatgggcaagtgtctaaccaccaaggggatgtgcttcccagcaggaggctgttcccgcctgggaaggggtccattccctaactgtccactagaggggcccatcgtcatttatttgcccaaaggctttccctgggagatcatgggaaactcgcagccccaatgccgaatgcccaaagaaaggaacgtttaagccctctttgcaccccctgagaactccaacggccagtatcaccttcccagagcccatcattccaggcctcttggctgcctgccccctgcctagcccctacccaccaggagtgtgggtgctgagtgggcttctctccgcagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtaagcaggcccagggaggggacagagggtctgctctgagggtggctgggggctccgaacatgccgcgatcttccagcagcttggaccacagcctagtacatcacagatgttcctgcag

SEQ ID NO: 27561 - DNA, 1050 bp, Homo sapiens
ggggcagggcgggctccttccgccgctctggctctctgcagctgcatgtggcctttccctctgtccctgcctcaagtcttcctctcctttctctcatgaggacaccagtcattggatttggggcccaccttagatccaggatggtctcatctcaaatccttaattacatctgcaaagaccctatttccaaaaaaggtcccattcactggtgtctggcactgttcaacccatgacaagcccctcagtcctgtgcctctgtttttagtcaaagggtgtgtttcattccctctttaacaatattggcgtctgctctacaaaccggttatatgggaaagataccctctcagagcaggatgggtttccgtggacctggtgagggtgctgcaggctggggcagggacaggactgggacaggcccaccagtatccaaaggctctggccgagctccccacgaggtccagcgggctcctctctccccaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctgcgtccccgtaccgcgtgctttatttc

SEQ ID NO: 27562 - DNA, 1044 bp, Homo sapiens
atggattctccccttggcacccagcactgtttgcgtttgcgcctggccatggtggagcgggcagtgagagagcacggaggggctccgccctgtcgccgggagggcagcggccaggcaggctgggcaggggggtggggtctggctctgtcccacaggacggtgtgacccctgggtgggctcttgacgggctttcctcactggagttcctcaggccgctctcctgaagcggtgctcagaggccctgaccatcctgccaggcgcccgtgacccctgacctcttccctctgcctcctgctgtggcttctgtccacaagcccctccccttcccctttggacccctcaggcctccccagctgcctgcgctggaccctggcggggctgtttcactttttcctgggcagtgtcatgtatgcacctgtgggctgactgtgtggccacatccagtcaggacccagcctccagaactgacccagggaggctcccgctggccccaggaaggagaagtagaaactgatgatcaggcggggcgagagaaccacaccagcggccctgttgagaaatcaggccgagaggtcggtggcggtggctcaggcctgtaatcccagcactttcggaggcctgggcagtcggatcaccagaggtcaggagtccaagattagcctggccaacatggtgaaactgttgtctctactaaaaatacaacattagccaggcgtgatgggcacctgtaatcccagttcctccagagattgaagcaggagaatcgcttaaacctgggaggtggaggttgcagtgagtggagattgcctgggaggtggaggttgcagtgagtggagattgcctgggaggtggagattgcatgaagctccatctcgaggggaaaaaaataagaaagaaaaatcaggcagagaggcaacgccaggtcccagctggagctcagcggggagccaggggatacagtggctgaccgggcctcctaaccccccttctagcactcccccaggatcctgggtcccaattgttgccctggacaaatacgcccat

SEQ ID NO: 27563 - DNA, 1025 bp, Homo sapiens
gtggtgaggccactgcccccaagaacacagcctggtgactttagtgtacaaagcagggggagtctccaggggcacagaacagaggctaaagccagggtggaggtggccagcaggcctaggaggaggagagggtcagggccacaccccaggggaggtgcatgtcagccaggggccaccctaaggtggaagccaggagtcccaaaggggcctagagaaggagcagccccccacctggctaccgcagccctctctggttctgtgcagggtattgggatgcgttactgaggcccaaatctgccccactgggaacccccaaaaaagagccagggcaggagaatgagagggaggagccatgaaacccccgccctttaaagacagctctgtggcagctggcccaggccctgcagccctcaccacgttgggactcacttgggggtctcccatgggggtcctaatcccatctcttttcttcccagtccagaatgacagggtccagaaactggcgagccacgagggacatgtgtaggtatcggcacaactatccggtacgtacctgcccctgccccgggacacagaaccctcccgccagctgctcttctcaggcagaatgtcccaggttctactggaaggctggcctggcttgctgtgccagggccacagttctgggcaggaccctgcctggggcacagcctggtatagattcagagccctgcccttcccctctcgcgggagaccgggggcatccccctacttttctgagcttcagcacaccgtcgccttgcaaacatggccatagtgccagcctcgtgatgcacacgtgtggggtccgtgataccgcccacacagcaccccacccccatgccagccctgtctcctgcaggttgtcctcagccattaccctccacacccctgaatcacggaaacccctgtgctgccttcagggtgctgaggaggggacctgccaggcctggcctggctggcgaaatggggaaggggggtccctggggcttggaggcagctgctgt

SEQ ID NO: 27564 - DNA, 1050 bp, Homo sapiens
gccgggcggtccctccccgatagggttggtgagaaggtaaagaatgctcttcctgcacccaggaggtggcagtccacatagagaagcaagcaggggtgatggagaacctgcaggcggtacagccagttctcacagggtgttcgaggcgcctgtaccctgcaggggccccttgtggctctcatccagccagctcctccccaccagggggactcggggtacagccaccctctaggtgatgcgtcagcatccccctaacccccgtgtgtctagggcccacaggccattttcacagggatggcatgagtcctcccctgggcccagagaggtaaatggagagagagactgaatcgtgggccagggtggggagacctcgtggagccgggtgggagggcaggccagggcggggtgcggcccagcaggaggggccccagccattgacctctcctgacccggatctctcgcaggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggc

SEQ ID NO: 27565 - DNA, 1045 bp, Homo sapiens
acccatctgcccaagggttttaaacatgcagttctgtgcgccacagtcccttggtccacgctgctgttgaatgaacgctcaggtgggtggcttccacattcctgccgctttgaacggtgcttctgtgaacagcgttgtctgtgtttggtgcatcctggtgagtttttctagaatataaatgtattaaaagtagaattgctgggttgtgaggagcacacatgttcagctttgtaaggagtaccagattgtttttgtagcacagtccgttctcctgataccagagtagaaaaagttgaagtgaacttattctttgctaagcattggcattctcagtctggtgggtgtcccacggcagcgttgtctttccgtacatgctcagtgtgggattctccggctcacagctcttccagcgctgccctctgcccttggaggagcatctaaacccctccctcagctgttatttttttcctgtagaaataaatcagaatgagttatgcagaaaaacccgatgaaatcacgaaagatgagtggatggaaaagctcaataacttgcatgtccagagagcagacatgaaccgcctcatcatgaactacctggtcacaggtaatggcttacagtgaggatgctgttgcatgaatgtgattctccctttttgaacacataaggagtgctgtagcactgaggtttgatgacgtagttatttgtgttcagacattatgaaaacacaatgctaacctggtaagtttggaagttatcatgtgaaagccttttctgaagatgagatttttccaggtctctgagacctaacacaaacccatttttcagcctttgacagttttacagttactcaaaataattgagactgttgtgaagtaagtatattgaaagcctaaatagttgatctcttctggccagtctgcaaaaatatgctggcctgtttctggaaagtatgcccaactcagaggatgggaatggggaagagcagaagcgtgcagagggaaataacagtcaggctgttcttgatgtcaactggaggaagggcag

SEQ ID NO: 27566 - DNA, 1024 bp, Homo sapiens
cgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagg

SEQ ID NO: 27567 - DNA, 1033 bp, Homo sapiens
ttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaactgttatctggaagctctcttttttcctaagggtattttaataacaaatactgatgcatttgtattgaaagttgatatcttggaatggaaggacagaagaaagctcgcctcttggaactgtagttggctctcctctcactctgacagtgctgccccttttagtttgtaaatctgtacttggtgtgtttaatttgaaacctatcggctgctctcttgactggggcacttaatgtttcataaactaatttccttggtgtgaaggaagtagaacttttgagctacccactgcatgattttaaactgattttaatagcctaagtaattactctttttttttttttttttttgcttaatgaaattttccaaacatattaaaaacagagggaatacgccagca

SEQ ID NO: 27568 - DNA, 2556 bp, Homo sapiens
ccccccgagctttaaagtgaccaaggtgcctggactgtgctgggcatggagccgtccccacagcagggtagatggggctggggcggtggcactgtccattgaagatagcgctggtgtggcttccccagcccgtcttctgctccagcaggccccggccctgtcctgaagtctggaggatggggttggccctgctgttccctggccttgcacgctgctcacgtgtgccctcaccccaatagcacaccgagctggcctccctctagggagaggccagcatttgtgctaatccagtctctgctgcagctcttctgggcatctcagagttatagggcccgcccagagccgctggcagcccgggggccattgagagacagtcctggacctgagtctgtgggccctgaggaaggatgcctggcagcccatgttaagtctgtcaagccttgtctttgtttttcattttaggctacaaagtttggatcccaagcgagtcagaaggtaacagaggagaagcttctgcaccctggtgcatctgaaactatcctgagtctgacgtcacgtgcagcacctgaagctgcctggttccctcttctcaggccacatgctcagagctgaggggtcccagcgtagaagggggtgttcctgccatgctgttcccctcctcatgcccgggtggctgcctcatggacccactcagggcctgcagggccaaactcgtttcctgttcactggtagctggtaccggtgtgtggccactgcagccggccaccttgttgggagcaggactgcccggcttggcagatggcccacgctggcggtggccgctcagccagaagggccgctgtggttggtgctgtgcctgcggcacactggacgcgtctgcacttcgaggcaacggagcgtctctttgctctggccagggcttcccccagtcggggcagtgtggcctcaggcctttgcatgttttttattctttaggatgtgggtaggggccccgcggttcccacttggtggtcagggctgtgatctggctgtcctcgggttcagaatcacacccaggaggcagtacccatgtgaggctcaccatgaaagctcaggactgcaggcgtggagctgtgcatggctctaggacgcgcctttgccccctgggcgagggtgtcctttctcacgaggtgcccatccgtcacccccgtggcccatatcaccccttcctctctgagggagtctccccacgtgcccacccccagctgcagggacgcccatctggctttttcgtgggcctcccagggtcctgaggtgcagtcgctcgcgcagtttctgaaggtggtggtcagttccagggcagggagcggctgctccagggttgtgttgctgagagcctgcccggtgctgccttagtgttgcggcaccccatggtgggttcgaaggcgctgctggttactaatgccgcccctcaccttgctctctcctcacctgtcttcttgctgtcgggtaaagttttggggtcacaagcagcagccggagccggtaaagcccgtgtctgctcgtgcatgccgcccgcatctccgccgagaatgtgcttggcttcctctgtccctcctgcgtgctgccactgtcttgtgtcacctcacatgtgcgcacgctcagaccctctccctggcctcggtccgtggctctcctttaagatccaggatctgcatcaggcttggctgtgtgtgcctgtcacccctgcgcagtaccactgcgctccccccgggcaaaaaaatgagacccccatctccaaaacacacagacccccaacgcaggcctgctgccggggaggtgctggagggagggcgggggcactgggcgcagagctgctgagcagggtttcctggccacctgcgctcccttgaacgcagtgcaaaggggaggatctttgctctgtgacgagttcttccctttccggcctttgatccgtgctgctccctgcctttgggggaagaggaggcctcacaccacatccccaggtggccgtgtggcctcgactccactgacccaggatcaggagaggctgagctcctttctcagcagcttcttcctatggccccagcctccgtgccctcttccctccaggggggactcggtgcctgcctggggaggaaggagaggcgttgcaggtcagcatggggtggctgcagccggcgttggcctcaggcacaggctccacagggcctgttcccaccagcccggcccggcagggccgcatggtggcgcgtgagggaggaccctggagggggaccttcctgcaagaattggtgggggccgcggtctccgccttctagaggtggcggcctactgcccttcgggtgttgtgtgcaaagccccgtttcctgctccctgcgcttgtatcctgctgccttccctcctgctggtgaagctcgtgctgccctttgctggcctgtgctgccactgccgacccgtgtcccgtggtggagctgtcgtggggctcacgtgacttcccttcctacaggcgtccgagctgggccacagcctgaacgagaacgtcctcaagcctgc

SEQ ID NO: 27569 - DNA, 1215 bp, Homo sapiens
tgttctcggcctctgaccccaacaggggaaccaccggggatctcatcgggcctggccttgtgctgtctactgagaggccagccctggtgggcacagatgcactgcccactaggtgggcccaaattttccctgcagacgccatgtcccttctctccctctgtgtatgtggtttttcagtggtgtgattgcagctgaggacagagggcagggccagatctggggccagcgtagctgagggcgtcgctcgggagggcctgtgtcccggcttgaggccaagcgcccctgcccctccccacttgactaaaccactgttttattgcagcagtttggagctggtagaaaaggaagttttctgtaaaactgtcctccagttggggtggttgataaagagtgggccctggttctccagctccccagcagtttcctctgctctgaagcgggagaaacagatcccacctggtggggctgctgtggaccctgagcgctggcctgggaaggcggtcactgtccaggtgcagagctctcgggggcacagaattcccagtggtggactgagtaacagtcatttagagtcccccttctgtctctttaaaagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctg

SEQ ID NO: 27570 - DNA, 1023 bp, Homo sapiens
ctccacaagggctgaagaggacgggcgggctggaccaggcggggctccgagacgcgtccgagacgggggcctgggcccgggagaggggcgggggctgggctcccggacccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtccgcgcgtgcgcaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccaggtgaggggcgccgcgcgcgggtgggacgagcaggcccgaggggcggggggcgaggggcggggctgggccgggggctcctctcctctccgcctggcgagcgctgggctcggggtccccggcgggctcctctcgggtcgggcgggttgggacggcgcccaccaggttcccgacgtctgggccggggccccgcgcacaaagcgcctttgttccacccgctcggccggtttgggctggttggagccgcccgcgccccgcgcggcgaaggcggtgccgggagctggggagccccgcctcggtaaataacccagcgcggcggctccacccgctggggagcgcccttcatgacggaaggccgctgacccgaggggctcctccacccccatgcgcagatcccaccagccagcaagctaaagcatggcggccatcccctccagcggctcgctcgtggccacccacgactactaccggcgtgagtagcccctgccccccatccacgcggatgctctgctggcgccagtgccggccccgtgcaggc

SEQ ID NO: 27571 - DNA, 1075 bp, Homo sapiens
ctcacgctgtgaggctgttgctggggctgataagggtggggttcactgctgcttctggagagccttggacagcaggcagtcctggagctggacaagcaggacccagggcagccactgaggtgggcccccgtgccacctttagcggggggaaagggagcagggagggctggtcctctgagggattcaggccccttacccgagggcctgcggggcggggagtagcctctggctgtgagctgggaagccctcactctggagggacctggttcctgctggtaggtgtctcccaagggcctcccataggggtgttgccccaagacaggctgaggggtaggggctgcaggcaccgtggaggggtcttcctgccacaggcagcccagcttaaagtgagggtggctgcatcattctggcctggtataggcatggagtgttggagtccgggagtgctgcaggctggcagggatgggggtccacacacaggagtgcatgggctgtgagcttagtagactccttcataaccaaggtgggtggtgtccccacacctctgccaggagcctacagggattgactcagttctgttgagaggcagcttagtgagcaggtgggagtcagtgagatagctggagacttgatgtgtggccagggacatggtgagaggaggggcctccgtggggtgggaaagggtggggttcagtggtgggggagggactctggggaggggtggggatcagtgggtgctccctgcctggtaccctgttccactgcactataaatagctgtactagttggtgggaagctggtgggaaggcatctggcttgtggcctctgatggctgagcctttgtcctgtccacagggtggaggcagcctcacccagccatccaagccggtggtcagtgctgaggctgggtgggggagcctccgatggacccaggagtgggaggctgctcctaatggcagttgagccccctgcagccttttgcagtgtccagatgaagcccacagagaccctcctccatgtacacacagctgtgagggtagcaggagttggtgttgaagggagagcccagccacgc

SEQ ID NO: 27572 - DNA, 1029 bp, Homo sapiens
ggccaggcacagtggctcacacctgtaatcccagcactttgggaggccacggtgggcagatcacgaggtcaggggatcgagaccatcctggctaacacggtgaaaccccgtctctactaaaaataaaaaaattagccgggcatggtggcgggtgcctgtagtcccagctatgcgggaggctgaggcagaagaatggcatgaacccgggagacggagcttgcagtgagccgagatcgcgccactgcactccagcctgggcgacagagcaagactccgtctcaggaaaaaaaaaaaaaaaagttccagtaaagcaaattttaaaagagcccacgtgtccaggtgtacctataatcccagcactttgggagcctgagatgggaggtttgcttgagcccaggagttcaggactggcctgggcaacatagtggggctccctctctactaaaatacaaataaattagccaggtgtggtgtcacatgcctgtcgtcccagctactctggagggtggggctggaaggtggcttgagcccaggaggtcaaggcagcagtgaaccatgatggtaccactgcactccagcctcggtgacagggtgaggccctgttggaaaacaaaaatgaggaagaacctatgtggttaatcactattcttgttccacttacataaataaccacaccaggtttaatgaggccaaacttactctgcaatcaaatcaatcttttattatctttgatagaaatgtgttaatttgaaaacaatcctacttttattatctttgatagaaatgcgttaatttgcagccggtcacggtggctcacacctgtaatcccagcactttgggaagccgaggtgggcggatcacctgaggtcaggagttcgagaccagcctggccaacatggcaaaaccctatctctactaaaaatacaaaaattagtcgggcgtggtagcaggcacctgtaatcccagagacttgggaggctgaggcaggagaatcacttgaacccgagaggcagaggttgcagtgagcca

SEQ ID NO: 27573 - DNA, 1050 bp, Homo sapiens
tgtgatgacgcgggaggagctggacgcagaaggaccagcgaagaggctcatgactgcgtgatgtaggcagtgggaactcgaacaggagaatggctgtcagcggcttgcggcctggtggtgcctgttttaccccacattccctcccggaggaccctgaagggcgtggggactgtctgagatgatcaagccctttgtgtgagggcgaggggtacggagcctttcgctcagagcgcaaacgtgcgtggtgcctcagtgtagctctcctcagacacacacggcatttttcctataccacaacgttccctcccattctaacatcggaatccaaactgcgccttcacgcacgggcatctccattccctggcagcgattgtctttggttttggtgagaaaggaaataatggaacttagagaggatgaagtctttgagccaatgtgatctgtgtgtgtctgtgtgtgtgtctggatcagtgtgtgtctgtgtgtgtgtgtgtctgtgtgtgtccgtgtgatctgtgtgtgtgtctgtgtgtgtccgtgtgatctgttttgtgtgtctctgtgtgtgtgtctgtgtctatgtgtatgtctgtgtgtgtcatgtgatgtgtcttgtgtgtgtgtctgtgtgtgcatgtgtatgtctgtgtgcatgtgtgtgtgcatgtgtgtctgtgcgtgtgtgtctctgtgtgtctgtgtctgtgtctgtgtgtgcatgtgtgtgtctgtgtgtctgtgtgtctacgtgtgtgtgtgtgtagacgtggggggggggtgtgcactttatttcctcacgtgcccccgctgcctccagcaagagccccggcccatgccactcaccgcggagcagctccagcaggctgcccttggccatgagctccgtgatgatgtacacggggtcccccacggacaccacggcgtacagcgccaggatgtgtttgtgccgcagcttcttcatggcctggatctccgactgcagcatctgctggtgcaggaggttgtctgcggggacgggtggcctcggtggatgcagcccctgacccccca

SEQ ID NO: 27574 - DNA, 1046 bp, Homo sapiens
ctcacgtggactcccatccatcccaggcagcagcttcccacctgggccctacgtgcaggatgagggctccttccgggtcagaagacatggcggcctcggggcaccgtcccctgcatggggtgctcacaggatcttctcctctctccttcccagggtgtgcccttactacctgtcccggaacctgaagcagcaagccgacatcatattcatgccgtacaattacttgttggatgccaaggtgggggctcagtcctgtagctgacgactcctgatgtccaggggtgtccctgggcttgggaacagctgtccgagcctttgctgcttcagggccttagatcagcaggcctgggtgggaggactcacctctgtcactgggcaggggctcaacctggccagacacacttgtgagcagccccaggccacaggtcagttttctgagcagtctgggagcgggcaggctggtgggagtgaggagagacctccaggctgtggtccataggccagtgcccgctcttgatcctgacagctcaggttctctccttcacgtcaggccatgggaggcaccgagaacacaggaagcccactgactcccctcttcccagcgcgtgcccggccccacactcactccccctcccagcatgtgcccggcttcacactcactcccctcttcccagtgcatgcccggccccacactcactccccccacagcatgtgcccggcctgacactcactcccctcctcccagtgtgtgcccagccccactcccttccgccccgtgtgcccagccccacgctcactccccccgccagcatgtgcccggccccacactcaactcccctcctcccagtgtgtgcccggccctgctgccctcctccccatgtgccctgcttttgtgccccacactttttacttagtgcaggtgggatcacacgccacgggtcaatggtttgtgtgttcacgtgacgatggcgtggtgacgtttccagatcccgtcgttggttcgctcattctcggggtgtatatttattgagagctcatcatgctgg

SEQ ID NO: 27575 - DNA, 1017 bp, Homo sapiens
atccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccaggagtttgagaccagcctaggcaacatagggagaccccatctcaaaaaaaaaaaaaaagaaaaaagaaaagacttcagtgtgcaggtttaccagagttttgtttgcagttgccaaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcctcagcctcccgagtagctgggactacaggc

SEQ ID NO: 27576 - DNA, 1017 bp, Homo sapiens; identical to SEQ ID NO: 27575

SEQ ID NO: 27577 - DNA, 1017 bp, Homo sapiens; identical to SEQ ID NO: 27575

SEQ ID NO: 27578 - DNA, 1015 bp, Homo sapiens
caaactgcactgtagagtgacggagctttgtgtctgggcctccatgccttctgacgtcacctgtgggggtgtgaaaggcagactctaccttgatttttcccagcacgccacaccggtggttctgtgcgctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagagacgaggtttcaccgtgttagccaggatggtctcgatctcctgacctcgtgatccgcctcccaaagtgctgggattacaggcatgagccaccgtgcccagcctgatatttttagtagaaatggggttttgccatgttggccaggctggtctcgaactcctgacctcaggtgatcctctcaccttggcctcccagagtgctgggattacgggtgtgagccaccacgcccggcctcttgttcttttgaaacctgccctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagt

SEQ ID NO: 27579 - DNA, 1015 bp, Homo sapiens; identical to SEQ ID NO: 27578

SEQ ID NO: 27580 - DNA, 1015 bp, Homo sapiens; identical to SEQ ID NO: 27578

SEQ ID NO: 27581 - DNA, 1285 bp, Homo sapiens
gatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggaggaaggggctgggggggggctccaggctcagcctcaccaacttt

SEQ ID NO: 27582 - DNA, 1030 bp, Homo sapiens
cacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggagctgatgtccagggcagctgtgatgctgacggccaggggctcaagtgtgtggtttcttctgcagggggctcatgagtcccagctggaatcaggccccacccttg

SEQ ID NO: 27583 - DNA, 1035 bp, Homo sapiens
ttattagtgctaataggattttttatgcactatttaggattttcgatatatacaatcatatatattcaatatatacaattaatatatatgtgaatagagataattgtagtctttgtttctagtttgcatggcatttatttctttttcttgcttaactgccttagctagaacttcaagtacaatgttgaataaaagtgactagagcgggccgggggtggtggctcacacctgtgttcccagcactttgggaggtggaagtgggcagatcacttgagatcagcagtttgagaccagcctggccaacacggcgaaaccccatctctactaaaaatacaaaaattagctgggtgaggtgatgtgcacctgtagtcccagctacttgagagggtgagacatgagaattgcttgaacctggggggcggaggttgcagtgagccaagatcatgccactccactccagcctggacgacagagcaagaaccctgtctttaaaaaaaaaaaaaaaaaaagtggctagaacaaacatctttatcttgttcctgatcttaggtggaaaacttttttgttcctgatattaggtggaaaacttttagtctttcactgttgaatatgatgttacttgtaggttttctgtagattccctttatcgagttgaggaaattctcttatattcatagtgtgttgagtgttttttatcatgaaagggtgttgattttttttttaaagatagggtcttgttctgtcacccaggctggagggcagtggcatgatcatggctcactgcaacctcgaattcctgggctcaggggatcctcctacttcatcctcctgagtaggtgagactacaggcatgagccaccatgcccagctaattttttaatttttctgtagaggtagggtcctgctttgctgcccaggctggtcttaaactccagggctcaagcaatcctgcctcagcctcccaaagtgctgagattacaggggtgagtcactgcactgcacccagctgtgtgggatttttcaaatgcttttttc

SEQ ID NO: 27584 - DNA, 1129 bp, Homo sapiens
acacctggctaatttttgtattttagtcttaacgtgctggtcagactggtctcgaattcctgacctcaggtgatctgcccgccttggcctcccaaagcactgggattacaggcgtgaaacaccatgcccagcccccaattttttttttttaatagagagaaggtctcactcaagcccaggctggtcttgaactcctgagctcaagctgtcatccctcctcggcctcccaaggtgctgagattacaggtgtgagtcacagtacctggccttctttcaagactttaaaaatgccatcttggctgggcacggtggctcacgcctgtaatcccagcactttgggaggccgaggtgggcagatcacgaggtcaggagatcaagaccaccctggctaacatggtgaaaccctgtctctactaaaaatacaaaaaattaaccaggtgtggtggcaggtgcctgtagtcccagctactcgggaagctgaagcaggagaatggcgtgaacccgggaggtggagcttgcagtgagctgagatcacaccactgtactccagcctgggcaacagtgcgagactccatctcaaaaaaaaaaaaaaatgtcatctcactgccttctggtccaatagtttctgatgagaaattggctgttaatcttattgaggaacatttatatattgactagtcacttgtctcttgctgttttaggagattctctatctttgggtttcagcagtttgattataatgtatcagtgtggatccctcaatttataagctacttggagttcattggacttcttggatgtgtaaattcatgtctttcattaaatttgcaaagtttcagctactattctttgcatcttgaaatactagttttgtttctttctgtctgtttgccgcttatggaactttatgcatacattgatgtgcttcatggtgtagcacaggtcccttgggctctaggcatttttctttgttctttttttctttctgctcctcattttggataaattcagctgacctgtcctcaagttcactgtttctttcttcttccttctcaaatctgctgttgaaacttctggtgaaattttcactacagttactgtactttttagctccaaagtttctatttgg

SEQ ID NO: 27585 - DNA, 1033 bp, Homo sapiens
cctcggcctcccaaagtgctggaattacaggtgtgagccaccgcgcccagcctattttttattttttgagacaaagtctccctctctcacccaggctgtagtgcagtggcacaaccctggcacactgcagccttaaccgtccaggcttaagtgagtctcccaccttagtctcctgagtagctagaactacaagcatgtgccaccatgcctggctggttgtgttgttactgttttagacacagggtcttgctacatttctctgactggtcttgaactcctgggctcaagcagtcatcccaccttggcctcccaaggtgttgagattacaggtgtgagccaccgcacccggcctgttaatttctttatttccggtgaatgggccacactttcttgtttctttgcatgccttgtaattttttgttgaaacctgcacaatttgaagatgataatgtggttactttgaaaatcagatcctccgccctctgcagggttcattgttgctgtttgttgtggattgtcgtttctcgtttgtttagttactttcctgacctttttaaataaagattatattctgtcaggggtgcttgtttctgttcttttaggttagtggttagcttgtgctttgaaagagatttctttaaatatctagtggcaaaaaggataaagaggccgggcgcagtggctcacgcctgtaatgctaggactttgggaagtggaggcgggtggatcacttgaggtcaggagtttaagatcagcctggccagtatggtgaaaccctgtctctactaaaaatacaaaaattaaccgggcatggtggcacctgcctgtagtcccagctactgggaagactgaggcaggagaatcgcttcaacccagggggcggaggttgcagtgagctgagattgcgccattgcactccagcctgggcaacagagcgagactctgtctcaaataaaaaaaaaaaaaaaaaggataaagagtgtcttccatcctttccaggttgcctctgtactggggcaagtccttcagtgtc

SEQ ID NO: 27586 - DNA, 1027 bp, Homo sapiens
ggccaggcgcggtggctcatacctgttatcccagcactttgggaggccgaggcgggtgaattgcttgaggtcaggagttcgagaccagcctggccaacatggtgaagccccgtctctagtaaaaatacaaaaattagctgggcgtggtgggtgcctgtaatctcagctactcgggaggctgaagcaggagaattgcttgagcctgggaggcggaggttgcagtgagctgagatcgtgccattgcactccagcctgggcgacagagtgagactccatctcggggaaaaaaaaaaaaaaaaaatgccatcaacagcacgaccctggaggctgccccagccctgagagagttcgagggggtgaaacaaaggcaagcccttcagggagacactagaaagatccaaatgcataagcaggattccttgagaaaaggtctgtatcatcccttctgacaccagcaagccacatcagaaatacaggttgccttccccatggctacatgtgagctggtagtagtggctgagcagaaatagcccagctgtcctcctgaaatttagcagggtcttacttcattgagcagtcatctggttcgtagacaccagagttacagaaaagtttattgggaggttttgacagtttaatagaaaaaagtttattgtgacagttttgacagctgaatagaaaaaagtttattgtgacagttttgacagcagaatagttgctttgctggagagacggatctttggagctgccaactccatcattttggtgatatccagctctgttgctgaatttttagctatgctgttttaagttattttcttagtggttgctctagagatgacaatgtacatctttaacttaccacaatgtacttcagattattactaacttaacacttaaagtacagcatttttttttttatggagtttcactctgtcacccaggctggagtgcaatggtgtgatctcggctcactgcaacctccgcctcccaggttcacgccattctcctgcctcagcctcctgag

SEQ ID NO: 27587 - DNA, 1031 bp, Homo sapiens
atttttgtatttttagtagagacggggtttctcaatattggtcaggctggttttgaacgtttgacctcaggtgaggcacatggtgaaaccccatctctactaaaaatataaaagttagctgggcgtagtagctcacacctgtagtcccagctactccagagactgaggcctgagaattgcttgaacttgggaggtggaggtgcattgagctgagatcatgccactgcactccagcctgggtgagagagtgggactcggtctcaaaaaaaaaaaaaaaaaaaaaggattctctatttcctgaatcattgccatcatattttcatttaattatttgaacatacttatagtagctgctttgaagtctttgctaaactcaacatctgggcccactcagagtcagattatatcaactgctttttttcctaaatatggatcatggtttcctgtttacctgtcttataattttttttgttgaatactggacatttcagatgatctatgtctggattctgagttgttttcctgagtcttgtgttctgtttgttttagttaagttgtttggacttaaactgcaaaacttgcccacccacccctgcagcctctgatatctctgctcagatttttaaattcttttttttttttttttgagatggagtcttgctgtattgcctaggctggagtgccagtggtgccatctcagctcactgcaacctccacctcctgagttcaagcaattctcctgcctcagcctcccaagtagctgggattacagatgtgtgccaccatgcctggctaattttttgtttttttagtggagatgaggtttaaccgtgttagccaggatggtctcgatctcctgaccttgtgatccgcccacctcggcctctcaaagtgctcggattacaggtgtgagccaccacgcacggccttaaattctattttttagtctggcttcctagcagttgcttctgtgtttgcatatggtagtggtcagccagggatttgggcaagagggtgtgctcaaacactcc

SEQ ID NO: 27588 - DNA, 1070 bp, Homo sapiens
ggacacctgtcccagatgtcgctcagctctgaatttggggagtgctgctttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgacagaaaagggaacatcagttccgctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctctccgcctcctgacactcagtcggggaagggggctgtgcacacttggcacaaagcttgttttggtatttgctggctattttttcttcctataacttttcttctctcaggtaaactatcctttaaacttttgtggaacagggaatagtagctgagagaaactcactcagccacctgaccacacttaaaactcccctctgcctgatatgcgtcccttatgtaagaggcctgcactggtcctggctgtatctctaactaatagagctccttggcttccggcagtgcacaagctggacaacaccacttggcctgggtttgttggtggcgaatttttgtttgttctaaccctaacccttttccctgcttagctccagctgttgggttctcagaattcctttcctcctttaggggtagttcttgagtg

SEQ ID NO: 27589 - DNA, 1033 bp, Homo sapiens
caggcctggatcacttgtccatcctgagtgggagtgggggcagcccccagagacagactcaggagagggggagtgcaaggatgtcccccagatgccctgtgctgcccaggggacagctcactggcagtgggacgaaaccgctgtctgtccagggctctcttcctagaaggtcttaggaactcccaaatgggtgctggctggggttgcccggcccggtgctctcaaggagagctgaagctagttattgggtgcagatgctggctctgacccctgccccttcctcccgggctcagcttccccatctgtcatggagtaataacaacccagccttctggtccactgaggaatgtgtgtgcctgtgtgtttgacgctctcagaacaggcctgcagcgctgtgagccttggaagggggcctcacagctgctgccgccaccttggaggcccaggatgggactgagaaggggaagggagaggtcagagccacagctgttgggcagggacctgctgtaggaagagaaggccagggaggcgctggtggtggcctcaggctatgcaggtgatgcccattgtttccagggccatcccagtttggaggttcctgtttctagaggaggttcccttgtgaccccctcatttccacacccgagcaatgctgagggctgtggggcccccaggggcttgagtgtggtttatggcacagcagggactgatcacagtggcaccgggtgtcagtggccagtggtcagtggccaggaaccctcaggaccctcctccttgtgtgggtggcatttacccacccacaggtcacgctcaggacccgcatctcattccgatcctccttgtgtgggtggtacttacccacccacaggtcacgctcaggaccccacatctcattctgaaggccgggcacaggcggttgttttctctccaacttcggtttccccatccccactcttagggcacaaatgcaggtgtagcttccccatgcccactctttaggcacaaatgcaggtgtagcttccccatccccact

SEQ ID NO: 27590 - DNA, 1551 bp, Homo sapiens
gtgtgatctcggctcactgcaacctccagctccctggttcaagcggttctcctgcctcaggctcctgagtagctgggattacaggcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccatgaggccaagggaggaccctggggtcgagtttccttcgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattgaggactccattcccttggcaacctctgatgactaagggccggtaaaaaccccctctaggctgacgaggaagagctggtagggggtcaggctcttcacctgcagcctccagaggagatccttgtgtcaaactgggccgtgtcctttccaagtcctgaccctggctgcctgcagtgggtggggtggggttcgaggggctcgcacacagatcctggcacttgccctggtgggctgtcactcaggacacttcacggtctcagccttcacggaaacacccagagctgtggtccttattctgtgcctgtcaggcaccaccctgattctcaggattctgtgcctgtgccgtgaggcactgccctgattctcaggagagcccagaactgtggtccctattctgtgcctgcgccgtcaggcaccgccctgattctcaggagagccctgttctccttgtggggactctggctgggtgtcgcagacgtgctggcctctagagtccccgggcctgggaggggtatctgtttgtgtgggagggactgagtgggat

SEQ ID NO: 27591 - DNA, 1046 bp, Homo sapiens
ggggatagcagagaggggccgacagccccccaactgcacagacttttcataacctcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtccctgtggttgttgggcatggccgacctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagttatggtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgtaaatggaacgatacagtgtgcagctttttggcattcactgtcttcatttggcatcgttctctggagacctgttgggg

SEQ ID NO: 27592 - DNA, 1051 bp, Homo sapiens
gagggcgggcgggcgggcggacgggcaggtgagctcgctgcgggtcgggcgggcggatcggcccacgtcaggcccgggcaggcgggcgggcgggcgcgggtggggggcgggggcggcactccagagccggaaatggcggcgacccccgggccggggctgcgcgggcgctcggggccggagctgctgcgacgccgcggcctgggccggggcgggggcgcgggaaggtcggcgccggggcctgcgggagccgggccgggccgggccgggggtctgagcaccgtggtgggggctggggcggcgctctccgcgggtctcttcgggcccggacgccccctccgctcccccaggtccccgcggccgcccccaaccccccggggtctcctctcctgcggggggactggagaagctgggccatcgctggtcttagggaggcagataatttagtccctgggtcgttgtgtttatagctcggggaattgaaaattgttctgtaacgcatcgtaaattaatctttccgacgttgtaaattccaaaaagcatttggtttgttagaaaaaacctgttttctccgctttataaaaacatttgaagccatgctttatattgaactcttaaggagagtattaggaactcgtccgttcaggttctaacttgttggtgttaagtgtctggattaaagactctctttttcgtgtgccgaagccatgatttctcaaattcattcagttgtgtcatacaggaaaaggaagcaaaaatttcagctttatttttgttttccggcttaggcttggttgggaagatttgatggtggttagacacgtctgcccttatttgcctgtttagaaaaacctattctaatgacaaaaacagttacattgctcccactattgtcatggttacctgaaggcaaaagtttactcaaagcttctgagattttatgttcgtttatttgcttctctttttaaaaaaatgtcagctgagtttcaggaatgagtagtctgtcaaacaagagatgaaattagaagcctggatctaagggctttggggaagt

SEQ ID NO: 27593 - DNA, 2269 bp, Homo sapiens
ccttggatcttcctggaatgcctggttccttaaccccctagcctggcgactgcctgcctgccttgccacccagttcccttcctcgcttaattttcccacagcgctgaatcctcctagtgtcctgcttaatgcatttatcatacttaatattttactgtgagttagtaaggtccgtggagagaatgttttgtgaaaaaaacagttgctggcacatgatcggggcccagtaaatatttgttcagtgaatgaacgtgaggagcttagcagcagctgtgcgtggtgctggccttgtcacccggaagtccttgtcggtgaggactgagcatgtagaggtaagggttcctggagtgttggccctcaggacagagagccaccatctctcacctgcccaatgaggaaagacagccaggtaaggggtggcttggaagggtgcatgggacccttgtaaatcttttcgcaactttgaatctataattattttgaagttaaaacgtttctaaaaagtcagatctgttgggggcacagtggctcatgcctgtaatctcagcactttaggaggctgaggcggacggatcacttggagtcaggagttcgagactagcctggccaacatggtgaaaccccatctctactaaaaatacaaaattagctgggtgtggtggcgtgtgcctgtaatcccagctactagggaggctgaggcaggagaatcacttgaacccaggaggcggaggttgcagtgagccgagatcgcgccactgcactccagcctgggcaaaaagagcaaaactccatcttataaaaaaaataaaaataaaaattagctggttgtggtggtgggcgtccgtaatcccagctactcaggaggctgaggcaggagaatcccttgaacctgggaggtggaggttgcagtgagcaaaggtcacgccacactgcactccagcctgggtggtagagcaagactcagtctcaaataaataaaaataaataaaaagtcagatctgccagtggtaataatgcttttagaaattttgtctttgattaccaggaaaaaccctacatgctagtccttatactccgtcgtgacatttggtaattaagtagagtgaggtggaatgatctccctggctcttaattcaggaggactgcctgagagtgactgtggctgatccccttagcatgaggcccttcagctgtggtgctgtgacagagccacagaggctgcttggtgacttgcagactctggagtcctttccacagcctccacctcatgcctacattaactcagagtgagtgggcttcagggccttcctgcatccctgaagatggttgtattaacgtggttcagagattgaacagacgctgcacgtttctcaggcatttttcctcagttccccttgcttggagggtggataccactgagcctggttgtacagctgcctccgtgaccagcacctttgcccaaggtctccctgttaacaatcgtcagagctggaacttgaactcgagtcttctctagaccaggtttcttctaagtatttggcatcaccaggaagagccctgtacaaggtgctggtggttttatccttagagcccagatgtgaggtgctcacgtgtgtgcctggggttagcagttggtgtttgttgaatgaatgactaaaatgcagtggggcggggagtcatgataaggtagaattttatctgaggtggagtttgcttctgaaatcaggcagtaaggtgaatgtgatacccagttaggagtatgtaatgctgcaggtaaactgtaacagcaaatgaaagcagtatttctccaggaaggaaacagacccctgggtcctcgggctgggttggaaaaagccatttgtagagaaatggaacatggtggctagccctgcacaagacatagagaagagacccttaacactccagttatctccaagtgggcagttagaatgagtgcttctaggccgggcacggtggctcacaccagtaatcccagcactttgggaggccgaggcgggcagatcttgagatcgagagatcgagaccatcctggccaacatggtgaaaccctgtctctactaaaaatacaaaaatagctgggtgtggtggcgggcacctgtaattccagctactagggaggctgaggcaggagaattgcttgaacccgggaggcagaggttgcagtgagctgagatagcaccactgcactccagcctgggcgacagagcgagactccctctcacaacaaacaaacaaacaaactgcagtg

SEQ ID NO: 27594 - DNA, 1027 bp, Homo sapiens
tgccattctcctgcctcagcctcccgagtagctgggactacaggcacccgccgccacgcccagctaatgttttttgtatttttagtagagacgggatttcatcgtgttagccaggatggtctcgatctcctgacctcgtgatctgcccacctcggcctcccaaagtgctgggattagaggcgtgagccaccgcgccctgccacatcctgttttttttacaacagggtgtcactctgtctctcacccaagttagagaggagtgacacagtcttagctcactgcattctcccaggcccaagcaatcctcctatctcagcctcccaagtagctgggactttaggtatgtgtcaccacagttgactaatgttttaatttttgtagagatggggcctccacatgttgcccaggttggccttcctgggctcgatcctcctgcctcagcctcccaaggtggtgcatgcctacagtctcagtagattagaatcaccctaaccctcagtaactgagattgtaggcacgcaccacctcactgactcacctcaaactctcttttttgagatggagtctctgtcaccagactggagagcagtggtgcgatcttggcacactgcaacctccgcctcctgggttcaagcgattctcctgcctcagcctctgtagcagctgggactacaggcatgcgccactacgcccggctgatttttgtattttttagtagagacggggtttcaccatgttggccaggatgatctcgatctcttgacctcatggtctgcgcaccttggcctcccaaagtgctgggattacaggtgtgagccactgcgctcggcccatctcaaacttttaataaggctcttcgtatagaaatttttaaaaaattaaaaacatttttggccaggcttagtggtttaagcctgtaatcccagtgctttgggaggccaaggcaagcagattacatgaggccaggagtttgagactagcctggccaacatggcgaaaccacgtctctactaaaaatacaaaaatt

SEQ ID NO: 27595 - DNA, 1049 bp, Homo sapiens
ggcttgttagggttaaattggtgcaccttatacttggttgcatactagactcactggaatgatttgactttcgtcatagttgcagaggcactctgaaaccctatgtatgtgcttcaccagggacagccccacgcatgggaggtggtggccagccatcaccccagggtgaatttctctaagagcagtcctaggccagggggtgagtgtgggaaagtcagggccgtttccatcagttaacgtttcagagcgggttcccgctggaagtgctggaaatacccagatgccatctgtagcattttatgaactgtggcggatccactctctgtgtcttgagcttctgctctgtggtctgctcagtggaagcatcctgtcagtccactgtacagtggggtggagccgcagccagggtgggtgtgccgtttgattggtcacggaatgaacagggcaaaggtcactaagtagatatgatactgcaagtaggattgtggtcataggtatttttatgaatttgtgttatgtgaagttgaggatttgaatgttgtgattattatatccagataaagttctagcctggcacagtgcaggcacgtgcctgtggtcccagctgcttgaagtgggaggagagcttcagctcaggatttccaggctatagggagctgtggtcccaccattgcaccccagcctgggtgacagagtgagaccccatctcaaaaagaaaagaaaagaggctaggcgcagtggctcaggcctgtaattcaagcactttgggaggctgaggcaggcggatcacttgaagtctggagttcgagaccagcctggccaacatggtgaaacccccccatctctattaaaaatacaaaaatcatacttacccggcaggggagataccatgatcgcgaaggtggttttcccagggcaaggcttagccattgcactccggatgtgctgagccctgcgttttccccaaatgtgggaaacttgactgcgtaatttgtggtagtggagggactgtgttcacactgtcccccccgcccaaaaaaataaaaata

SEQ ID NO: 27596 - DNA, 1125 bp, Homo sapiens
cgacagagcgagattccgtctcaaaaacaacaacaagaacaacaacaaaaaattagccgggagcagtgatgcgtgccgtagtcccagctactctggaggctgaggcaggagaatcacttgagcctgggaggcagaggctgcagtgagccgagattgtgccactgcactccagcctgggcgacagagcaagactccgtctcaaagaaagaaaaagaaagaaaaaagtcttccccgtgagagtagatttctactgaatcgattgctggttttatgccttttcttccgtgataggaagtatgtccagactcatctggctggggatcctcaggagagcctgcggggggcagcagaggcccgcctgggccagggcgtgcaccagaccagaatcctgcggatttagtattgtgagggtagaagaccagcaagcagcatgacctcgtggttactgatcttatgaagaacacttgtctttcatatttgggactgtgttaaggttttctggaatatttttggttgtagtaacgattctgctttaggagctttcttctctagtgttgcacagacctgagtgatttgaccagcagtgctgcggtaacggaagaccactcgtgtcttcagactcgttctgttcctgggggtgcttgcttgttctaggccccctttgtatggagaggttcaaaccttgattgaatagtcgctacccaggtgtcataacctgtggcctcattggtgtcacctggactttttgtctgctgtttgcaccatcgaaagtgatgtgcgctggccgggcgcggtggctcacgcctgtggtcccagcactttgggaggcgggggtgggcagatcacaaggtcaggagatggagaccatcctggctaacacggtgaaaccccatctctactaaaaatacaaaaattagctgggcatggttgcgagtgcctgtagtcccagctactcgggaggctgaggcaggagaatggcgtgaacctgggaggcagagcttgcagtgagtggagatcgcgccactgcactccagcctgggcaacagagcgagactccctctcgaaaaaaaaaagtgatgtgcgcttgggactgggagggcgaggcccgaggtacctgggtgcccg

SEQ ID NO: 27597 - DNA, 1050 bp, Homo sapiens
ccagggttcctaacagcctgttttttttctttctttttttttttttagtgagacagagtctcgctctgttgcccaggctggagtgcagtggtgcggtctcagctcactgcagcctctgcctcctgggttcaagtgattctcccgcctcagtcttctgagtagctgggactataggcgtgcactaccatacctggctgatttttgtatttttattttttatttattgttgagacagggtctctttgttgcccaagctggagtgcagtggtgccatcttggctcactgcaacctccacctcctgggttcaagtgattctcctgcctcagcctcccaagtagcttacagtagggattgcgggcacctacgaccacgcccagctaattttgtatttttagtacagatagggtttcaccatgttgaccacctggtctcaaactcctgacctcaggggatccgcccaccttggcctcccaaagtgctgggattgcaggcgtgagccaccgcgccaggccctaacagccaccttcttagcatctgtatattcagaccgtccattgcaggatgtgtgatctttgtggcctggaatgtctctctctgagcactccatcctcccacccctcaggcagtgtctcttgaggccacctgcccagccaccatcttggggggaccacaggaggctggggagagagcgaggcagtagtgagaagccgggacgctcaccgttggccgagtaccttagagcagccctgacgcctgcttctgtctcttggtgaaagtggcgcccagacttcagtccttacagcccagaactcagaaccgtggaggtgctgtgacccacagggtttaccttgtaattgttgttaaaacccttctgggcttcataatggaatgcttatgttgaaatattattttaagtactattatctatgatgtggttagaaatgccaaagaatttttagcttttttgagacggagtcttgctctgttgcccaggctggagtgtagtggcgcgatctccgctcactgcaagctccccctcctgggttcac

SEQ ID NO: 27598 - DNA, 1050 bp, Homo sapiens
ggaaatggcctcagataatttcagaggtttttaaataaagaacgctcaaaatggagcaaaatggagagcccctgataggcctcctgcgtggaggtttgcagtaagccagaggcacctgtgggtcccagggagagacgggctgctccatggatgctcctgggacctggggcactgggtgggcctcaggcagataggagctggtccgtatctcttgccaagcccaggccaactcctgatgaagcagattcctgtgggtgacaagtgtcagaagatagaataggaccttagggtcaggaaggatttcttgaacaaaaaaggggaaaaacagattgagagattcagaaagctgtaatatattctgtgacctcaaaggtgacttggaggagggctgttgttcagcgacgggcgtgtagtgaacactggggcatttaaacggttcagatgctgaatttaatgttatatgttttttactacaattggtaaaaaaaaaaaaaaaagcttgtgctcatcaaaagacacaccataataagtaaaaaaagaactgtgaactggaagatacttgtaacatttttaaccagtgaagggtcggtgtcctggatatgtccactgggcaccacagacagaacggccttgaaggtaggctggagacgcctacccttatcaggccaggcaagcactggggagcctggccgtaccagtcattgttgaggctgcaggaatggcagggagccctaagttccagtggccactggtgcagtcctcagagagcagttggcacaccgcctcaggctgagcctgcccattcttgggcacccagaagttccactcttaggtatacaccagaagaattcttcctcgactgtttgtgctgaaggacaaggtttaagtttttaaaatttccagtgtcacagactgatgatatttttgtaaactacaacaaaagtgactagctagtaaaggaaatcacagaacataaaatacaaacccatgtcattattattaatattttgaggcagagtctcgctttgtcactcagactggagggcagtg

SEQ ID NO: 27599 - DNA, 2003 bp, Homo sapiens
gtggctcacacctgtgatcccagcactttgggaggctgtagcaggcggattgcttgagtctgggagtttgagaccaacaagatcctgactctataaaaattttaaaaaatagctgggcgtggtattgcacacctgtagtcccagctactcaggaggctgaggtggggggatcagctgagcccaggaggtcaaggttgcagtgagctgaaatgtgaccactgcactccagcccgggcaataaagtcaggcggggaaaagaaagaatgagttaacattttctcagctttatgtgttgagtgattttggattctatcctgaaatggtaagaatgaaaagaaaatctgccaagtccatccgttcctacactctcactgcctccaagtcattctgcgctcttgagccagaacgacctggccgtttttaaaaatggagttttttgccttagtaattgacttgtgtaagagttctttattccacttgtgaattgttttttatacgtacataatgtaaatattttctccccttctgtgcctttcagtatgaatctatctgaactcgattctgctgttgtgtgtgtgtcttttcctcagtaccagatggtcttgattactgtagatatatagtatatgtcttgaaatcaatagggtaaattctctaacttttgttctttttattaatgttgctgtggctaatctgtctgctacatttccttatacatttaaaaaaatcagtatcagtttctgcaaaaaaaaatcctcttggattagggttaggcttctgtcaagtctacagatcagtttggggagaactgacttctttatatcgaggcttctaatccgtgaacatgaggaatctttttcttatctttagtatcttagcaatttgtggttttcaacgtacagatttcataggtcttgttatttctttttctttttttgaaacaaggtctcactgtgtcacccaggctacagtgtggtggcacgatcatggctcactgcagcctcgagcttctgggctcagccatcctcttatctcaacctcctgtgtcactaggaccacagacatgagccaccatgcctatttaacttaaaaacaaaaacaaaaaaccgggcacggtggctcatgcctgtaatcgcagcactttgggaggccgagggggggattgactgaggccaggagtccgtgaccagcctggacaacatggcaaaaccctgtctctaaaaatacaaaaattagctgggtgcagtggtgcgtgcctgtagtcccgtgcctgcggcatgggaatgggttgagcctgggaggcggaggttgcagtgagttgatgacttaggatttttcttctcggtcactttgcaagccggggacccctggccagtgatgccccacctgggccctgcttggccacactggcgtgccccaactcacctgtgttatagcttgtactgtgttcggccattcccgagctcatgtaccgcactcaagatcaaggatacactggacattgaagggtgaggagggcggagaagaactttattgagcagtgaaacagctttcagcggaccaggggatgcaggggtggttcccctacctgaaggcaggaaagtccgcctgtgtggctgggtctggggctttttatggactcaggatgcggagtgcttgcagagcttgctgatgggtttgtgagtatgcagaaaaggttaaagtgggcatgacagtgtagaaaaccaattataagaggccgggcacggtggctcacgcctgtaatcccagcactttaggaggctgaggcagacggatcacaaggtcaggagttcaagaccatcctggtcaatgtggtgaaaccccatctctactaaaaatacaaaaattacctgggcgtggttcgcgtgcctgtagtcccagtgacttgggaggctgaagcagaagaatcgcttgaacccgggaggcagagattgcagtgaactgaggtcacaccactgcactccagcctgggcaaacagagc

SEQ ID NO: 27600 - DNA, 1102 bp, Homo sapiens
aaaaccccatattgatgtcatttcctaaatatttggttaaaaaaaaaatctgggcctggaattttatctggttttttttttttttttttttgagacggagtctcgctgtgtcgcccaggctggagtgcagtggtgcgatctctgctcactgcaagctccgccttccgggttaacgtcattctcctgcctcagcctcccgagtagctgggactacaggtgcctgccaccacttccggctaatttttttgtatttttattagagatggggtttcactgtgttagccaggatggtctcaatctcctgatctcgtgatctgcccgccttggcctcccaaagtgctgggattacaggcgtgagccacggcgcctggccttctggggattttttattacaaatataactttattaacagatgcaggcctattcagattttctatttcatgtcagtcttggtaaattgtaattttcaagatatttgtccatttcatctaatttttctaatttcttggcatgaagttgttcgtattttatccttttcacgcctctaggatctgtagtgatgtctttcctcatgttgctcaaagaaccaactcttttggctttgttgaagttatctgtttgttttcatggatttctgttccttatgatttccttgcttgcatttatgttgggtttatcctgttactttgtagcttcctgaggcggagccttaggccttgattaacgtgttgtactagtcagcattctgcagaggaacgttgccattatctgtgtctctttctaaaggagatttgttatgaggaattggcccacgtcattatggagacggaatctcatgctctgccatttgctgaagattgaggaaagcagtgggataataacagtccaaggacaggaggagacacgtggccccgctcaggctggcaggcgagaaggaaaacccaggccaactcctcctcccacccctttctattcgggacccccgtggactgggacgacactcacctgcacagggcagcgcagttggcttcatggagcccccagctcaggtgctgctcttaccaagaaacaccctcccaggcacaccctgaagtcatgttt

SEQ ID NO: 27601 - DNA, 1066 bp, Homo sapiens
aatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccagg

SEQ ID NO: 27602 - DNA, 1050 bp, Homo sapiens
aaaaattacatcatggtcccgtggcatctgggacagctgttatcagctgaaaccccccagagcagctgtaaggtgggcacggaagagctcagtgtgggccaagttgggtttaagggcctggttggatgtggagggggagatgatcgaagccttagggtggagagagattgccttggtaacatcatcagggtaggctgaaactttcaggtaagcagagaagatcagaagtgtttgagactgcagttcattgtcaccaggatctttggaggtttcccaaaggtgttagaaaaagaggtgttagtaagtgataaccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgaggtgagatgtgtccggctttcgtggctcctccagccagtctctgggagcagctgacctaaccagtgtgtgttggtgtctgtaatgaatggcttggagtggctcatgcatttaaattttagctattcatggaacatctttactgagagtgagagggagcaggaaaaacacggagaaatgtgcactttttgtccctcagaagagatgttcttgcaggtgttaggaccactgccttggcattttctattgcccagtcttttttttttttgagacggaatttcgctcttgtcggaagagatgttcttgcaggtgttaggaccactgccttggcatttcctattggccagtcttttttttttgagatggaatttcgctcttgtcggaagagatgttcttgcaggtgttaggaccactgccttggcatttcctattggccagtctttttttttttttttttttgagacggactttcgctcttgttggccaggctggagtgcagtggtgtg

SEQ ID NO: 27603 - DNA, 1128 bp, Homo sapiens
ccaaagtgctgggattaacaggcatgagccaccgtgcccggcctaaattgatttttctaagtgaagtagaaaactatttttggggctgggtacagtggctcacatctgtaatctcagcactttgggaggctgaggtgggaggatcacttgagcccaggagtttgagaccagccttggggagaacctgtctttacaaaaaataaaaacttagccaggcatggtggcccacgcttgtggtcccagcaacttgagaagctgaagtgggaggatcacttgagcctgggaggttgaggctgcagtgagctgtgattgtgccactgaatccagcctgggcaacagaatgagacccatctcaaaacaaaagtaaaaaacagttgctgcatccaaatcccttctaaagcttggtgatctggaggctaggggtgagagagggcatggtcctacctgggcacatgaaattctgtcagagaattaatgtttttgggggctggatatttccagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactgtgagcttccaaaaaagggcacatgtggcccatttagtcctgttagatcagtggcaggaatggtgggtggtgttggattcaatgcttctgcaggtcatggctatgctgtggccgagtctgtctgcacagctgtgcatatgtcaggccactggggaagtatttcagagagtaaatttcttgggcatgcagtgcaaaccgttgttttattcttgcctttcctctcttcccctccagcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgagtttgtcacacagcattttcctgtggacaggtttagacagtttaattttgttttgt

SEQ ID NO: 27604 - DNA, 1047 bp, Homo sapiens
tttttttgagacggagcctggcaccgtcacccgagctggagtgcagtggtgtgatctcggctcactgcaacctccacctcctgggttcaggtgattctcctgcctcagcctcccgagtagctggaactataggcgtgtgccaccatgtctggctaatttttgtatttttagtagagacggggtttcatcatgttggccaggatggtcttgatctcctgacctcgtgatccactcgcctcagcctcccaggatgctgggattagaagtgtgatttttttgtatttttagttagagatgggatttcaccatgttggccaggctggtctcgaactcctgacctccagtgatccacgtggctcggcctcccaaagtgctgggattacaggcatgagccccggcgccccggccagcatgttctcagtttaaggcaggatgagacttgactctttggtgtgtgtggaccgcattcgctcatctatgtagaccgcattcgctgacctgtttattcgctgacggacacttggaccactttcaccttttgactattgtgaataatgctgctgtgaatacgggtgtacagatatttgtcagagaccctgctttctattctttcttttttaataaaaattttatttatttttttttgagacggggtcttgctctgtcacccaggctggagggcagtggcgtgatctcggctcactgcagcctctgcttcccaggttcatgtgattctcctgcctcagcctcctgagtagctgggactacaggcatgtgccaccacgcctggctaatttttgtatttttagtagacacggggtttcaccatcctggccaggctggtctcgaactcctgatcttgtgatccacccaccttggcctcccaaagtgctgggtttacaggcgtgagccaccacgcctggtcaaaaattacacttttttttgtagagacagaatcttgggaggctgaggcaggaggattccttgagcccaggagctggaggctgcactgagctatgattgccactgcactcctgcttgggtgac

SEQ ID NO: 27605 - DNA, 1050 bp, Homo sapiens
atgggggagggatactgtggtgggcaagttcccatcctggaagggatgcttgggttgagccctcactcctgcctttttccagtgtgtgatcttggatgcttgggcggtcactctggtccaggcttccctcatctgcagggtgagaacaacggtagctcaaagcctgtgtcctggggctctggagatggtctgtgtgaagagctgagccggcacctggcacgtgcagacccgttgtgggtgttactcattttctctcctgagaaggcaccagagccacacgttgattgaactctttcctgctgctgacgaggctgtgccttctgctcccgcgatgcagcgtgtgccgtcagctcaggtcagataacgacagacggtgtgcctaccaggcaacctgattccatccagggattcctgccagggtagagcttttgtgggtagtttgtttatttttattactgtggattcataaaaggagcactgtttctcctgtcactggaagtgtgtagtagatgctgctcttgaactgggtccagaacgagtgctagtcagggggctgttctgaagctaatctgtgcaggtggcttcttttttttcattttttgttttttttttctggttttttttttttttttttttttgagatggagtctcgccctgtcgcccaggctggagtgcagtggcgtgatctcggctcactgcaagctccgcctcccgggttcacaccattctcctgcctcagcctcctgagtagctgggactacaggcgcctgccaccacgcctggctaatttctttttgtatttttagtagagatggggtttcactgtgttatccaggatggtctcgatctcttggccttgtgatctgcctgcctcggcctcccaaagtgctgggattccaggcgtgagccactgcacctggcctatgcaggtggcttctatccatttttttttttttagacagagtctcgctttgtcgcccaggctggagtacaggggcacgatcttggctcactgcagcctctgcctcccgggttcaagtgattctcctg

SEQ ID NO: 27606 - DNA, 1047 bp, Homo sapiens
aagtgcatgcacccctgtaacccacactcgaccaaggcatagagcatttccagggtgggcaccgtggctgacgcccataatcccagcactttgggaagccgaagcgggcggatcacttgagatcaggagtttgagaccagcctggccaatatggtgaaaccccgtccctactaaaaatacaaaaattagccaggcgtggtggtgcgcacctgtagtcccagctaccttagaggctgagacaggagaatctctgaacccaggaagcggaggtagcagtcagctgagatcgtgccattgtactccagcctgggcaatagaatgagactctgtctcaaaacaaaaacaaaaacatttccatccccgcagaaagtcccctggtgcctctcaatcaatccatactatccccattcgttggcagtcatgcttctgacttattttaccaagattagttttgcctcttttcagacgtcacataaagggagtcatatagtataaactgttttgggactggtttcttttgttcagcatgtttttgaggttcattcccgtggtcactggtttcctgagtcctgttgatatgaccctggcagtcttcagtcacttccttgctttctgctaccacaagatgctccgtttgtccttgtttgtgtctgccccagacctgaaggaagccacataaagggcaggtgtgtggtccctgactgtcaaccagggaagtccgtctcatcctgaccagcagcatgctcaccacatgagcctcctgtttttatctccttttctgtgacgtggtttctcgtttgacctttcctagccctcgagcatgttccaaactcggttcgcttgtggaaagcagccgttgagctggaagaacctgaagatgctagaatcatgctgagccgagctgtggagtgctgccccaccagcgtggaggtgagtctggcgggctcagggccaccagagcccaaagtggccaaggcctgagcccaggttcagtgtctggaagtgatgatacaagtggagcattgagctcactcaggctgcaatttc

SEQ ID NO: 27607 - DNA, 1050 bp, Homo sapiens
tatggctgcctttattcagaccgtggtgacttgggcttgggtctgtgggtgacctggtcctgtgcttatgtgagccccagtccatttgtggctctgtagaggcccagatggggctctcagtgtaccctgcaccgtggggcatgtgttagcacactccggtccccagggtccctggagggcagtgtccactctgactaccctgtcctgggctggcccagcctccttctcccctgccaggctggtaagtcgggagagggagaacatcctcaggggtcatctgtctcccagccacggaggggcactgcagggccggatgcctgaagctgtgtgtttctttttgttgcttgtcctggcattggtgacagccagctggggctgccacataggctggagggggcaggcctgtgttctgggggctcatccaccccttcttgctcagggacaggcaacatctatccatccatttgttattgagcacctgttgtgtagtagaccctgttttaggggttaggaatttggcagagaacaaaacagacaggtccctgcctgtgggaagcttccattatggtgagaagagacagacaatcaacaaatccacaaacaggtgtggtgactcatgcctgtaatcccagcactttgggaggctaaggtgggcggatcacctgaggtcaggagttcgagaccagcttggccaatatagtgaaacccctgcctctacttaaaaaaaaaaaaaaaaaatacaaaaattagccaggcgtggtggcgcatgtctgtaatcctagctaccctggaggctgaggcatgagaatcgcttgaacccaggaggcagaggttgcagtgagccaagatcgcaccactgcactccagcctgggtgacagagtgagactctgtttccagacaaaagcaaaaacaaaaaacaaaaattagctgggcgtggtggcacatgcttgtaatcccaggtagtagggaggctaaggcacacgaattgcttgagcccgggaggtggaggttgcagtgagccgagatcgcaccactgcactccagcctgg

SEQ ID NO: 27608 - DNA, 1030 bp, Homo sapiens
cagggttgagtctgggttcctgtgaccagcgttctggactggggtctgccctgggaaggggtgggctcccactcattcctgctgggtgcagcacccccatcattgcgttcacacacaccccggaaaactggtcagcacaaagtaggggtctgcgaaccattcatagctgtttccagagatgacccgagaatggagttgttccccttcttaaaggagacaaaacacaaacgataaaagctgtaggtgggagaagcaaagatgggtcatggagccaggggagggctgggtggggctgggcagaactgatggggggtttctggtggaagaacagcttgagtagaagccccaggggagaatgaggaggggaggcgggcgctgtgcagtggggagtgggagccagcagagcctcctgggggtcccagtgcctgaggtcccctcggggacctgggggccaggtgtgggggtttttttgcctctggacctgagcccactgagagccacgtaagcaggtgcagggctttcaggggacagtggccttggctctggctatcacctcaaggctggactctgtacagcccaagaggcagggcctgcctgggagggctcaggaggggctgcagcgtgagcagactatgccacccggattgctggggttgtgcgggcggtaggtgggacaagcccctcccatggcctgtgggtcgtgggactctgatcaggtcaccttagggcagagggaatgatacacacgtggaaacacatgcacgtgttacagaggagatggggtgttgcagggcacagttgcagttttaaacaggagaggccttgctgagaaggtgttgttgaaataaagcccgggagggagggagggagggagggagacgttgtgggaggccgccccaggcggtggagctgcaggtgcagagggcctcggtggcggctcagcgcccttggggagcactgagttgccgggcctggtgtggaaatgtgaccggtttgtgcctggcctcgtcagtgttgaggacctggagga

SEQ ID NO: 27609 - DNA, 1768 bp, Homo sapiens
cctgacccactggggacctcatggccctctccctcctggctgctgggcacaccccatggacatctgggctggactcaagataggcagggccacaggccactgttggactctggcagagtagaacaagcaggggttggtgggggattatgctgtggcacctgctgcttctaggaccagtgtctcgctggggtgcctgcagccttgagtctgaacccagctggccctggctctctgcagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccgtgagtgcggccggccctggctcctgacacccgctgtggttcacagggtggcccgggcccctgcctgcccgcagaggcctgcttccagcggggtgactgtcctcccccagcccattgctgtggccctggcaggggctaggggcctgtgcctggatcgtgggcctcttgcagggacccggatgtgccctctaagctgccagggtgttttgcaggcagaaggggtggcaggtggagaaaccagtgggggaagctagtcagggctccctcttgcagatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggtgagcccctgttggaggggctggagggctgctccctcggagcggtgggctaagccactggccccgtgctccaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgagcggccgctgggcaccctcccccgggcccggtgtcttcagggcatctggtgcccctccttggagcccatgcctattcccgcctctgctgcatgaatttcccgagcctctcagtccctgagtaggctaaggcatgatggccaccttcagggaccactcccctctacccaggacctctgggctccacggggcggcgtcttgggtggtgggacccacttgttgcggatactcaagtcagagggcctggcctggcc

SEQ ID NO: 27610 - DNA, 1047 bp, Homo sapiens
tcctgttgagggcagggaggtacagtggctacacgcagccctgagggaggctgaggtattgccaccttcaatagccagagctgcatcccacacacggggctggactctcccggctgtggggtgaggctgggccgcatggcctatggcaaatgcccctcaaaccctaatgcatccacggtcaacctggtgagttctgactcagcctggccaggttcccctggagctggccccctgagcacgtgttgagttggggtgggggagctggagggcctttctcgagcagaacttcagagaggagcgctggccctgtctttcctgattctgaacgtgtccaagtcgtttcatcacgtgatggattaccaggctggttggttctaccgaaaggcagcagcacaagcttttcctggatttctcaccattgttcctttaaataatcagtcttaattaactccatccgaagaacatattttccccaagggtagggagtcccagtcaggtggagcaagttggaactgcaaactgcatttgatagctgtggtgttgggaggagccccctggctactgcgaggggtgtctccgtgatgggcgggcagatggatcagcaccaacccctgctggcactttctgacatttctgttgccctcatttgatagatcgggaaactgagtcacagaaaggtttggcaatctgccccaggtcacttcccctaagcacagacgtccttgtggacgaggagaagaggcagaactcacaggggaaaacccttcttccacacagcatctgctgtggccagctgcccccacctgcccctgtccccacctgtccctgtccccaacctgccccacctgtccccgtccccacctgctcctgtccccacctttcccatctgcccctgtccccatcctgtccccacctgccccacctgccccacccatccctgtgcccaacctgccccacctgcccctgtccccacctgttcctgtccctacctgccccacttgtccctgtcctcacctgccccacctacccctgcccccacctgcccct

SEQ ID NO: 27611 - DNA, 1032 bp, Homo sapiens
tagcgtatttacaaaggagcctcctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaaggtaagtcaacgttacgttctttctgacaaaggcagatacccaacgcttggcttttcctcttggacagagacagggagagggcgcgcgggcagagttaatttctaagatgaaggctctgtttgcaggaaaagcaggtctgaggatggctttttgaaactgctctggaggacgggggctttcttctcctccctggcctgccgtgtgctgtttttctcctgtctctctgttgttcatgctcctctgagattccaggggacatgttgtgcgtctgacagaggagacattaggggaaggggagcgcatatcaaaaccagaaactttatgcgcatttctggaagaggaacaacggatatgtctgtggccgtgggacccagcagccccgtacctggggagagcactggccgcttaagcagaagacctctctgaagcagggtctcagagtctggggtgtgtcatgtgtgacccccacccaaggtactgaggagaggtgctcacgtgaacgttttgtctgcatgtcatgcatttctcaacttaaggatcaatatctagggtgcatgcgtctgtgggatagatgtgcagaagtaaatatcggccgctcctctcagccccttttttcgctacgtgtccgtgcagctgtggagtgtggttgtttatggtggtagtgtaactggatttttgtatttaaaactaaaaatcagggttagctaagaagttgaacaccctaatgccattgtctgtagttc

SEQ ID NO: 27612 - DNA, 1036 bp, Homo sapiens
tcaagggaatggctaaacagctcctatctgggcgtttgatagactgtcattcaagaatgagtgaagttgaggtgcctataagcaactcagaaattgttgtggccacgcttgggggaaatagagccctacactcaggtgatgagaggagacctcagaggtgaccgatccagggccttgctccctgcgccaccccagctcgtacctccagtggaacttggctgggcttatcaagagctcctttcattcattgcaacttcatttgttagaaagcttctctgtgtatttagtaggcattgtctccaacatgtaccactggtctggcttttgttaggcccattaatagtgtacatgtgacagcctttcaagtataggtgctccccggcttacggtggggtcgcatcccagtaaacacatcgttaaacctgaagtcgaaccatccgaagtcggagaccatctgtatttgaaaaaagtccctttgcattgcttgtaagagttctggttttcaaggtgagaaatctgtttgtgtgtttgtttgatcattctgcccaaaggagatgtggctttgggtccttttccccactcatcttccacaatgaattactttgtccatattaccctaaagaagtgacatccaagttggaatgtgatcttccgtatgtcgcctcccaaaaccccactaccatagcttcatgcttgtgttgacacagccacaatcacaactcaggtgtcagttctgagaccttcccatgcctgtcgccactcagcaagtgttcttcatgtgccctggcagttcgcattgtaaggagcagccaggttgttatggactgttgctagttaccacagagtagtgaattatattaaggattaattacagcagacaatgtgcacagtatcatcgagtgcagcgttctaaaaatgattctacacttttactttgaaaaattggatttgaccagattgtagaatctgggtgaaaatgataggatttggtttggcgaagagctttgttgtcggtgtttttggtgacatcatgact

SEQ ID NO: 27613 - DNA, 1616 bp, Homo sapiens
ggaaacattcacctctcagccccgtgcatctactcggaggtgatggaagccctagatctgcagcctggactctcgtttctgaacctgggcagtggcactgggtatctcagctccatggtgggcctcattctaggtaagtgtggaaggagagtctgaaaactcatctgtctcagggaaggaggcatctcctttgacagaaaatgtagtctgctaatggcctgcctgggtcgagaccgcagccttcccagtagttatctgacattgacacatcactgggtggtggatagagggatgagggaggaaggcctgcatgcatctcatgggccccggattctccagagggacctctcctgttctctgtcccctcttcctgtgctgccacagcctgtactgcgcacctgccctctggacagcggaggataaagacagttgtgtaaatcttgaccccactgtgatttctcgatttaattttatcactcattcttccttgtcactccttctctaaatcgatggtaattaacttgaaagtcctttcggagtacttctaagcagtttttgttttgttggtttttttttttttttttttttgacagttgtgccccatcgtctaggctggagtgccgtgacacgagcaaggcccactgtagccttgacctcctgggatccagcaaatcctcctgagtacctagggccacaggcacgcaccaccacccctggctgatgtttaaatgatttttagagacggggtctcgccatgtttcccaggctggtctcaaactcctgggcgccagctctccacctgcctcagcctcccaaagtgctgggattacaggcatgagccaccatgcctggcctacttttttgttttaatactaagagtaatacctgtagattttaaaattagtttcagggatggaagggatttcactatgaagctatttagcctattttccaaacaaatgagttgtgagactgcacatggaaatatggctatttttaataatagcagataactaaggaaaaacatcacttggtgccaaatgctgtgaggggcggggaaggcatctgtttttaactcagtagggtggaaaagttttgccggaggggtgataggagctgatctgtaaacaggaagcaggggccaggctgctgaggcaaagctggctgagaagacgctggatgaaaccagtgcagagaagctggagtctgtattttttctaaatcctgttagaactgacaggatttacgggtggactgtatatgcttgtgaaagaaacgtcaggaatgtggcttggcttggtggttcatgcctgtaatcccagccctttgggaagccgaggtcggaggatcgcttgatcgcttcaagattgcagtgagctatgattgcaccactgcactccagcctaggtgacagtgagactccgtctataattgatttttgtggatatggaatgataattttgttttttttttctaagtctgtataaattggaatttggtgaagttttgagaccgattattttggctttatgctatagattgctaccttcaggtgtaaaagtgtgtagatttttataatgctttttgaccgtaacttctcttcaattgagactgtt

SEQ ID NO: 27614 - DNA, 1028 bp, Homo sapiens
ccagccacagcaagatgcagagttgaatcagcaccccaaaaggctcccatgccccctcctcctcctagaaagttcaccagtgttgcatcttccagaaaggtgatgaccgttttgcctttgtcggcaaagatgaattttgcccgatttttaccttcatgtaagtggattcccgcaacagagagacccatttaagttgagtgtcaatactgtgttcccagttaacgtaggggcagttttatatcgggggagcactgtcatcattaagtggacttgtaacatttctcagttgtatttcaaattactgataaatatcctttgatataaaaatgtttcattgtgacttggaagcatagttttatcttaatgatgatgattgaaccctgttttgtgaatattataatgctcacatctgagtgttctgggcaacttttcagggaaaacagaatcgtcttaaatgttacctctggacaaacaggtgaggcctgtgtcagttccatttgcaaatacatgtttcttctttagttcattagtaagacctgaacacttggtttgtctccattttcaaatgattctttaaaagtttgtgagcagagaagcccaggcctcaagtatttacgatgtggtgagccgtgatactgtgatgagacttcaaaactttgtgaatgtctgtagttacacatgttaagtcagacgtgttacagttggtagaagtgaacagatgagcaagagttcttactctggttctacatgttttcttattcttaaaccttttaggtccttttggtgtgaaccatggggtggaacttcactcagatgtgatagagtatgcaaagcagaaactggacttcttcatcagaacaagtgatagttttgacaagtaagatgaaatactatccattggctcagatgatgtgaactgtaattttacaaagttttgatcagatagaaagaaatcatgtggtaggaaacataattaaactgtggtgggatgattctatgtgcctgttctaattttcagaaaagattct

SEQ ID NO: 27615 - DNA, 1123 bp, Homo sapiens
aagtagctggcactataggcacgtgctgccatgcccagataaatttattttttaaatatttatttatttatttatttatttagagacagagtctcgctctgtcgcccaggctggagtgcagtggcgcgatctcagcttagtgcaacctctgcctcctgggttcaagcgattcttctgcctcagcctcctgagtagctgggattacaggtgcgtgccaccacacccagctaatttttgtatttttagtagagacagggtttcaccatgttgttcaggctggtctcagagctcctgacctcatgatccgcccacctcggcctcccaaagtgctgggattacaggtgtgagccaccgtgcccggcctaattttatttttttagtgatgggctctcactgtgttgcctgggctgatcacaaactcctggcctcaagcaattgcctcacctcagcctccagagttgttggcatgagccatcacacctggcagaatattgttttaaatgtctttgcttatacaagtgatattacagatctttgttgctatacaaaatgcattggattttttattggaattgtatcatctcgataatttgaggattgtggccatctttacaatgtttcatctgcttatctagaatatgaaataggggtttatatagttttatttaaggttttatacatcatttattgattctattgaaatacttgtttttcattgtaactagaaattcttttaaaaatgtttaaataaacatatgttttgctggtatacaagaatgtttgttgatatttacttagtacgtggcgacttaatccttttagttataagattcatgacatagaatcttagtttttagaggatttactgacttagatatttttagaaaaggccagcatataatcatagcatgaaagaactgaccagaaatagttttgtgacctgtgtaggccacttggagactgacccagccacacagagtgcacagagggtcatgtctaattgtggtctctggtgctcgtaatactttaattcaaaagaaatgttttgatggcctacactggagtgtgttaagccaccagattccggtgctttcgtgggggtgatatcagggcaaggctcatt

SEQ ID NO: 27616 - DNA, 1050 bp, Homo sapiens
caaggttttgccatgttgtgcaggctggttgctctccaaatcctggggtcaagcaatctgcccacgtcggcttcctaaagtgctgggattataagcatgagccacgtctggactaaaaaccatgcccggcagtggtttttattttattatatttttatttttattttgtttatttttttgagacggagttttgctctcgttgcccaggctggagtgcagtggcgtgatctcagctcactgtaacctccgcctcttgggttcaagtgattctcctgcctcagcctcccaagtaactaggattacaggcacctgccaccacgcctggctaattttgtatttttagtggagacggggtttcgccatgttggtcaggctggtctcgaacgcctgacctcaggtgatccgctcgcctcgacttcccaaagtgctgggattacaggcatgagccaccacgcctggcctattttattttattttttatttatttattttatgagacagagtgtcactctgttgcccagtctggagtacagtggcatgatctcggcacactgtaacctccgcctcccgggttcaagcgattctcctgcctcatcctcctgagtagatgggactacaagcgtgcaccaccacacccggctaatttttatatttttagtagagacagggtttcaccatgttggtcaggctggtctcgatctcctgacttcaggtaatctgcccaccttggcctcccaaagtactgggattataggtgtgcccagaaggggttttatttttaatgatttctaggtaggtaaccatttaatttggcttccaaactgggacatatttgagaatacagggagcagaaagggtttgctgtgaacaattgtgccaggactctaggtataaaccaggaagatctcagacagatgaggacaaatggtcaccctactaggttaccaggaaacagcagtcaagccaggaggacaggtttaccgaggtgaaaagttactcctattatctttctgtcgcacttccaattgcacatggctccaaaccagctag

SEQ ID NO: 27617 - DNA, 1039 bp, Homo sapiens
tgtgaatttgtctttcagtggagacgctgctaactccctccctgtgtcgtctagcagttgatctcactctgtaattcatacatctttagctcacttgaattttctgtttcctcttccctttttatgtcacagtgagagcctatacatttagttggaataaagtatttgtcagagtggcacacgtgggagtgctttctccatctgccactgacatttaatcactaggctgtggggttgaggagggtggtgttggggcctgaaaaaaacagcagccgaaatccacgttgggacagcatcctcctctgggaaacaccggtagtgttagaaacaggccaaagagtctgcagatctgtttagagagttctgcagtgagcatcaccttaacagtatgggaaaaataatgtcatttactgcaagccagttttttccagaggaacaataactaaactaaatcacttactatattctgcacgtatttgttgcgttcccacagagtgccaaaaattttgaaatagtaagtaaattttgaaatgcaggattaaaagtagaattggaggccaggtatggtggctcaacgcctgtaatcccagcactttgggaggtcgaggtgggtggatcactagagcccaggagtttgagatcagcctgggcaacactttttttctctacaaaatatatatacgcaaaaattagctgggccagtggagcttgtctgtggtcccagctacctgggaggctaaggcaggaggatcacttgagcccagaaggttgaggctgcagtgagccatgatcgtgccactattctccagcctgggtgacagagtaagaccctgtctctaaaaaaaaaaaaaaaattggaacagagtcttaagagaaatgagttatgggaggtatgatttgaggatttgagttcagaattaagtaacattctggcaaatggtttgccaaaacctcatggaaattcagttgactgcatagtggtttttttccccaagatacaagatttcctttctcccagattgccgaatagcttatttag

SEQ ID NO: 27618 - DNA, 1030 bp, Homo sapiens
ttacccttgcccttctttttcctcagaacacctgaacttttgttgtattattttgtatctccccacttgcatgtaaactccctggtgaccttgcatgtcttatgcaatcctcattaaaaccttttgtttttttttttaagtgggttcgttttccctcaggatcgaagagtattgaatggaatggcacgaggaaaatatttaacaccctacttggcttgtaataataggtgcttaataaattgtagttccactctccactccattgccccctttctctccctacacacacacacccacccacccacacacacacacacacacacacaaagtaaatggaagtattgttgcataaagagcatctcaaaatcctaagaactttgcccttgagtttgcagctataattacaagccacaggccagactgaactaacatgacaagtaactttatttaatgagaccctgataaataggtatctgaagactaaggaatgatcctggccaatttagtagacttagatgctgcagtctccctgcttttcccctgctgtattacctgtgtgtaatataggttgaatatcccctatccaaaatggttgggaccagaagtgttttgaatttttttggatttttggaatatttgcggaatacataccagttcaatattcctaatctgaaatttgaaatattccaaatagcatttactttaggcatcatgttgatgcttaaaaaatttcagatttttgaggattttgtattttcaaattagaaatgctcaacgtgtaatacgaaattcagactattctccaagtaaaacatatgtagatggtgtcacaagatgttctggactcaatcctatgtaaataagtacttcctagactttatagctctcctttgattctgtgctaaatttaaccattagagaagcaatgtaatgttactgcaagtggtctacctctaacagagttctgtctggcagtgtgatttttttgatcagttaacctctctgaatcttttcttcacaggtgatttaa

SEQ ID NO: 27619 - DNA, 1063 bp, Homo sapiens
accccttaacaaatatttgtaatttctgtggcccctatgtaagttaatattaaattttcaaaactcgtgaaaacacctgacgtgctagcttctggtatactttatctcacttaagagtcagcaaataaaacagtaaactttaactcagttctcaaagggtaattgtcctaaggattgtgtaaatttctgcttatagatgctaattgaaaatttacttacatttctaaagtggggtcaccaaatatcttgttcccagtagccacaagatcagcttcctagaagagagaattgctaaaagttggctaagctttcttactaaacaagagttgacataaagcctgctgttggagccttagaaatcccctgaggagattgtgccagcagagatacttgatctttccattggctcatgcagtttgtggcaagcaaggctttagaaagttacagatatgattgcccagccctgggaactgtaggaacccaagttgcccttcaggaaggacaagaatttggccaacaacgtcggctgactgaaaggctgggattaacaaaccccaaagattatactactcagttccctttagtttgaggttggaaacatttcagattggatttgatgacctaaatcaggcattggcaaacttctttaaagggccaaatagtaaatattttaggctttgtgggccatgtagtgtttgtcacactattcaagtctgctgttgttgcacaagagcaaccataaacaatatgcaaacaaataggcatggctatgttgcaataaaacattatttacaaaagcagacatcaggccaaatttggcctgtggtctgccaacctctgttacagactcttaatggctaaagaattactgttcttagaataagaggtttgtagtaaagatctgttttctttctttgaggggtctgtggaaataatctaggatctggacaagacagaaaaatttgaagtggtgcaatttgggtatactttgggtcttttaggacagaaaacatgttgaaacaactgtgtcagaaaaagatctctaagctcagagagctgagtt

SEQ ID NO: 27620 - DNA, 1055 bp, Homo sapiens
tggattggtataagatgacatggagctttgatgtatgagaacaagcctttattctcttcctggtttcatcaaatatgagtcagaatggcaagttgtactcttagctttgccgccattctagaaccttttagcacccctacttaagttacagaaagctgctgaaaagaaagtatttttcttgccaataccttttgtagaatatataactagtggtaatgctgatgtatctatcctcaatgccatttttctcttccaggctgtcttacaaaaatcattcaaattttgcctgcagaggtaacaggatatttggcaaaatatgattaaagcaaatatcagtttactgtatttcttgggatttttcttctcatgttataggaagcactggttaacacagttgagctatatttattggctgtaggtaggagagccagaggtatatttcaggccattattatttgtaagattatttccttcccatataccttctgtaaatgattccttggactttgtgcattttgtttctgcagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatgggggtaattgtttttgttgacttcattatactcactcaaagggctgaatcttgtggatctgttgagtagtttttgtcagaaaacctccgtgactctgtatgtgtatacctcaggatcaaagcccaatttgtgttttcttttgagctgaaaatttggttttgcagtgaggaagcagagttgctttggcaagtgaacaattttaatgggcttaccatttaaaaatcattttagtttcttatccttttctatgatgtatatgcagtcgtgcaccacataacaaagtttgaattaatgacagaccacatgtaggacagtggttcc

SEQ ID NO: 27621 - DNA, 1050 bp, Homo sapiens
gtaagcactaagtaagacaatttaaaatggaacttaataagaaaggcagtgcattttgttagattgccttaagatatactagtattatgaacagtggagaggagaattgatcttccaaatatctaggactcaggcactttttccatcttccaaataagctgctataaaaattggtaaaatcaagtttcttcagtattctcttaatttgaattatcgaggggaaaaagacaaatcctagttgtagtcctgtgatttaatagaagctgtagtattgggaaagagagagagggaagggaacaattactcaagaacctttgacttggttttccagttctcctagttgcgtaccagatgacctgaagtatttaggaacaccctatactttggatgcaacttcattttcatttcatttttaaaaaataaaccaagattaatttgatcaccaaatagtgtttactgaacgtgctacaaaatgcaagccttaggctaggtactataaattaaaaaggtaaattaaacatggttcttaactttgtagaacttagggtccaattgagaaattaagatttgaagactggtgtgtgtgtgtgtgaatgtgcagtagaaagtgattgtgttctgtaggagtgagaagacttgaaccttggaggccaactcactgtctttgaatcccagctgtaactgtattggatattcttggtcaagctactgaacttaggctgttcttatttgtagattagagaaactaatgcttgcctcgtagagttgttggaagagttagatacttaaagctgagaaactcttagttccagacttgtaatatctaactgcctattcagaatcttcgtttgaatgattcaaagccattttaaccttaagtccaaaacctatcttgtgcactcttatctccatgaatggcaccaacagtctgtcaagcaagaaatccaagagtcacctcccacttcatacagcattttccagttcactcagagctattgattttacaccataaattttgttcctcatattagtccactgatctccacatgc

SEQ ID NO: 27622 - DNA, 1054 bp, Homo sapiens
tcttttgtataatcagtgtttgtttggagctgtctgtaaattttcctcttttttgctctttattttttctttcaactcagaccttccaaaatgggattatttttcttttttctttagagacatttgcttgataacagaattttaatttggcggctatttatttttttcagcacactgcaggtattaaactacttggcttcattgttggttttgaaaaatcagctgttctaatgttgctctttgaatataatctgcctttttctgtacttgcttgtctttagttttttgtttttgtttgagacaaggtcttgctgttttgcccaggctggcctccaactcctgggcacaagcaatcttcctgtatcagcctcccaaatagctgggactataggcctgtgccattacacccaactcatctttgttttttcctgctattttgtaattatatgtttggttttggatttctttttattgatcttgtttggaaattgtttgcttctggaatttgattgtgtctgattgcttctgggatattttcaactgtcttcagttactgcctttatcccattctcttttctgctagtaccaattaaaagtatatcaaactggctgggcacggtggcttacgcctataatcacagcactttgggaggccaagatgggcgggtcacttgaggtcagaagttcaagaccagcctggccaaaacatggcaaaaccccctcactactaaaaatacaaaaattagccgggcatggtggcatgcacctgtagtcccagctactctggaggctgaggcaggagaatcacttgaacctgggaggcagaggttgcaatgaactgagatcgtgccactgcactctaacctgggtggcagaacaagactttgtggcaaaaaaaaaaaaaaaaaaaagtatatccaacgatttcactatatttttcctcttgttttttgagatctgctaggacattgtatttaaaaataaataattggctgggtgcggtggctcacacctgtaatcccagcactttgggaggccaaggcgggtggatcac

SEQ ID NO: 27623 - DNA, 1008 bp, Homo sapiens
aggaaagtagaatgatgtctcaccaaatagataataacaataaagagatttaaaattagatttataaaaggaccaaatggaaattttggagttggaaatcacaataactaagattaaaaattcactagaggggcataacagcaaactggagcaggcaacaagaaagtcagcaaacttgaagttgggtcaattgagagtagtcagtctgaaggacacaaagaaaaatgaataaagaaaaataaacagagcctcaaagacctatgagacattatcaagcataatgccatatgcgtaacaggagttccggaagcaaaggagagaaagattcagaatatttgaagaaataatttgatggaaaaacatttacctacacatctaagcagcataacacactctaggataaactcagagacctacatgtagacacatcataatcaagctgttgaaagtgaaacacatggagagaatcttgaaggcagcaagaaaaaaaattgctcaccaggtacaagggatccccaataagattaacagctgatttctcattataaaccatggagaccagaaggtgatgaaatgacacattcaaagcactgaaagagattgtcaatcaagaattctatatccagcaaagctttccttaaaaaaaaagagagaaattaaaacattcccagataagcaaaaactaagagactttattgttagcaaatctgttctttaagaaatactaaagagaattcttcaggctgaataaaagcactctagacagcaacttgaattcacaagaagaaataaagaacaccagtaaaaggatacagtagaaatacatgttatgtaaatatttatatatttttataaacctttttcctcttatctgacttaaaagatgactgtgtaaagaaatggttatgaatctgtgttgatggtcatgcagtttatgtataataataacaatacaaaagaaataaaaggcatctatattggaaaggaaaagtaaaactatttctattt

SEQ ID NO: 27624 - DNA, 1033 bp, Homo sapiens
tgagaaactggatgttttcccccctaatattgggaacaaggcaaagatgtcccctttcgccactcctatttaatattgcactagaatttcttgctagtgcaataagacaagaaaagagaataaaaggcatgccaattgggaaagaagaaataaagctgtctttatttctgtgtacagtgtggcatgattgtctaacatagaaaatcccaaagattcaacaacaaaagactcctggaactaataagtgattataggaagttcacagaatataaagttaatatttaaaagtttagtgctttcctttatgccatcaatgaacagttggaagctgaaattagaaacataatgccatttacattaccaccaaaaataatgaaatacctaggcataaatccaacaaaatatgtacaggatcaatataaggaaacacagaaaactctgatgacaaaaatcaaagaaaatataaataaatggagagatattccatgtacatgaatagcaaaactcaataattttaagacgagaattctccccaaccctatctatagattcaacacaattccaataaaattcgaataagttattttgtgaatattgacagattctaaagttaatatgggaagtcaaatgacctagaatgaccaacacaatcctgaaaaggaacaaagtcagaggattaacactacctgactttatgacttactataaatctacattaggcaagactgtgtggtattggtgaaaaaacagacaaactgatcaacagcacagaatagagagcccagaaatacacccacataaatatagtcaaattatatttgtcaaagaagcaaaggcaattcagtgcaggaagagggaagaggagaatctttttaacaaatgggaaaatccagacagtccttccaccttttataaaagttagatcaaaatggatcttagacttaaatgtgaaacataaaactacaaaacttacagaagctaatataggaaccaatctatgtggtttgtggtttggcgatgagtttttaaattc

SEQ ID NO: 27625 - DNA, 1217 bp, Homo sapiens
cccagcactttgggaggccaagatggatggatcacctgaggtccggagttcgagaccagcctggccaacatggcgaaaccccatctccattaaaaatacaaaaattagccgggcgtggtggcaggtgcctgtaatcccagctacttgggaggccgaggcaggagaatcacttgaacccagcaggcggaggttgtagtgagccaagattgtgccattgcgctccagcctggatgacgagagcgaaactccatttcaaaaaagaaagaaaaaatgaggagtaagctctgttacagctgcctagtattcgtttatgtaagtgtgctataatttacttggctagtgccctattaatgagtatttgagtcatttccagtattttgctattataaacaatgctgcagtaactcaccttgtacagacttcattttccacgtgtgcacatgttgccataggacttactctcagaagtgggatgaggggctcaaaagctgtgtgtagtgtttttgagaggtcttgtcaagttaccatctctaggggttgcactctggactgccaccaccaggctataaaggtgcaatctcctcccagccccagcatcacagtatattgttaaatctttggcctctggacaataagagtaaaacatgatatcagtggttttaatttgtatttatctattacccatattgtgtgagaccacttctgagacgtcatacttatggagaaagtcatttcgtttgtcttgagtgtgtttcctaatctctttcctccccatttgtggaaacagcttttgttctgccaacactacaaaattcccaggagacaatagggacccagggttgccaaattttagttggattctgtctttccatcaaacctaggaattttttcttggctctaaccaggtaaagggatgtttttcagtgacctgagacccaaggaactttataattaggctctgcatgatgggtaattagtctgcttccctctcacccaggagaattagaaatttaaccaagatgaaaagacagatttctgtctctctcttttccagaatacacattgctctacttcctctataaaatatcactgatttatctccaaataaactgctcaactttcaggaacttgaagccatcccactcccaggtgtctgggtttctgttcctgcagggcagagggttggcagtgtgaggaagaggctttgtagtttactt

SEQ ID NO: 27626 - DNA, 1027 bp, Homo sapiens
aaggagaagtttgagaaagcatttccaatataaatattatttttctaaaaccatcgtaattgtaaagcttgacaaaatcctggctggtgggaatacacagaatatatactgaaaggaggcttgttcattgcattagtttttaaaaatgatccatagcgtgtgtgtgtgttttctcatctataaaatggagatacacccctctcagaggatggttgtggtgattcagcgaggtcgtggctgtgaaagcccctttagacaatacctgcacagagtcggtgtaaatgtcactcctgttttttctgctccccacccccttaactgatatcagctattttggcttaacagcttctttctcatcttaggcctgcctgaaaacgttatagttccctttctggcaggcggtggtttcaatgagtacgtatactttgaattattataaatagttgagggacaggctgcctaaagtctaattggagagttaacctaatgtctgtgaaactaatgaacaaaacgagatagtgtagatcaggaatgtccagtcttttggcttccctgggccactttggaagaattgctttgggccacacataaaatacactgatactaatgatagctgatgagctaacaacaacaaaaagcaaaaaaaaaaaaaaactcataacattttaagaaagtttacaaatttgtgttgggctgcattcaaaactgtcctgggtcgcatacggcccatgagccatgggtggttggacaagcttggtgcagagcttaggcatttacaggtatatgagatttacctattcactatttccaatcaactcttgtggcctatcgtagtgtcatttaaactgtgtgtcccagcccacactttttgagtcccacatgctttgaggctgatgcagagaagcagcttctctagtgctagtaatgtgggtgacattctcctctgagctctactttgtaattctgtaagtccatgtttttcacattcacagaaaagagtaagtttgcttttcagtcattctttaat

SEQ ID NO: 27627 - DNA, 1001 bp, Homo sapiens
atgcagttgccttctctcacttggattggacatgcttacattcaggtctagaagatgggagttgggcattcaagcttgatctttcccgacatgtggttttggatgggaagtctggtgctgagagttgtagcattaagggatttggtgtctgttatttcccactgtccttccccaagttggggaggagagtgggaagctgcattgtactgtactcttctaactctttcttcttatgtcctcttaggtgatgaccccacaaggaagaggtactgttgcagccgctgcagctgctgccacagccagtattgccggggctccaacccagtacccacctggccgtgggggtcctcccccacctatgggccgaggagcaccccctccaggtgaggagcccataaggagaccagtgctaattgatagaagatgccttagctggattaatgatgagatataaccttgactgaagctgatgatgagtttgtataattaagcaggattactctgagatccagcgtggctgactgatgagactaggtggacaagagccattgggagccctgggtgttaggctcaaatgtcagttttctgggagctgctgagagggtggaatggtccatctatctcagaacttggtggaaagctttgtagtttttttgctaccttttcaagatagacacttgagctatattcttggggcttttctcttgcaggcatgatgggcccacctcctggtatgagacctcctatgggtcccccaatggggatcccccctggaagagggactccaatgggcatgccccctccgggaatgcggcctcctccccctgggatgcgaggtaagtgcctgcagtggtgactttggcttctttccctagagcctagtgggataggaaatggagggaagattgcatttagatcatatcccatgggctttcaagccttaaatctagggaaatccagaaaggaaagagaagagggaacatttcttaaattgggcttac

SEQ ID NO: 27628 - DNA, 1079 bp, Homo sapiens
ggctggacgaccccctgcctctggtaccaagtgtgaccaaggctggcgccaccatggctctgctgccgtcacctcctccctttagcattgagcagccccggaggggctagccctgaggctgacctgcccagagtccccaccatcgcgctgcttagtggcctctccctgcagcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccagtgagtgcctcttctagggtgacgcttccagtcccacaccttgcagcccgttcagtgtgtctggaccatttgtttccatctcacatctcttgtctgtcttctggtctgttccgtccagtaggttttctctttttatgtcccacacatcttccacaggagtcctgacaggtgtaataacctgtgcactttttagcccatccttgctcagcatttctcgccctgacagctccccataatttccatcacgaaagcgttgcattgtgtagtgtgtctcctgggtgacttggccgacttaatttctgccaggtgatcttgggtcactgtatactgctggccaggaggcacacagaacagaggcaatgccaggactttttaacctcatcttttctcctgcgtctaagtcaaccacagagctggtgtcgggcacctcagccctgggaaaatggggtcctggacttggaaggagctggggcaggctgaggtctgcctcagccttgggatctctgtctcctcccagttcagagggctgtgtacaaggacctggtgctcttgctccagaaagactcactgctcacagctgcccagctgaaagccaaggtgagggaagcttggtggccatgtcagtggtgggtgggcacagaccctggcctggcagggttctcctccctggcatgggtctgaccagtagggtggggggggtgggtagggggagctgagctttgaacaggaccagctggtggctgggggccagctgggcgagctg

SEQ ID NO: 27629 - DNA, 1068 bp, Homo sapiens
cccttctttggtgcctggtgcccgagtgtagatggcaggtccattcatcacatgtggatggagcacttgccctgtgaggtgctgcgccaggtcctgaggccggatgagaaacatggacatagtcctgaccctcaggacctgcaaagcctggggaggaagtaggcatcctaccttggaggctgagaagggctggtgggctctgaaagcacaggaaaggggcaatccggggtggcgtcatggaatgggtgtggtctaagccaggtctccagataagggcattctaggcagagggaacagcaagcacaaagtgaggaggccagcagcgcagagtgtgcaaagaagtgattggaagctgctggactctaaaagttgagactggtgtgaagagaggtgaggaggctgggtgggccgtgcagggagtcttgactgtcccgaaagttgggaagctcctaagaggtagaaagcagagttatggggtggtcaagttacataggtgggtcattggaggcagctttgaggacagattgagaagacaagcctggagcaggtgaatagttaggaagagatgtgtcgagcggcctggattatggtgatgaaatggacagagagaaggggggttaagaaacaattctgaagcaaattggtttgaggttcctttggggtcctccagagagtagtggctaggaatggagacatggaccacaaggaggacaggcaagcccatcccctgtcactctccagaggggccatgaggaaaggaagagccgtgggtgcagcctggtggggcatggccagagctgctcactgtgaccctcattcaaggatgccctgaaggagttgcggaagaagggagagcctgccgagagggccagggcagcacaggagggggactgaggagtcaggagcagggctgccagtagcagtgagggggctgcaggctgcagggctgaagggagcaggagctaggccccagtggcaggtgcactgcaggcctcagccttgtctctgctgacctcccttctcacacttccccaaccttggtgcactggaccatgtgctgcttttcct

SEQ ID NO: 27630 - DNA, 1034 bp, Homo sapiens
ggctaattttttgtatttttagtagagacggggtttcaccatgttgccaggctggtctcgaactcccgacctcgtgatccgcccgcctcggcctcgcaaagcgctgagattacaggagtgagccaccgcgcctggccttttttgttatttttttctcatctagccagtctgcagtctgacatccggggcactttatgtaaatgtgaagagaggtttggttgggtttgtcgtcctcatcccttcagattaacacttccgtcagtgtcttagaaagagcagtggcagcttatgggccaattttgcctaaaatgaaccttgacccccattgtatgccagaatctattaggatacaaagcaacagaaactgattgcaacgggaggcattttttacgagatggagctcctgctgtgcgaaacgccttctctcttggcttttaggctgttttgcttcttttctcctatcttcggtggtccctcttcagtttccattgccaattgccttctctaccagctctggccctggactctctaatctcaatattctctgttacccaagtgaaaactcacatctccggcaactgtccatgttcccctgtagctcctgcttctccttggaactcatcctgccgccctgacagcactcaacatcctctctcttttttctttttttaagatggagtcttgcccctgttgccctagctggagtgcgatggcgcgatttcagctcactgcaacttccgcctcctaggttcaagtgattctcctgcctcagcctcccaagtagctgggattacaggcacccgccaccacgcccagctaatttttgtatttttagtagagatggggtttcaccatgttggccaggctggttttgaactcctgacctcaggtgatccatctgcctcggcctcccaaagtgctgggaatacaggcatgagccatcatggccaggctcagcatcctctctaaaggaaacattcagactctgtactgctcacatctgccctccagagcttttccccctcactgccccc

SEQ ID NO: 27631 - DNA, 1047 bp, Homo sapiens
tcagcctcctgagtagctgggactacaggtgtgtaccaacatgcccagctcagttgctcatatttttaaggttgggcaatacttgggggccccgatctgggacaattgcccttggcctttgatctgatcttgggtgccctgatctgggacaattcagtttaatagaggaaattttaaaacgaggaacctcaggcttaagagttttcttacaagtgacaagttgtcttcatttggatcattgtatcttgtgttttttattaaatctagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctg

SEQ ID NO: 27632 - DNA, 1082 bp, Homo sapiens
cccacttctacctcctgagtagctaggaccacaggtgtgtgccaccaggcttggctaatttctaaatattttgtagaggtgggggtctcactacattgcccaggctggtctcaaactcccggcctcaagtgatcttctcactttggcctcccagagtactatgattacaggaatgggccattgcatcctgcctgtggtaacatattctatcttgtataacttttttgtcttccctggcattaataatttttgttactgtttttattagcatggctttttgtatccttatctcttgttcatgcccggattatccggtagaagtatgattctcctctcctgggtactgtctatgtcgtccagcatgagctggttgctctttatgtctgttcacagctcttgtcctgggatcttccttcacctttttcctgggatttccctttgcttctctgtattgaaccctagtttctggatcccatatctctactgccaactttcaggtcttcaattgtggtagctctccttactttgatcctggagcatcctgcgaactctttgcctcatgtagatttcagcctttgaggtcttctctttgttcttttttaaagtacaggttgagcattccaaacctgaaactccaaaatgcaaaatgctccaaaatctgaaactttttgagcaccaacatgatactcaaaggaaaaaaaaatgattggagtatttcagattttggatttttgaatttggaatgctcactggtcagtataaagcacatagtccaaaaactgaaaaagtttaaaatctgaaacacttctggtctcaagcattttggacaagggatactcaacttgcagtataaaccgtagtgatagaatcgtagactgttagaggtggaagggactttcaagcttacctagttctaaccctccagctccctggcacctggaaatcctagaagaccatagattgttcagccatcccaccccgtactgccccccgaacctgttttctgacatccattcttgtctctctagtacaccaataatgtgggctgaagagtcagacagtctttaatattaggctccact

SEQ ID NO: 27633 - DNA, 1452 bp, Homo sapiens
agcagagaggacctgccctaaagatagagtcttgatgcaccgtctaccttgtccccaaccaagagtgagtagtgcacagaagtctcctggcaccctgggaatcctgcatttttaatggacgaacaggcaggaaagaaaaaaaaaacccaaaccccatcactctgccagcccctgtgaccaaagcagcccaaatcagttaccttgacaactctcatgcacagactgcaccagcctgtgttgcaaacatcactgccccgcttctaacaggaagagatactcttttgggggtcttgcagggcccaggaccagagccccttctacccagggcccttccaaaggcaaagcacagagtcacatttgggcgtggcatgagagggaaataaagagatttggctgtagtgggagggaggtttcagtgctttttctggggacattggtgcctatctctattctgagagttgttctcctcataggacaccataaatcgcatccaggacctgctggctgaggggactataacaggtgagatgatgagagccaatcactgcagtcctggccttggagagtgtctagccacaggggctgcagggatgtgctgcagaggcaggatgaccacccaagatggggggaggggtgtgcaaggaggggcactgagtagctggatgcagttacaaggaggacatgccagggcctggaggtggcagcagtgggagaggacaggcagggcagcctgattcgactctcctagcaggactggatgcagccaggaaagtccaggcaggcaggaggccggaagggccctgagccagctgtgaaggagtaggtgggcattctcaggccagatggggaacgcccaggaggcctcagccccacaacctgcatgtccccacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacatttactctgtttctttgtgccctgcaagccctgcccccaagacctagataagatctttctcttcttttgcccccactcaaattagaagtgggga

SEQ ID NO: 27634 - DNA, 1052 bp, Homo sapiens
ttgagcacttagtttctggcactgcaagatgccccagactcatcttgtatattacttgcctcagctttagctttctgattcttgtttttgtttttgagatggagtctcgctctgtcccccaggctggagtgcagtggcacagtctcggctcactgcaagctctgcctcccaggttcacgccattctcctgcctcagcctcccgagtagctgggactacaggcgcccaccaccacgcccggctaattttttttttgtatttttagtggagacagggtttcaccgtgttagccaggatggtctcgatctcctgacctcgtgatccgcccgccttggcctcccaaagtgctgggattacaggcgtgagccaccacgcccggctagctttccatttaaaaatttttctgagtgctctggaaaatgtgttgggttgagggaggctgttttaccaggcagtagtggtgatggagcaacatagacagaccagggagttttctggaagttagagaaagaaggggtcaataggacctcatttctgaccagttggctgtgttaattcacagagccagggacctaggaggaggtctaaacgtagaagagtaggtcccagggtctgtctgctgcctgtgagatggcccagtagctgtgtcacatggaccgttgtgtgtttgggagaagagattcgggtggggctacaagtgtggtagtcactggcaaggaaggggttgatgctttgggcatgggcgaggtggcccagagaatgtggaggagagagaagaggcagggctgaatgatgaaggaggcgggaagaatggcccaaggagcaggaggaaatccaggagagggtgggatctggaagccaagggaggaaagaaggatcactgagaggacagacatatgagacctgaaggttgtaccttgagtttggtgagtggagggcatgggtgagactgtggcaggagttgtttcatagaactgggaacacagaagccagactggagtgggctgactgggtgagtgggtggtgaggaaatgcagggttcacatttgctta

SEQ ID NO: 27635 - DNA, 1026 bp, Homo sapiens
ggcagagctgggctagtgacatttgcaggtgggtggaaggggatccccctgttaggggagggacgaggggttggggatccatcgtcatcagtcctctctggtcagaacctgaactgtctttctttgaccatacccagcccaggaggaggaaggtgtcgagaagccagcggaaactcacctgtcggggaaaattggagctaagaaactgcggaagctggaggagaaacaagcgcgaaaggcccagcgtgaggcaagccggagggatggggtgcagctctgggaagtgcgaaagggcactgccttcctttttccctaaggcagactgagggcttgttgcctgctgggctggtgtttgctgcttccctggctctgtctcctgccgcctgggtctgtgccctggcccaggcattgccttccctagtctgtctgggcggtgggcacactctagccgggggtgagggatgtgcccctatgaagacctctctccaggcagaggaggctgaacgtgaggagcggaaacgactcgagtcccagcgcgaagctgagtggaagaaggaggaggagcggcttcgcctggaggaggagcagaaggtgaggccagcccctaccctgacctctgacccttgaccaggcaaggcagccttgcttcttatgcagctccctggcacctccaacctagaaggtgggccatagacctggcacaagggcaggtcctggtttatttggtccctaggctccaccacagcctagaaaagccactgctgaaaagcagagcctggagtggggatttttgtgcacgtgactattgaactttcggggagcatgtgaggaacgcgaggcgaggaggatagctgggcagagaaagccaggagaggaggagaagatggcagagaggtgatgggggtctggatcctgaaggccttgaggctgaggaagatcattgtaagagatggttcttacatcgagggcctggcatacagaaggtgctcagggaatggggtccactgcagtagtgactaatgaaca

SEQ ID NO: 27636 - DNA, 1105 bp, Homo sapiens
aagtgcataccaccataccagactaatttttctatttttagtagtggcagggtttcaccatgttggccaggctggtgttgaactcctggcctcaagtgatccacccacctcggcctcccaaagatcaaatgttgatttgaattggagattcaatataaattcattatttttaaaaatgtatatttcctaccattttcctttgaaagggaccagaatagtaataccacagttgcagcaaatacccttacctctgtatcttggtttctaagtaccagtccccactacaaggtaccaggactccttggagaattagctgactgcatgcctaggtcaaggaaagtacaaggtgagcctggtccattttatgccaataaagcaaggaagtactcaaagattagtggagatgtgtcaaaaggatatgggaagtagcttaagaagttcctgctagtctaatttgggacaatttggggataagaaagaaccatgataatactggaactatgaattataacacatggaataaaatgtgtgtccacagtgatcctcaaaaacaaaggtggggccaggcacggtggctcacacctgtaatcccagcactttgggaggccgaggcaggcagatcacctgaggtcgggagttcgaaatcagcctgaccaatatggcaaaaccccatctctattaaaaatataaaattagccgggcatggtagtgcatgcctgtgattccagttactcaggaggctgaggcaggagaatggcttgaacccaggaggcggagcttgcagtgagccgagattgcgccattgcactctagcctaggcaacaagagcgaaactccatctcaaaaaaaaaaaaaaggtggaagggggcaggatagcaaagccctttatagaagaataccaagtaaataaggtttgatagaactagaaaataatcagccgagcatggtggctcaggccagtaatcccagcactttgggaggctgaggcgggcagatcacaaggtcaggagatcgagaccatcctggccaacacggtgaaaccccatctctactaaaaatacaaaaaataagccgggcatggtggcgggcacctgtagtcccagct

SEQ ID NO: 27637 - DNA, 1092 bp, Homo sapiens
agcttatcctttgtgaagacggtaagcagagctatcatgggtcagctggctgggaatggcctgtagagggacatctgtaagttgggaggtgggagtgggtgggggtcttgggcagcccaccccacctgaagaagctgatcttctctcagtcctatcccagccatagcaggggtgagcctgtgtttactgaaggtacccaggtagctgtgctaggcccacccacatctattctcccttgcctaggcttccccagtgtccagagtcttaactgaggtgttgggaggcacctctttctgggttatgaagccttcctacaggtagctgagattgctcttgtcgaaatgtgaatccaggacaagcttgccttgactaacagactaagtttttcagtggcatctttgagttccaagacttgcattgatgtccttaacaggaacctagagttgagaccagtcttgacagcgtagtgagaccccgtgtctaaaaaaaaaaatttttttaattaggcaggtgtggtggcatgcacctgtagcccgacctcctcaggaggctgaggcaggaggatcacttgagtccaggagtttgagactgcagtgaactgtgattgcaccactgcactccagcctggatgacagagtgagatttagtctcagaaaacaaacaaacaaaaacagggaacctgagaaaattaactacagtcctgtaccacaaaaggacatcttggtcaacagtggactgcagatacaacagtggtcccataatatcataatactgtatttttacccaccatttctatgtgtagatatgcctaaattcacaaatattaccatcatgttataattgcctacagtattcagtatagtaacatgctgtacgggtttgtagcctaggagcaatagactataccagctagcctaggtgtatagtaggctacaccatctaggtttaagtacactctacaatgttcacacagtgatgaaatcagctaatgatgcatttctcagaatgtatccctgtcattaagtgatacatgactataattatttaaatggccaataatcaacagggacctgggtctgccatgaagtagag

SEQ ID NO: 27638 - DNA, 1104 bp, Homo sapiens
gtgaaaccctgtcttcactaaaaatacaaaaattaacctggtgtgttggcgggcacctctaatcccagctacttaggaggctgagccaggagaatcacttgaaaccagaggcggacgttgtagtgagccaagatggcaccactgaacttgagcctgggtgacagagcaagactccatctcaaaaaaaaaaaaaaaaaagacatcacaagattgccaggcacagaggcttaaacaccaagttctttctcatgtcatcgtgtttcgtcggtgccgaggacatgaggggtgtagatcaggcctgtttcaaacacaaggccttttggccagagtgtaatggtgtgaggacttgggaagaccttacctacttaactgtctctctcaaaggacaaaggtatgagggggttaaaaaaaaaaaaaaaaaggcaaagctatgaagaacatgaagttcttaagcccctagacactcttccaaggtctggcctgtatcccagagtccactgctgaaaaggggcagagatgtgtgttatatgcgcacatacgtacgcatagtatagctagcatatggcattctggtggcctcgacggagctcacaggcaatataacagcattgactgctttcacagtttccacttgtctcaggaaaatagagaaaattcaagatgaaatacagtgagtttaggacaactcagtttcctaaatatggaagatcctgtcccttcccaagtattgaaagagatgaaaattttcccttagttttcaagctcaaagtctatcttatctttgactaaatagccctgatttggatactgttaacttgctcttaactactaatagtctagtgcttttactttattttattttatttattttctttgagacggagtctctgttgcccaggctggagtgcaatggcactatctcggctcactgcaacctccacctcctgggttcaagcgattctccttactgagcctcccgagtagctgggagtacaggcgcacaccaccatgcctggctaatttttgtacttttagtagagatggagttttgctacgttggccagggtggtctcgaactccaactcaggtgatccacccaccttg

SEQ ID NO: 27639 - DNA, 1017 bp, Homo sapiens
ttggatgatgaggtaacttatccagaagcacaaagcctaaagaatgacagagcttggactcctgagaagttcagctactgcccgccttatgataaccaaaagaaagcggccgggcgcagtggctcaactcctgtaatcccagcactttgggaggccgaggcgtgcgaatcacaaggtcaggagtccgagaccagcctggccaacacagggaaaccccgtctctactaaaaaaaacaaacacaaaaattagttgggcgtggtggtgggcacctgtaatcccagctacttgggaggctgaggcaggagagtcacttgaatccggtaggcggaggttgcagtgagccgagatcgtgccactgcactccagcctgggagacagtgagactccgtctctaaaaaaaaatgaataaataaataagaaggcacaccacaagttcgagaccacttctacaaaaaataaaaaataaaaaaaattaggccaggcacagtggctcatgcctgtaatccaagcactttgggaggctgaggcgggcggatcactggaggtcaggagtttcagaccagcctggcccaacatggtgaaaccctgtctctactaaaaatacaaaacttagctgggcgtagtggtgcgtgcctgtaatcccacttactccagaagctgaggcagaagaactgcttgaacctgggatgcagaggttgcagtgagctgagattgcaccactgcactccagcctgggcaacagagtgggactctgcctcaaaaaaaaaaaaaaaaagaaaatgaagatgaccaaatgggcttctagatggctaatgatattctgtttctttgatctgggtgggggttacatgggtgtgttccctttgtaatatgttatcaagacattttgtgcacttttttgggtattatactgaaagaaaacatttattttttaaaaagttgaaaaattgccttggagcagagtaaggtaaatctatgattaagcttagatttttttattttttattttttatttt

SEQ ID NO: 27640 - DNA, 1051 bp, Homo sapiens
atttgttaaacttgtctatatctacaaaaaaaaaatttgctgggatttttataggaattatgttaaacctatatatcaatttggagagaatatctttcctatgctgagtcttcaaatccatgaacatagtatgtctctgcatttatttagattttacttgattcctctaatcatcattttgtcatttttagcatataagtcctgtacatatctaatgtcttattaaatttaattctttgtatttctttttttgaacaattgtaaatgtcattgtatttataatttcagtgttcctatgttcattgctaatttataaaaacacagttgatttttatatgtatatctggtatcctgcaaccttgctgaactcatttattagttttagaaatttttttgaagattctttgggattttgttgttgtagatgttgatgtggcaaataggctcagtttaatttcttcctttctgatgtgtatgccttttattcccttttctaccttattgcactggctagaacttccagcactatgttgaataagagtggtgagagcagatatcctgccttgttcccggtcttaggggggtaagtattcagtctttcacaattaagaataatattagctgtacagtttttgttgttattgtttggttggtttttgccggtttgttttttgtagatgctttttaacatgttgaagaagttctcttccatttctatttctgggagttttttaatttctgggtgctgatgtttgtgaaatgtgttttttttaaatcagttaatatgatcatgtgatttttcttctttagccatttaatatggatagattacattgattttttttttttttaatattaagccagccccgcatctcttgaataaaccttacttggtcatggtgttgtaaaattctatttacatattgccaaattctacttgctaatattttgttaagaatttttctgtctgtatttgccagacactgtctttatctggttttgctatcaaggtcgcattggcttcaaaaaatgccttgagaaatgttccctc

SEQ ID NO: 27641 - DNA, 1039 bp, Homo sapiens
atgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggt

SEQ ID NO: 27642 - DNA, 1972 bp, Homo sapiens
cattggcctgcgttgctggggctttgaaccaccaccccgtactttgttttgcctgtagagtgttgtaaaatattttggatgtgaatgtccttgcaggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctccttcttgggctactctttaagaaaagagtcatccctcagaatctgtaggggattggttccaagacctcctcggataccaaaatccgagact

SEQ ID NO: 27643 - DNA, 1055 bp, Homo sapiens
ttgtgtgttttgttgtttgttttgttttgttttgttttgtttttaagacagagtcttgctctgttgcccaggctagagtgcaatggcatgatctcagctcactgcagtctctgcctctcgggttcaagcaattctcctgtctcagcctcctgagtagttaagattacaggcatgcaccaccacgcccagctaatttttgtattttgagtggggacgggatttcaccatgttggctaggctggtctcgaactcctgacttcatgtgatcctctcacctcggcctcccaaagtgcttggattacaggtgtgagccaccacacctggcctagagaggtagtttttgagcagacctggggcaggaggtgatgagccagaagactaggtaaccagatgggagaccgatagaatgaaccaggaaagcaataacatggcctgagctgggccctaacagtgaaaattgagaatatgggtcacatagaaggatagggaggtcagaaggtcattaggtgattgcttgaatgaggacatggaggggttagtgcttcttagacttctggtttgggcactggatagctgagcaccttcacctcctcaagtattctttgctgttatctaggcaggtttgatctgtgggaccatgtgtgtgtgtgtgtgtgtgtgtgtgtgtgtgtgtgtgtgtgtgtgtgtgtgtatgtgtttgacgacagtttcattttcagtagagctgctaaacgaagcattcctttgttctatcttgggatgtgtgacaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttcc

SEQ ID NO: 27644 - DNA, 1051 bp, Homo sapiens
attacaggcacatgcccccacgcctggctaatttttgtatttttagtagagatggggtttcaccttgttggccaggctggtctcgaactcctgacctcgtgatctgcctgcctcggcctcccaaagtgctgggattacaggcgtgagccaccgcatccggctacgatgttttcttttaattaaagacacagtgcacatcagtcctcattatggccgccttcatctgacttagcaactgtcccaggcatctggtgcttaagattttaaaatgaacagtttccatgagcttcagaatccaagtggatcttgtagagtcttgcagcgttcagaatgactttgggtaactggtcctggtcactttcgcctgcctctctaggagcattcatggttgttttcctcccacagttcagtggggactgcccaccgtgtctgcggccggtgtcatcggcatgctcagtgccgtggtcgccagcatcatcgagtctattggtgactactacgcctgtgcacggctgtcctgtgccccacccccccccatccacgcaataaacaggtacgttcctgagaagacaagttcctgattggtcccagcaccttgttactttgttcttaggtttacattaccttgaagacaaaaccaagagtttcagcaggagcccagccaagcagcaggactctagcgactgtttgatgcatcaccacctttgtttactttcgactgtctgatacaccactgcctttgtttactttcattttcctcgtccatgacgtggaacggaattcctacccttccttaattgcagtgacatcaaataacacactctctgcgaaaccactgtaagccttaaattcaaaaaccacatgccaagcactgcacttgttctttgctttttttggggtgtgtgtgtgtgtgtgtgtcatttggagattagatagataaaatcaaagtagctctgtctatatatatatatagagagagagagagagatagagagcactactttgattttctgttatcttgcctttccaactgttcttttttttttttttt

SEQ ID NO: 27645 - DNA, 1098 bp, Homo sapiens
cagaggtgggacatgatcttgaattatctagatgccttcctccactccacccttacttgtctctttctggaacctcttcctgaagcctcctggactcttcctgtttcctctcctgttttctatctctttgtcttttttctctattcgtgagaattctcctttgctttatctcttattccttctgccaagattgtcatttatgctctggtgttttttcagtttccaagagctcttctgtatccttgggctgtcagctctgtgagagcagggcctacgctctgggtgggtcacctctgcacccccagcacctgcccctcccgtggctgagctggtgctcagtgagcaggttgtgaactaataaaggaaggctcaggaagcccggtaaacccatgaccacaagagcagccgagatagttgctgaaggactctgattcctaaaagaagccctgggcccagatggttagacaatgagtgcattcagtcttcaaggaacagagactatatgcactaacttgcaaactgttccagagctctgtgaaaggagggaaactccccagccaatcttagcggcaaattctgactgaactaatacaaaaggagaaccatggaccattgttttctttcctggggttgtgttaaaaaacaaacaaatcctgagctgatggatgtattgcggcacattctaagcaacgagccctgagttcaaatgtcttcaggtagcgtgctaaagttcagcatcattctctactgtaagactccttccaatctttcaaaatgcaaatgcgcaaaagactctattcaccttcagaaaagggccttagtatccagccctgtccacccttaatttgttttttaaatgtcacacatctataagcatatcttgacagactattccttagaatgttgtttgggaagatgctgctacagataacacaatgaaagaacaaggcataatgcgtcatttcaagaattcacagatgatcaaatattagaaaatgtgttgaaatcgatcatggctccatggtaggtttttttttatttgttaaattttgagacaggatcccgctccatcacccaggctggagtgcagtggcacaa

SEQ ID NO: 27646 - DNA, 1028 bp, Homo sapiens
cagtcatttcctctcttggtgaatggcaccaccgccaccttcccctacccagttgtccaagctggaaactcagcctcactctccttcccctgcccccttggcaagtcatgctcgctccccagcacccctctgtgcccctattccttacgttcagaccagagtgtcccaccaggctccccgttggcttccctgcctccagggcactgctcttggactcactttgtgccccacacccagtgccatctttctacttccacaccctcctcagggtgagccacactgcagctctcctccctttttacacaccaggctgcacccagcatttaggcttgcccttgctctctgccccacttccatctccagccatgcctctgagccctgtctcctgccttccctggcctcactcccaagggcccgctgtctaccttcttgtgtgtcttccctcaacccgcctggcacacaacagctcatcctccaggcccagcttgtcctgccctcccgactctgtggagcccttcattgttctctgaattcccaccttgttttcatccttccagtgtggcctttattccagtttgtcctttttgtttctatgtctttttcccacggtgcttcctccttgatgccagggctttggcttgttcacttctgcatttccagccaccagcttaaatggacgtggagctggcacaggaaggaagagaaacatccttatctaccttcctacctcctcctgcaagcttgtcttttcctctcctttcctgctcctctcccctcttcgcagtgcagcctcttgctttaccccagggcactgctcaggaagtggagcctgctctggcaggactgtcctaagttcacggccagctgtctcttgctctgtcagagacaggctgagtaaggcctggccctccctgcggtgggaggtgggtgtgagctgaagtcagggactgcattctgatgagtcagaatccttcgggacctcagggttgccctaacgcggcacggggataggggagccttggagggcg

SEQ ID NO: 27647 - DNA, 1050 bp, Homo sapiens
gcagaacccgggacgatggtgtggccccttaccgaggagtgttctccagtgggctggtttacttaggtgaacagcaaagcttgagttcctccagctagaacatttccccttctaggtgcaggaagtcggcctcaggtggttatgtgggcagggatcttaaccgaggcagctcagggtactctcacctgttcagcctgggcctcgtccacaaacagcatgggcctctgagccaaacttcccttcccctgaaggatgtgggggtgcccctgctgaggttgccctgggattttatttcttttctccccggctgagccttctgctaaggcagcctccccatacggtacatggagtatgtttctccatcaaaaccatgcctggtcatgcactcaccaggagaattacaaatggctttcggggggaggaaaatgtggttcacgctgaaacagcctctaagtggattgtctctgcaggtggtgataaatggaggcgccacctccagcggtgagcaggacaatgaggacactgagctcatggcgatctacactacggaaaacggcattgcagaaaaggtaccccttccgtcaccccgtgtccccactcccaccgccatcccctcccacaagtgctgccccggatctggatccggatccctttcagacacttgcatgtccttcgtctggggcttggtctctgactcccaaggggctgtgttctcttcataagggaagtaggaggagccatagggaatagaagttactagtttttttttttttttttttttgattgttttaatggcatttaaggtgagaaccatagaggaggatccaggtatttaaaaaggcctcagccaagatggcagagggaagtggttaagagcttgaggtctggcatcaggtctgggtgcaaatatgagtcagactgaggaaattatagaagttctctgggcctcagttccctgtctctaaaatgggaataaaaatgtcaacatctggttgttttgtggattgaatgaaatgatatgtgaagttattagcatcgtgcctgttacag

SEQ ID NO: 27648 - DNA, 1010 bp, Homo sapiens
accctgtctccaaaatatatataaaataagaacaggaacacagtactgcccgtatttaatcactagtgaaattgctaccctaagtcaacttttaaagtagaagaccattttgaatgatttgcccattgacagggaaaaagtgaggggactaagttacagtgggtcgcttcccattgcctgatggatgggattagtgtgggggcagctggttggaggcaggggcagtggggtagcacaggaagaattggtgggtctgggagataccaaaggcatgggaatagtaagaacagaggtgaggctgatagaagaggtgataggaggttttgagggccaaagaaggagatgtttcggattctcatcaagattttatacagaagaacctgattgggtatatgttggctttggagaaaatatgaagtctagggaaaaccataagtttggagggtggggaagatggaagatgatgggttttatttgagaagttgtggatttgaactgcggtgctcctagagcctgcaggcagtgggggtgtgggacttgacacacatagagatcaggagagctgtaaagactcactgtgatggctcatgtgggtggtgactgacccgtgtgagagggtgctgctggcaggcagagctggcagaggaagatagggttgagggtctcaccgttgggtatacccacacatgagtgacagggaggatcatgccaggacattgctgcatgctagtgccttgtttcattctggcctttgcaaatgtaaatattgaagaatagccagcatggcagctctgggttttatctttttgtctggatctgtactgtccagcatcatggctgctagtcacatgtgacgtttacatttaaattaaatactattcaataaaacctgaaattcacttcgttagttgcactcgtcaagtactccatagccacacgtggctagtggctagcccatctctgcttgctggttagggccttgcgaggctgaaatgttggctcttattttc

SEQ ID NO: 27649 - DNA, 1324 bp, Homo sapiens
ttttgatggacccaccatgatttgcttacccgtccacctcttgatggctctttggatgtttctagtttggggctgttataaataaaacagtgtcaaatttttgtcttacatgtatttgtgtgaaagaaatctgtctttttttttttttttttgagacagagtctgactctgttgcctgggctggagtgtagtcgtgcagtctcagctcactgcaacctttaccttctggactcaagccatcctcccacctcagtctcctaaataactgggactacaggcggataccaccatgcctggctaatttttctgttttttttttttggtagaaatggggtttcgtcacgttgcccaggctggtcttgaactcctgggctcaagcgatccgcctgcctcagcctcccaaagtgctgggattgcaggtgtgatccaccgtgcctggcccagaagtgtatattttaaataagcttcccatgtgagtcttaagcacatgagccactgattcttattctggctcttcctctctctcgtatccttttggagaagtgtgggtttttgtctagagcaaatgatggatttgccatggatttatatttctgatatagtatttattcagtgccgtctacttggagtaaatgtaaatttcattagcatttatggaacatctatcttctccacaccgccccaccccccgccctgtgtacttccttgtaaagagcatctgtctattctgtactaggagctgggaatataaagatgaattttatgttttattttttgtagagtcagagtctcgctatgttgctcaggctgatctcgaactcttggcctcaagcaatcttcccaactaggcctcccaaagcgttgggagtcactgtgcccagccttaaagatgaattttacatagggggattctactctttgggcagactattagtgattaattcattcagccattggagggtttctgtgttacctgctcactctgctaggtgctgatcatgaaaggacaggtttttcttaggatttggtggttctttcgagaaacacagaaggttttggtatttaactccacgaatagctcagctctgaaaacttctggacagtgccatcacatttctccttcaggtggccctgctaagccacagtgagaggggtgactctgtttcctggacagggagagatggtcggataaaatgaagttcaaaagaaatcattacaggctgaatagctgatgaaacaagtactgattaaaagcttctgcatttgtgcgtgattgttggtgggtggagagctagtgattcagtccttagggaattggaagatt

SEQ ID NO: 27650 - DNA, 1038 bp, Homo sapiens
tataggtaaattatccttcagaaaagccgcaagtgtttcacatctgccgatacattctctcagatactctgcttctggatgtggtggtgcacgcctatagtcccagctactctggagactgaaacaggaggatcacttgagcccaggagttcaaggatttagtgagctctgattgtgccagcgcactctagcctgggtggcagagtgagaccctgcctcaagaaaaaaaaaaaaaaaaaaaggatgctgtcagatacattgacttgttaaaactaaatttattcagtatggtggatgtaaaatgttatgtcagtgttgttttaaaaaaattttatgtgcagtaaaatttactttctgtgtacacttataagagcttttacaaatacttagaggggatcactccttttaaaaaaattttaagacttctaataaaggctgggtgtagtggctcatgcctggaatcccagcactttgggaagctgaggcgggcggatcacctgaggtccggagttcaagaccagcctgtacaacatggagaaaccctgtctctattaaaagtacaaaaaattagccaggcatggtggcgcatacctgtaatcccagctattcgggaggctgaggtaggagaatcgcttgaacctgggaggcaggaggttgcagtgagccgagattgtgccattgtactccagcctgggtaacaagagggaaactctgtctcaaaacaaaacaatgacaacaacaaaaaaaaccaaaaaacacttctaataaagaagtctctacttactactaaaaacaaaacaaggccgggcacagtggctcacacctgtaatcccagcactttgggaggccaaggtgggtggatcatgaggtcaggagttcgagaccagcctggccaacatggctggtgaaaccccgtctctactaaaaatacaaaaattagccaggcatggtggcgcacacctgtattgctagctactctggaggctgaggcaggagaattgcatgacctcaggaggctgaggttgcagtgagccgaga

SEQ ID NO: 27651 - DNA, 1051 bp, Homo sapiens
gcagtggcatgatcacagctcattgcagccttgaactcctggctcaagcaatctttctgcctcaacgtccaaaagcactggaattacaggtgcgagcccccatgcctggctgtcatctgacttttttaaaggaccacttaggctgttgggtaagaaggcaagggtatcagagcagagcccaccaggagatgactgcaataatccagaggagagaagagggtgtcttgagtagggggatagcagtgataagatgcagataataagggggatcagatcctgaaatatatatatatacttttttttggagactgacagatatccgttgaggtcaggagttcgagaccagcctggccaacatggtgaaaccccatctctactaaaaatacaaaaattagctgggcatggtggtggccacctgtaatctcagctacttgggaggctgaggcaggagaatcacttgaacccaggaggcagaggttgcagtgagccaagatcatgtcactgcactctggcctgggggactgaggagactccatctcaaaatcccagctactcaggaagctgaggtgtgaggatcacttgagcccaggaggccaagacagcagtgaactgagattgcaccactgcatttcagtctgggtgacagaaggaggctctgtctcaaaacaaaaccaaataaaacacacacacacacacagacacacacacacacaaataaaggcaatgcgttaatctgcgtggaaatgagaggcatgttatttgggaatgtgaggtagccatccagtgatgtttaacagatgtttttacagccaactttccagaaaaaaaaatgcatatatattaatatacacgtttattataaatttttctgatataagggatatatggtatacaatttacagatgataaaatatatgtatttctccttttttccttttccttttttttttttttttgacgtaatgtctcactctgttgcctaggctgaaatgcagtggtacagtctcggttcactgcagtctttttttttgagacggagttttactcttgt

SEQ ID NO: 27652 - DNA, 1104 bp, Homo sapiens
ctcagaaggctgaggcaggaggattccttgaacccaggagatcaaggccagcctgggcaacatggcaagaccctgtctctaaaacaataaaataaaatggcattataaacctacagaaattaaaacagggtgattctgcataggcattgaaagaaaaatcaatggaacagaaacactatgcaaaaagagtcacaaatatcagcaaaattttgtatgtgataaatgggcaattaaaatcaccagagaaaggatagcttgtttaataaatagtgttggaataactaattaacaaatgtaggctgggcccattggtgcatgcttgtagtcccagctacttggaaggctgaggcaggaggattgctcgaggccaggaggttgaggctgcagggaaccatgatcacaccactgcagtccagcctgggcaacagagcaagagtctgtgtctcaaaaaaacacaccaaaagacaagtggcccagttctgtgggctcatgtttggattgaacttcctcatctcttaaaggagggcgtcgccacatgacttgccttggcgaggaaatgtgagttcaagcaatatgtgtcatttctgagtagcggctctaaccgccagtttcactttccctctgccacggtcctagagtgatcgtgatgcacaacagagccccgcgttgacccataatgaacacaaagtgcgagagtgaagtacacctttgttgtgttaagccactagatttgggggtttctgtcatgcagcatatcccagcctaccctggatgatacagtctctatctcatacttcacacctgttagaggaaaaacaagtcaccccaggaaattagaaacatgaatgattagcatttgctgggagtatctgtgcttccaaagagggtgatagggagaagccattgtttattcaacagagtgaaggaccggctacataacttgtaacttgtggggcccagtgccaaatgaaaatgcgcagtcccttgtttaaaaactgattaaaaacttcaagagggtgacagcagagcattaaatcaagcacagagtccctctaagcatgggtccctgggcgtctacacaggtcacacacccaggaaatcatg

SEQ ID NO: 27653 - DNA, 1105 bp, Homo sapiens
tccatctcacaaaggaaaaaggggaaaaaaaaagctcactgatcggatttgttgatcgctccaagtttcccctgttttgggatatcagagttatttctaagtattttacattttatatagctttgataaatgggaccttttaggctgggtgcagtgtcacatgcctgtaatcccagcactttgggaggccaaggcagtcacatcacttgaagccaggagctgaagaccagcctggccaacatggcaaaccctgtgtctctactaaaaatacaaaaatcagccaggcatggtggtgtactcctgtaatcccagctagtcgggtggctgaggcatgagaatcacttgaacccgggaggtggaggttgcagtgagccgagatggtgccactgcactccagcctgggcgacagagcaagactccatctctaaataaataaataaatcaggcgcagtggctcatgcctgtaaccccagcacgttgggaggctgaggcaggcagattgcgtgagcccaggagttcaagaccagcctgggcaacatggcaaaaccccatctctacaaaaaaattagccaggtatggtggcatgtgcctgtagtcccagttactcaggaggctgagatgggaggatagcttgagcccaggaggtggaggttgcagtgagccaaaattgcaccactgcactccagcctgggcgacatagaccctctctctacaaaataacaaaattaaaataaaataggaaataaaatggaggttttcttattcttttttttctttgaatagttcttcgttaatgtatagaaacactactgatttttatatgttaacgtttgtatcctacaactttatttagttctaacaggtttttggtggtgtctttagggttttctatatataagatcagccatctgtaaatagagacagttttacttcttcatttccaatttggaggcctgtcatttctttttctcacctaatgctctggctaggatttccattactatgtcaaatataagtggtgagagtggggatccttgtcttgttcctggtgttagtggaagagctttcagtatgttcactgcgaatttgtcatgcaaggtaaatt

SEQ ID NO: 27654 - DNA, 1021 bp, Homo sapiens
atttacttatttttgtttgttttattttgtgtagagacagggtttcactatgttgcccaggctgatctctaactcctgaggtcaagcagtctgcctgcctcagccttccaaagtgctgggattgcaggtgtgaaccattgcccctggccaattttttttccaatttttatgggtacatagtaggtgtatatacttaggggatacatgaggtattttgatacagccatgcattcataataatcacatcaggctaaatggggtatccatcccctcaagcattcatcatttgtattacattccaattatacttttatttatttatttattttgagacagagtcaggctggagtgcagtggcataatatcggctaactgcaacctccgcctcccaggttcatgctattcttgtgcctcagcctcccgagtagctggaattacagacgtgcgccaccgcacccggctaatgttggtatttttagtagagatggggtttcgccatgttgcccaggctggcctcccaaagtgttgggattacaggcatgaaccactgtgcctggcctatttttagttatatatatacatatacacatacatacatacatacatatatatatattttggagacagagtcttgttctgtcacccaggctggagtgcagtggcaggatctcagctcactgcaaactccggctcgtgggttcaagtgattctcctgcctcagcctcctgagttagctgggactatggtggcaagccagcacacttggcttatttttgtatttttagtagagatgggtttttgccatgttggccaggctggtcatgaactcctgacctcaagcggcctgcccgcgtgggcctcctaaagtgctgggattacaggcgtgagctaccacgtccagccttagttattatatttttaaatgtacaataaattattctctagtcactttgtgctatcaaatactagagcttattcattctatgtaactatattttgtacccgttaaccttccccattc

SEQ ID NO: 27655 - DNA, 1034 bp, Homo sapiens
ttgtaatgcgagagccttgtagttacaggttttatttactttattcagaaactaatcagattgtgttttgttaagtggagttttttgttgttgtttctttttttaaggaactttaaaatttttgttaggtggaattttttttatcactgtttatttacactttagtcaaagcccgttcaccttttaagggagaaacttattactaaagccagcagattgtgggaatcttccttctttcctgatgtcatgagatccaatttattaaaggtattctttgtgataaatagtaagtaaaacacagtatttattaagtttgtatcctaccctaaccatttataaactagtcaatactacagcatctccttttgcacacttccccttacaatagaatgttctacgtggaactagggccaacgaggaagtagcaggaaaccatcctttataaataaataaattactctttggacccacatttgaaggagagataaaaatagatctggaaagatctgggaagcttccagccacttaggtcagatacaacgatgagccaaaccttggaaaatttgtctctgaatcttaaccttgaattgaatttgttcataaggcaggtttacttgctatgtggaacaaacaactaatcatttggaataagctgaaattgccttcttttccttttttttttttttttttggagacggagttttagtcttgtttcccaggctggagtgcagtggcacaacctcggctcactgcaacctctgcctcccaggttcaagcgattctcctgcctcagcctcccaagtagctgggattacgggcatgcgccaccacgcccagctaattttgtatttttagtagagacagtgtttctccatgttggtcaggctggtcttgaactcctgacctcaggtgatcatcctgcctcggcctcgcaaagtgctgggattataggcgtgagccaccttgcccagcctcttgttttgttttgttttgtttttaagatgtagtcttgctctgttgcccaggctggactg

SEQ ID NO: 27656 - DNA, 1385 bp, Homo sapiens
gtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacgtatgtagaggcgcgtaatgccaggcactgtgtgccaaacgttttatgatgcttttagaactctcgtaacattcaggtgctgagggagtttgggggtagcggtgagctggtaaaaagcctgttggcaacgaagactgatactttgaaaatgctcgtttttatttttcccgtcttttagaatcctctttgccaagagtaaacattcgtctcccctctccctcacgcccctgcgatgtattgttttgatgcggatgtatgaacagttaatgtcaggggacgtactttaaaaaaaagtctaattgcaagttagatgtggttaaatgccctcaaaaaccacacatactggtagtttgaactttgttttatagaattaaatgcagccgggatcacaacactaaaaacctactatttgacacagtttgatccaatcttttttgaaaagtatagagattaacattatgctaatttttaaatacttgatttctagaccaggatgtaatcaataaaaacggatattaatatttagcaccaattatttaattatgctagttattttacattgactgcaagccacgtaaaacagttaggccgggcgcgctggctcacgcctgtaatcccagcactttgggaggccgaggcggacggatcaaaaggtcaggagtttgagaccagcctggccaatatggtgaagcccgtctctactaaaaatagaaaaattagccgggcgtggtagcaggctcctgtagtcccagccacttgggaggcagatgcaggagaatcgtttgaaccctggaggcggaggttgcagtgagctgagatcgggtccctaaactctagcctgggtgacagagcgagactccgtctcaaaaaaaagaaaacaccaaaaaaaaagaaaaacaatttgttattttttggaattaggtatgtacaaagtacttagaacagctggcatctaacaaagactaggtaagtactaaccaccattattgtgatgatgataatgatgaattttaaaaatgccatcccagagaaaaactagtcctttttttatgttgcccttatgcccttattgaaatactgaattttttttttttttttttttttttttttttttttttttttagatg

SEQ ID NO: 27657 - DNA, 1063 bp, Homo sapiens
tgtatcagtcttcaaaattttcatagctccctccaaagtgaccaatacaagtgtttgtgggtttttataaatatataatgagctaatagattgcaactttcttgatgtttttcaatgatgaatcttttgttttgtaggttaccatagagatgaatgaaccagttcaactaacttttgcactgaggtacctgaacttctttacaaaagccactccactctcttcaacggtgacactcagtatgtctgcagatgtaccccttggtaagataataaatttgaaccttgttttgtaggtagtcatatgtgatacatactcctcagtaattaaccatcttcctgtctttcagttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatcacagggcagtgtcttcattttgaccaggactgttggaagtatcctactgaattcccagctacagctaccctttcgtttaaatggtttttcagtttagagcagcctgatggagatcaaaaggatttcaaatacagtaggttactagatattttaggggattcacttgtcaaacttgttattccaatttgagctcaaggaacaagtgagagagtagtacaaatcctgtgtatttcattttacttggcaaaaattaatactcttcagaagcttaatgtaccgaaagtcgtgtgggctttataagatgtta

SEQ ID NO: 27658 - DNA, 1070 bp, Homo sapiens
tacctggcctgaaaaggcaacgcatgttaatggtggttttagctgagaaatgggaatatgtttctttgttttctttctttcttttttttttaaatctatttatttatttgagacagagtcttgttctgttgcccaggctggagtgcagtggtgtgatctcggctcactgcaacctctgccttcaggtttcaagtgatctggtgccccagcctcctcggtagctgggattacaagcctgtgcatgatactcggctaatttttgtatttttagtagagatgggatttcgccatgttgtccaggctggtcttgaactcatgaccgcaagtgctctgcccgccttggcctcccaaagtgttgggattacaggtgtgagccaccatgcccggcctcgtttgttttctttatactttcagtgttttctaaaattccaaaaaggaatattacagttaccccccattgaaaggtatttttaaaattgtttcttttcagggttcggcaaaagcagaacaaatatccgatactatttttaactcaaggaaaatctgagatttatcctgaactcatggacctcagatctcggacaacccccattgcaatgagctttgcacagtttgaaaatctactggtaagttatgtttgaatttttatctttttaatgttctgttttctattttggagtagtagtaaagatttcatattactttacccatctaatgttaacgttttgactaaactgtagcaaacaagtggctctacttaaaaacgaggatattagatctcaggatgaaaaacaattacattaagtacaaaatttgttataggcatacgttaaattttttagtttaactttctgaatagattttatgaataatctaaaaatgttcagactgtatgccttttaaaaatattattcccattttacagatgaacgtgaacttgttttggtagagcattccattagtacattttttgactgcacattcaatatgtatgcttatacattatgtatatattaatatattgtgaatatatttatgtatgaagtgtccattaaaaagaataagttaaa

SEQ ID NO: 27659 - DNA, 1021 bp, Homo sapiens
gagtgttgctctgttgtccaggctggagtgcagtggtacgatctcagcttaccacagcctccacctcccgggttcaagtgtttctcctgcattagcctcccgagtagctgggactactggcatgcgccaccatccccggctaattttttgtatttttagtagaaacggggtttcactatgttagccagactagtatcaaactcctgaccttgtgatctgcctgcgtcagcatcccaaagtgctgggattacagacgtgagccactgaccccggccgaaaatactgaagtttttatgaaaaaaaaaatatatatatacacatttcatatataggagatatgtgtgtgtgtgtctgtgtgtgtgtgtgtgtgtgtatatgtatgtatgtaatgtagaagtttaaaaattaagattattttaaatctcattttttcaggaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagaggtaaggttgaagacactgccaaataacccaaggttaagttagaattttaattagtttcaaattaagtatttgataatgataaagatgaaattaataatttgctttagtatcaatttaaggagcatgtctgttacattttgaatcttgtttttttttccgtttgacagaaactgataaagctgacttgagtggtatttaaatataatgtagctcataatggcccttttaatcatttttatttttgttcctccctcttttttcctatgaaagttgactatataattattaagccattaccaggatacagttgtgacatgaaatcttcattttccaagtattggaagccaagaataccattggatgttggccatcgaggtgcaggaaactctacaacaactgcccagtaagttgaatatttgagta

SEQ ID NO: 27660 - DNA, 1032 bp, Homo sapiens
ctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccggaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagc

SEQ ID NO: 27661 - DNA, 1024 bp, Homo sapiens
gaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttag

SEQ ID NO: 27662 - DNA, 1026 bp, Homo sapiens
tattctttgggcatgaaaatcagtatgcagtatatatctccccaggtattttctccccaggtatttcaggcaagagttgaataataaatttatttatctaactacataggcaactataaatgttcagcatgttgtacttcttgttattttttatttctcttaacctaatcttgattagtttgattgcattttaaaccctaattaaaccaaaaagtttttaaaaacctttatattgtatactaaacacatagttcctaaacactataatgggaataattgatgattactaaaaatttatgtcaaagaacagactttaaggtaagattatcttaaagtctgtccttatattttataatgaattttggctctttagcaagttctttttaaaaatgttaacaattgacttatagtaagtcacaaccccaagaggccaaggaggctcgatttgacttttctatgaacatgcttaatacatatcatggcttatctttgaaacttggctcctgatgttaacttcagggataagaatgggacttacttagatatctgtatatgtccttcattaggtcctgggtatgttctgttctgttgcattaatctttttgctaattaacatgtccccattgctcccgtctaaagggatttgacaccggatataaatagaatgtgattgtctgtgcttctcccatctgttgtctggtgcgagatttttctagcagtgtattttggggctaccatagtgtgaggttcttgtagggggaaacagtatgaggtcccaggcgagtcaatgatggagttatagggaatgtaggttgtgtgtgaccctgttggaagactagtgaaaatgcttagagttttagaatattatttttgatgttgactttaagtccatgaaattgagtcaggcctgcctgcctatgccttagattcctttggaaacctagattcagataatcagtgtagaaaggttattggaggcttggcctgaagaaaggagagagtgattctagcctgttcaagtgatta

SEQ ID NO: 27663 - DNA, 1021 bp, Homo sapiens
ttctagggaagtcattgtcattacctctcttgctgatgatatttggagccatatcatcctgtgtccagtagttacttgaattttaatggccatttttgaagctgtcagggtcttgaacaaatgactaagtgattgtgaggaagcatggctcctgcaactctacatctaagtaggttttgactttgaaatagcaagttcatatctgttaatttctttatgatttagcatgtaaatactttctagctgtgattatgtcccttcactcatttttagagtgtttgtcatcaaatagagtcttagggaacagtaagcatgaagggatatacactctattcaaagactgctggaatctcatttgctcataataaattaatcagaaaaactttcttctgtctactgttacattttatgttttctggtaatttaccaaactttgaaaggatgaataggtgtagagcaatgagagtctaattaggaaaaagaggtatggagacattttaaatgattgacgttctgtaagtcgtaatttagttttactaaaaagtcagaggcccaaaaagtttaattttttcatgaatgccctattataagtaaacattgagatgtatataattattaggggaggagggccaaaagcatccatcatgatggaagaaaggactatcaaaacgattctaccagaattctatccagattatgaactctaagcaagtataactttttttttagtaatgaccttaattactactctcagtttcccaatattataaaattgacttgttctttaagaatcatttagatacataaagctttgtgggaacctatgtatgtagaaacaacagctagagagagagattgaaatatttttggttctcttaaaaattaatgttttattttttttcttctgattccagcatcttcacaactatttcacagtgactcttggaattcctgcttggtgttcttatgtctttttcgtcatagccaccttggtttttggcctttttatgggtctggtaag

SEQ ID NO: 27664 - DNA, 1050 bp, Homo sapiens
gactgctgatgttagagatatatttatatagagatttgtgcatgtgtgtgtttccactgcagtatgtatgtgagatggtaattttcaattcatggatttctccactctgagactgagttgtgtcaattgaatagcagctctattctacagttttccctagccactttcattgtactcctgggtctgtgttgcaagtgtggagctcgcccaaatcaccaggtgcagcagattttactgtgaagtttaacaggctaatattagcatctcaagctcctcagaggcagaatggaaacttttgtagttcattttcacagctaagtaatactacactgtgttaatatatcacaatctatctgttcttttatagattgatatttctgttgtttccattatctgctattatgaaaaatggtagtatgatcattttttatatctctcctggtgcctgtgcaagagtgtttcaaggaagtatatgtagaagtggattcctaggatataagatgtataggtaaccaaccatctcggtttgcctagaactgaggagttttccaggatgcaagatttttggtgctaaaaccaggacagtctcgatcaaaatggtataagtggtcaccctgaatacacatatgatcgattttacaacataatacatattaacctctttcccacagaattggtagcaatttacactcccaacaagtggtatatgactattccctttgaacaccattctcctcatgcctggtgttcttgatatcttaatttttgccaatcaattgagtgtgaaatggaatcttgctgtaatttgattttccctggttactaatgaggtttggcatcttttcatgtttagttttccctttgtgtgttctgttctgtgaaatgccttccatatctttcatcttttttccattttttttttaattagacacatctcatttatctcttcagattttcttgatttttccagtacttaggttagggtctctcaacagcagcagtgatggcattttggactgcataattcccatgggatactgtcctgtgcct

SEQ ID NO: 27665 - DNA, 1029 bp, Homo sapiens
aattcagcacagtcaaaaccaaactcaggatcttctcttgccaaaagcagtcccttcccagggccccttctgggtgtctggcaccgatatttgaacactcattgccataagccagaaatatagaaggcgatctgtgtaccccctctctgttagcatccatacctagtccacctccaagttctgaaaaatctctccagctcttcacttgaatctgcctgccttctgccactgccctggtccaagtcaccatctgctcatgactgaacttagagtagccttcgtctggtccacctttatctgctctgactcacctctagtgctttctccattcttctgccatcctggtcttttcagagccataacatttgcttgtcacccttattatgaaaaaccaaccacttggtggccttctgttgctcttgggacagatcttcatgtggcccacaaggctctgtgcagcccagctttgtctccctgccagccttgtcttacacaccgtgttgtccatcgtatctgtagcctggccataccctagcagttgccttcctatcctcaactacatcacatgctttctggcctcaggacctttgcacatgctgtttatgctacttggagtgttttgttcctttcttcaccctcagccactccctctggactgcactccacagggcagaagctgaggatgttcagaagcccaaacggagttggctgccctgtgggacccaagcgagttgtaaacattctggcttcagatgtaaatcaaaggcagagccctgagttttagggcagagaattccttctatcagctctgcagtgagccctcacaggcagactcgggcccaaatatagcctaggtgctgtttatgtatttgaaagtatttaaggctggtccttctgtcatcggtcctccaaagtcttttattacattttgggactgtggtatatagagttccaaatttctttctcccctagagcaaatggtttcagtttactgtaatgcataataaacatgtaaacataaataggcac

SEQ ID NO: 27666 - DNA, 1028 bp, Homo sapiens
tctttatgggacaattctgaggcatgttcacagcctctggagagatcccaatgggactgtggctctgttgccctcagtagtaaccctcttataaaaacacccattattaagttttcctcccttcctggttttacttatccatgcttcctgaaaataccccccaataaactacttgcacctaaatccttgtctcagagtctgtttgtgggaacccaaattagggcaaccaagtccatattagcccatcagatcttattgatcagagatcaaattggatcttttgaatgatcaatattagactgttctgaagattgagagagatatcatgtagaaaaacttaatacattcatttgggtaaaacctcataaattctagagacagacagaaaatgtgtactcttgtgtctcccatagggaagatttgtggaatttatataagaagagggtgtctacaatttagttggggaagaaaagtcattaactttgagttataatatcataaaaacaccacatattttgaatgagaaacaggctctagaaagtcttttagaatgtgctttatctgcagaaaaattaaaactagcttattctttagttaatgctttgatgcaaagaacacttttatgtttctagctagcatgggatgataaacggaaattaaatgcttagcattcttattcattttctattgctactgtaagaaattatcacagacttagtggctgaaacaacacaaatgtatcatattagagttctgcagatcaggagtctgacgtgggtctcactaggctaaaatcaaggtgtcagcagtgctgatttctctttggaggctgtaggggagaacctctttccttggcttttccagatactagaggtgtccacattcctttattaatgcccccttcccccatcttcaaagtcagcaatgctgaatgcctgtgacctttcttccatcatacatctctgtatatatatgggactacggccaggaaatgttctctgattttaagaaatcatatgatagattgt

SEQ ID NO: 27667 - DNA, 1081 bp, Homo sapiens
gttgcaactattcaactctgctattgtaaagtgaaagcagtcagacaatacacaaaatagtgggtgtggctgtgatccaacaaagatttatggacactgaaatttgaacttcatataatattcatgtgtcacaagtcttattcttatttttattattccaattatttaaaactgtacaaaaacagggggcagctgtattggtttagtgacctctgatcttgatggttttcagtttttgctatgagcagtatagggcagtacaaatggctctccagtgggactcaagagaactgatgtctagtcttctcgacctacagactgtggaaacattgactggcaagtcattaaaaatctctggggcttcatgtgtctcatcttatggtatttatgtgggaagatggaaggtggtagatctacaaattctgaaattctatgagtttcaacattgtttgatcatcccagatatcactttgctggcaagtattatacttatgtaaaattactgtcatatcttgttgaattgtgcttggctttgttgaacctataggactaaattctacacttgcagaaatatgcctgctagttgaaattgagctgtgctataatttctatcacggtcaggagaagggcaattatgttgtcagaactctactaggtctcaggaaattgccaaaaggctttaagaaacaaagatatgctttcatttttctcctcccaaacaattcctccaagagtcccattctcctgaaacatactcttaaaagaaaattaaaaggcttgagagaaatgcaataaaatctcattaattggaatctataataatttggtttgagaggaattggcactattcatgaagaaaggttttgtggtgtctattaaccaattggagttgggacgttcattgctaatttaatcaaatccactgcttgaaaatgtgtttgttacattgatttacgtaaaaatatgttaattaaaatttctttttaaaagaaagttaagatctctacttggtagcaattttttagaaactgctcgttcttaaggcaacttaaaaggccataagaatatatttatttaaaat

SEQ ID NO: 27668 - DNA, 1049 bp, Homo sapiens
ctctgagaagttgcagatgggaactcaggagcccaaaattatgactgctttgttaaactgtcattgaagatgaattctgacccatgtctagggctgcaattatataatcagcaatatcatgacaagatttgctggactaagctggcatacttattcaaaaataccaatatccaatcagtttctcctacgaaaagaaccttctcagccatacttcttctttttttctttttttttttttgagacagagtctcactctgtcaccaggctagagtgcagtggcccgatctcggctcattgcaacctccacttcctgggttcaagcaattctcctgccttagcctcccaagtagctgggactacaggtgcgtgccaccatgcccaggtaacttttttatttttagtagagacggggtttcactatgttggccaggatgatctaggtctcttgacctcgtgatccgcccgccttgggctcccaaagtgctaggattacaggcgtgaaccaccgtgcccatctcagccatacttctaacaaggacctactcagagttacagttcttaggagtaatacagtagaagacaattaggttaacaattctcacctttccaactaatgctgggatattcattgagttagttgcgaatcccatcccaaagaccatagctgcttccacattcaggaacttagccacaaggtcctccaactccttgtgcttatccaaggtgcctgcacataaaattacatgagaagtgagccttctcttttcaacaaggccaagattgaaaactcaaattccagtacgtacacatcaccaaaagacctatacaagagtgcttgtagcaggaagatttgccattgccctaatctagaaacagcccaaatattcaactattgtagaatggaaaaatacaatgtggggtatttatacagtggaattcaatacagcaatgagaaagaatgaactactgctccacacaacattgtggataaatctcacaaatctgttgttgagtgaaaaaagtcagacatctaaaaaagtacaggctgt

SEQ ID NO: 27669 - DNA, 1050 bp, Homo sapiens
acctttgcagtgtgattccaactttcttgccttgctccgcctgagtcattgtgtttccagtaagtgacctcccttcctttggaccagtccctagtcttctcaagcccctgtcttttcttcaacacatttcttcaatgtgtttctcctgctttacaaggacataccccaaccctaccgactctcttattctttgtagcaagtaatatttggggactgtagctctgttctcttgccctccctattccatgttgtggtctgattgctcttagttcctatttttcctccgagacgctgtgacacaatgcctgggtggtgtcttcccccagagtatgcacccaattgttctggaagtcaggaaggactgtggcgttttctgccttgctttgtcaaatgttgtctcttcctacagtaatcccagggactctttttaacccaggattttattctaaatggaatgttaagagagttcagatgctgagagacaggtcagggcagcgggggtggggagaggtgtgagcttatccagatctgtggctttgccaggactgttttcaagttgacacagtgctaaataaaaagccccttgctttgatctcggggacttcctgagtagactgtctgattagataaagatcacatattccacccccatcctttaggaagtaatctaagctttgcagctattccttatcctgtctccttctcaaagtctgtctgtctgtatcactgggtccctccctgggtcttgggcttttctttctgtttgagcaggaaaagggatcctgagaaaatagagcacgtcttcctctttgaaatcttcttaagttgtttagaaacaaagcaaaagctttgtttgagaacctcatatggacctcgtctggtccagggcatcaaaggaaactgatctgtttgcaatatggtcagctgctgagatgctatgaagcaagcgagttggcaggtggaagagttggagagagaaatacagtcagtggctgcactgggttccttagccaagaaaagagggtgggagtgtgtcttttctcttagaac

SEQ ID NO: 27670 - DNA, 1003 bp, Homo sapiens
ctggaaatcttctcatggattcccttggaaacatctagtcctatctgaaactgttttatttcatcagaaatcattgctggctggatgcctgatgccagcattcaaatccagtagacagagtgtggctcagaagagactcattgaaactgggaatcccccaactgggaggcccagggttcacactggaaccattctggtgtagttatacatcaaccaatgttaggagtacctgctctttttatctttagtgatactcatagttgagatttttgagatacaaaaaaaaaatctcactttttaggcagaaaacattgacatcagggctgggtacataatttgtagagcccaatgcaaaataaatacttaaaagtcttttttacaaagaacaggaaaaaagctttttcctttctaggatggtctctctcaaactttcatgatgtgtctaatttcctagttaatgttatactgcctcaggctctggcatacttgaggggtgagtgtagaccttcataggcatcagagtcctgacttgcagctaagtgtgtaggatgtgctggcccaacctcaattcttccactgcgggcacagggcagcagtgatctctgggtggcgttaggggaggaggtagccaagaacccatccctgggagataagaggaggcagggggcaggacggggcatgagccaagactgctcagggcatgcactactgtgctattggtctttacttacaaaacaaattcaaagataaaagtattaagaatttcaaaatggcagccacaccattaaagccaagtgtgaggcccccttctgaatgcggggccctatgtgatgtcagtggtagcacacccaggaagcagccctggttgaaactcattctcctttgggccccctggaaacttactgttattgagaagccttttggatttgtattcttttctatgtaatgtgtttttttccttcctggaagcgtttaagatcttctttttaactgtgttctgaga

SEQ ID NO: 27671 - DNA, 1062 bp, Homo sapiens
ctttatatattatgatgataagttgtcagatatgtgatttgcaaatatttatctcagtctgtagcttgcctttcattcttttttcatagagcgtaagttttaaattgtgatggttctcattattattgctttaaagtaagccttaaaattgtataatgtgatttcttcaagtttatttttttcaacatttttcgcctcttttaagtttctttgcttttccacgtaaattttagagtcagagtcagtgttactatgtgtacaaaagattgttaactgggatggcaattgaaatttagttaaatccttaaatcatcttgtgggaaaattaacaccttaatattgttgagtcttccagtccatggatgcagtatgtctctccgtttatttagatcttctttctttcattagtttttggagtttttattatacagattctgcatatattttaaaatgtatacataattacatcttgtttttgtttttgttttgtttttttgagacaggactttgctctgtcacccaggctgaagtgcagaggcaccattacggctcactgcagcctcagcctcctgggctctgcctcctgagtagctggaactataggtgcatgccaccatacctggctaatgtttaaatttcttatagagacagggtctccctatgttgcccagtcaggtctcaaactcctgggctcaagagatcttcctgcctttgcctctgaaagtactaggattacaggtgtgagctaccatgtccagactatgtaatttttaaaccgtattattttttaaaattttgatttccagtagttgattgctaatgtatagacatatgattgatttttaaatgctgatcttgtatcccgtgaccttgataaactcatgtattaattctggtgcttttttgtagatttcttgcaaatttctacatagactatcatgttatatgtgaatggatagagacttctttctaatatcaggattttggtaacaatctactgagagatcagataaaatttcagatcacgtaaaacaaaactggatatgctggtcctcttctttt

SEQ ID NO: 27672 - DNA, 1029 bp, Homo sapiens
tccatttatatttaaacatttgagcttgttaaggaccccttttattaagagttcaaaaactggccagtataaaagagcacagcgtctccaagaacagtttgtcaagactttactcttcaattttctacattttttttttaaggaatattgtgaagccaagagggggaacatagtgatattcagaatcatggaggcaaaaatgtaacaggtaatataagttccttccttatcagatcggatattaaagatcagctactggaaccagagaatactgagagatgtaaaatcaacttcatttcacactaaagtagaaaaagtagaaacagatgagaaaataacctcattctctaatctggcttatatcaccaagaatctgaagctgtattttaaggtgcccacttttaacatggatgcttttaactgtgtgcctatatttgatttctttgtaaggtctgagtgttggatatctggttctcttgagtagaattaagcctggtctggattcctcaaggtggtcactgtgacctagctctggatttggaaacaggggcatcttcagggcttggtgaggagacaagagcatgtgattttgcttaaggcacctggagtgcctgtgctgattggactgtcttgtcagctctgccactgttttctctgccttcagtatgtctgcctatggcaggccctttcttaccttctaattaccatgtctaaatgtgaacttgatgtggagaaaggaaaacaattatactctgctggtggcaatgtaaattacgtcagccactgtggaaagcagcctggagatttctcaaagaacttaaaatggaactaccattcaacccaataatcccattactaggtatatacctaaagaaatacaaggcattctactgtaaagacacatgcatgcatatgtttactgcagcactattcacaatagcaaagacatggaatcaacctagatgcccatcagcagtgaactagataaagaaaatgtggtacatatacaccatggaatactatgcagcc

SEQ ID NO: 27673 - DNA, 1055 bp, Homo sapiens
ttctcatttcctctcctactttaggctattgaattatctgagtttttgtaagctactgaaattctttaaggaataaatttgggatataaacatgaattaagtatccttagttactctgtttagaagacaaaacatatacaaattactagttttcacataatgactatactcaatagagctggcattaaaactgctactcttgtgaatataattaaactatacattctgtgcggtcaggggtcttggctaacttggtcacctctgtatctcaagttgctagtgctgtgcttggcatgtagcagatgctcagtaaatatttcctgagcgatttgaacaaacgatctttcagtaactaaagtttaccagtggtacagtctgtggatgctcagaagcaaaatgaaggcctaatgctctggtgtttcctccaccttttttggacacgggtaggggtgtggcaagggacaccgctgacccctctgatgctctgctgtctctctctctctgcagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagt

SEQ ID NO: 27674 - DNA, 1072 bp, Homo sapiens
aaaaaaaaaagaaaaaaccctcaaaatatgagatatccaaggaaaattcctcaatgtgattaagggcgtcatctatcaaaaacctacagctaaaatcatactaattggtgaaacactgaacactttctttctaacactgacaacagacaaagagggcatccactcatcacttctattcagtattttattggatgctccactagtacaataaagcaaataaaagataaaacttggaaaagaaatagtaaaagccatagttattctcagaggacatgaaatgaatctaacgaatgatgtgcaagacgtgttccctgaaaactataaaaccttgctgagagaaataaaagacaatctaaatagagaaacatgccatattcatggattggaaaacacagtaagatagccattctttccacattcagctatagattcaaagcaatctcaataaaaattccagcagacatttttaaataagaaattgacaagttggttttataatttgtgtgggaatttaaaggacctagaactgcaaaaatcaactttaaaaaagatcagagttagaggacttacagtaccagactttaagacctactgttaagctactataatcaaggcagtgttcctccacagaagaggcaaccctaaaaatcaatgaatcagctttggaatcagcaggaataccgtccagctctgcagtttcacagcattctgagggaagggaattgccagattggttgatgcagcagggtccaccagacactgcagaaattattaaatattgtctcagaattatagacggaaatttgtgtctcaggaggaaactggctgggcatggtggctcatgcctgtaatctcagcactttcggaggctgaggcgggcagatcacaaggtcaggagatcaagactatcctggctaacatggtggaatcccgtctctactaaaaatacaaaaaaaaaaaaaaaattagctgggcatggtggcacacacctgtagtcccagctgctcgggaggctgaggcaggagaatcacttgaacccaggaggcggaggttgcagtgagccgagatcacg

SEQ ID NO: 27675 - DNA, 1130 bp, Homo sapiens
attgaacctctctgaaactcaggttcttcatctgtaaatgataataaaatgtctcatggcaggtggttctgaaaattaaacttctctcagtgtattatatttctccctctttttttttttttagcttatcagtatgagagtttatatttgtttactctagctattcacatcctaactacatagtatactgtgattccatttcatttcttgtacaagtcttattatttttttggtaatagtcactctttcatctccaaactttcctcaaaatctgaaacattttctctcaataatttcaaaccaacatgtattcagtcagtttatttttccctccccttagaattacctttcctggcctcttctggcttcatgctccaatttggacagtttgctctctcagcttgatgcatagctgtgtcatctggaatcccattatcttctcttgttttggatcctctgtatccagatcttattttcttcctcattatttacctcccttcttcattctgtcaaggaacattcatcctgtagctttctgagaaagaatgcatgggaggtaatctctttgagactttgtagagctttattccactttcatactttattgaccttttggctgaatatagaattctaggttggaaataatttttcctcagcattttgaagatagtgcctcatcatcttttagcttcaggtgttgctgttgttgagaaatctgatgccactgtaataccattgctttccatgtgatcttttcttcccatttgaaagtttttagacccttctctcctttcttagtattttaatatttcatagtgttaaatcttcgtggggcccctttttcatgagttgtacggggaggttgatggaccttttcagtttgaacactcatcttcaattcttggaaatgtttttgaattatttctttgaaattttactccttttattttttctagtctctctttctaaaactcctgttattcacatattggataattctggcctagctttatgattttcttatatttttgactcatttttcatctttttaatttttttgttcttgttttgttttacttttcttctgctcaggacacttgcccaaattttccctgtgttactcttttgtt

SEQ ID NO: 27676 - DNA, 1065 bp, Homo sapiens
tctcgctcacctgacctccaaactgtctgtgtgtcaatatatttatttttctccatagatatgtaattcctcaaagagagaatggcattcaagtgatttggcgcataggaattaaaaagaaaaaagcaatgcacagaaattcattgaaaggacagaaattctttattaaatgtaatgggaaggtggaacactagcagctaccttctagctacagaatgcctctcttgataaattcccacatgttgaagaggaagctgtgtgtccggttttgcaaaaggaactctgatgttttggcttgtctagtgtcaggtaatgctggttgtgcttgtgggtagagatgaatctctaatactgaaaatactcctaacactatacatgcacatcagagactactagtccagtgtctaatttttcagatgaaggaaaaaaagcacggttcagagagatagagtgtcttgttcaagaatacagcaccaaatctggaactctgatttcctggttccttggctctttgttctgtccatttgtgtgttgtggacatctgtggatttgtttgtctaatcctaactctactccactggccttgtggttccagttgatcataccagggttaacccctttggtttttttcctcttagattttatgagctggcaaattcccctttctgctttagatttttctaattaggaatctgttactagcaaccaaaataatatgcattcaaattcttgttaactgctctgttttaatattcattgtggttctcctctcaaatttcttcagtgttttcgtccttaaagattatagcacaaatacaataagtgggtctgtaatttgtgtatagtctggatttacaacctaagtgaatgtccagattacatacatttaatcacagtgagtgtgtctcaccatctgtaattacagtttcattccatagcagttacagacttaggtatttaagggatctagttgagattattatagtgaataaagtttgatcttctttcttacttctttactaatccacttgttttttgcagctgcttgcacatatgttaatggaa

SEQ ID NO: 27677 - DNA, 1099 bp, Homo sapiens
cttgtagtttgtgtgtgtgcatgtgtgtatgtgtatttagttctatgcagttttatcatgtgtgagttcatgtattcaccacaagtcatgatacagaaccccttaatcatcacaagaatccctcacgttccccctttataaccacatcacctgactatcactcacccacccacccaccctgactttaatccctggcaaccaatagtctcctgtctctataattttgtcatttcaaaaatgttatatagatggaatcattcagtatgtgaccttttaggattgtctctttatactcagcaaaattccgtggagattcatccatgttttggtgtgtatcagtagttcatttctttttattactgagtggtattccctggtgtggacacaccataatttgttgaaccttttactcactgaagtacatctgggttgtttctatttttttagtattataaataaatttattttcagtattataaataaattaattactgtgagtgctagtgtacagatttttgtgttcgcatgagttttcatttcttgacaataaatgcccaaaagtatgtttgctgggtctttgggtgtttaaggaaccacagagttgttttccggagtcatattcccagtagcaaggtacgagtgattcagtttctccacatctttgctaggtttgtcactatttcttatttaactattctgatagatctgtaatgatactgtttttgttcctagtcatctgctttttaaaaaaattgtggtaaaatacacatggcatgaaatttaccattttaacctttttttttcctttcctttttttttttttttttttttgggagagagaaagggggtcttgctctgtcacctaggctggaatgcagtggcaccatcatggctcactacagctttgacctcctgggcttaagcgatcctcccaccccagcctcccaagtaacttggactacaggcatgagcagccatgcctggctacttttttatttattatttattttttagagatggaatctctctatattgccccggctggtcttgaattcctggcctcaagcaatcttcctgtctcggctttcccaagtgttgg

SEQ ID NO: 27678 - DNA, 1061 bp, Homo sapiens
ccagggcattgtgtttttataagactttgcttcatatttgataagcatatttctctttttcaaacactaaaatcttttttctttgtagccatctggagcttgagggattcctaagaaaatgtattcttttttgtctattagaaaaatcaaagatgtttctccttcactgttataaatgctgtgatatttagctggttatactcacatgtccaaactgcaaaataaggaaaatataaattaagcgtatctctttgggcaatatttgccactaattcttgggctctaggctttatattttcagaattttatttatctttttatttaacaattattcattgacagctatgcatatacaagatactttgctggttactatgagagattcacagataaataaaacagccttgctatcaaaaaaacttgcattccagcggaaaagaaaaaaacaaatgcacagtaaataaaatataaggtgaataagcactgtactaaagttcaggaaatataggaacttgcattctgggcaattttgtgaaatggagatcctggaatcttctgactacaaataatctaaaaatgctagacaaaatatttaaaaaggcaaaaatcacactttcaaatgaatggatgaaaatttttgtgtaaggtagtcctagatgtatgaaactcccaggagtttgggagaaataagtgaagatcctttctgaaggagtacactgtcagctcagatctcaaagaaatctcatatatgaatctaaaatagaaggataaaataaagtaaaacacgtaaaagagagttaccatgagagagagcatgtaggtcaacagaaactttaaccagactaccaaagactttatttatttgtttgtttgtttatttatttatttgagatggagtttcactcctgttgcccaggctggagtacagtggcgtgatctcggcacactgcagtctccgcctcctggattcaagtgattctcctccctcagcctcccaagtagctgggattacaagtgtctgccaccttgcccagctaattttttgtatttttagtagagac

SEQ ID NO: 27679 - DNA, 1580 bp, Homo sapiens
tctcatttctcctgccagaaagaaccactgctaacagattggtatgtatatttatggctttccctcactcctttcctgccatcctcccttttctttctttcttccatcattttaaaaattatatagaagagatttttaatgtattgttttgcaatatgctttccacttaacatagcttaatgctcttaatatatcagtatatatagttttatagccaaatatttcatggttccataatttattcattcctctactgaaagagatttgtctgtaatttttgtctgtatcattttactgcatataagtgcttacttctctatattcttttaactaaacattttatatgatttcatttcctctcttttttagcatgtaagttattttttttagtggttgctctagagtttggaacatacatttacaattaacctaagttcacttttttttggtaaaaatttaaggggttcaagtgcagttttgctacatggatgtattgtgtagtggtgaagtctgggctttcagtgtaaccatcacctgaataatgtacattgtacccattacgtaatttctcatccctcattccctgactctcccacccttttgagtctccactgtctactattgtagactctatgtccatgtgtacacattatttagctcccatctataagtgagaacatttggtatttgacttcctgtttgtgagttatttcagttaagataatggcctccagctccatccatgttgcttcagaagacatgatttcattcttttttgtggctgaatagtattcgtgtgtgtgtgtgtgtgtgtgtgtgtgtatcatattttctttagtcatctgttgatggacacttcagttgattccatgtctttgctattgtgaatagtgctgtggtacacatacgagtgcagttttttgtgtaatgattttccttgagtggacacctattaggttggtgcaaaaataattgcggttccagactgtgaattttaaatcattataactaggctcaaccattattgcttatgggtctaataatttgtttttatgtatttttcctaaagtagctagtaacttactaaaataaagatttttttctcttactgcaatttgaaaaaactccgccaccatcttaagtgtagggtttgtttaaatctatttttgataaacaagactttaatgtgatagaccaaatggaggaaaattgaaaggcatttcagagattgaaatgtttttgtttccacttgcattaccttatgccaagatcagggctttggtttgacttaatattggaagcataaaagagaataaccagtctgcacatttctttgaaaaccactcttcatgtaacatacaaaactcataaaaatgggtactgtaaaaatagtgccttaataatacttcatgctaaccagctgattatagactgaatgcttagttaagtgggggaagaaataagtagtttcctttttagttgttctttttaaaagattacacacatatacacatataaaacctctttcagtgattcagatgtgacttttcctcttcatggttatttttaaaccaacttgg

SEQ ID NO: 27680 - DNA, 1029 bp, Homo sapiens
cttgtccatattctcagatttttggggctttggattttctttgtttatatctcctttattcatgtgatgatattagcctggtttctgcagtgactgttatggaatgagcatgttactaggagtcacaatacttggatcttagaatcttagttcttccaaatcacttttcttgtttgtcagatgagatgatagtactttccttgcaagataattctaaagccccagatatacagtagttgattatttaatcagtgagtcagtgagtcagtgaccctttctccctaaaaaaattaagttttctataattgaatttaatctaagtatattttttcattaattaacagcttttaaaaagggttttctcaagtcatctgcctattgcaagcctcttaactatattttaaccagcaagttattaaagttctaaaactacattcagtggtaaatattttgtcttgtgaggaatataaaactattaaagctaagccatttagtttttcaaatgaggaagctgaagcatagatgtcataagtgactcatttcaggttctacagccagagctggttctcctcatatgtgatccttctctctgatggaacaggaatccagatagaagattgacaagagcatcaactgaacattacaaacagtgttgcttcttttatggctactttcctaatgaagttctcaggtgtggataaatctaatgcttatacatatactctgtttcccagataaatacaatatagtgatacaatcttagcagcaccaccatagataagaataccacttttactggtgatggttgcctctgattttttttcctccttccctgggttcatttgtccctgatgctctaattagagtgttataatttaggtaactaaatttaaataatttagaacagaaagcaaggttctgctttatctcctgtattaacactcaaaatgaatattgggtaaatttctacattgagatgtgtattagggttctccagagggacagaacttataggatatttatgtatat

SEQ ID NO: 27681 - DNA, 1040 bp, Homo sapiens
aatgattctctttttcaagtaaagctgtagttcagagaggtcaaacagggcctgaatgcccgaggaatatagtgtgtcttccctcaatgaaggtagaataatgtgagaaggaagaagaaaggctaaatttaaatttaattagctatttttatttttactagaaaagttatagattaggtatttagagagttaaaaaaatcatgtaattttcatttaaatctgttcttaccaaaaccatgcatcttttatttttggctaacagagagctggccatagaaaatggatgtttttgttttgaaaaatcaaatatagtagataaaaaaatgccaccacaaagtttgtttatatcttcatttcacttaaattgagtagaagaagtggaatctggcctttttcatattgtttatgttctgctttgcttcttggttctggggcaagattcctagttgtgtttgaatttgttttcctctcaagtatcatttgcaaaattagtgtggaaattaataaactctttctgttcaataagtgttgtaactgtcctaatatgacatagtataatgctgtttcattagcatagtaaaattcaaatatgtgctcatttagcctcattctactgttttttttttaagtctagaaaagaaggaaggtgctttgcataagtaaccaatataatctttatttattaactttcattttaggttcaggggtacacgtaaaggtttgttatataggtaaattgcaggggtttggtgtacagattatttcatcacccaggtaataagcatagtacccagtaggtagttttttgaccaggaaggtgaaagatctctacaacaagaattacaaggccagacgtggtggctcacgcctgtaatcccagcactttgggaggccaaggtgggtggatcacaaggtcaggagtttgagaccagcctgtccaatatggtgaaaccctgtctctactaaaaaatacaaaaattagccgggcgtgatggtgcgcgcctgtagtctcagctagtcaggaggctgaggcaggagaa

SEQ ID NO: 27682 - DNA, 1051 bp, Homo sapiens
aacagaggtagaaaactggccctgacattgggatggcattgcatgttactcactattgggcatgttttgtaccaccagggatacagacatcctgcatcctaattaaaaaataaatatgtcctgagtgtctgttgcattcagtgtgatgtggagtggatcaaacctttccttagggagttcaggccaggaagtattcttgaagggcacatgccttgagcagaactatgtcattctgagatatgaccatgtggatccattggctagactttccctagctgtggttaaaagagggattaggaatatagcattcatttcagccagttcagcatttcctatcaaactaagtactgtcatagtgtatcagtatatttaagggaagttagaatttagagcaagaaatataaattctagatgtaagtaccttttcctaacagacttgatgtaaaattttgttgtggcacactctacttctgagttttccagtttgctttagggaaacatctcttgtttgaattctgcttccactatttagaaactcttcaatgttgctaaacttctgagatgggcccgggagctcattgacttttctggtgatggctttagtgtgtcattttgcttcttagggatctctcagtaccaaccaagtcctgctcagtaatgtgagcaataaatcacacaggatgaggagctgttcatgttgaacccggcgttgggcctggctcttacatgcatactggtggtgggggtaagggtggggtctagggttgtagggcaaggtttgaaaaccaatgccctagcataagaacaccaccatgactactattaacctaaaaacctaccgtaacccccctttttaatatatgagacttctttttccatgaatttttttcttgcctcccttaatcattgtttctatccagtagtgtagtgtttgtctctcttgcacaggtgacccataaactttggaggtaggagacagcggctcatagtcagtaaatatcactatgtgccttaaacatgtgggacctgggacaaaacattgaaacacaaa

SEQ ID NO: 27683 - DNA, 1050 bp, Homo sapiens
cacttataagtgagagcatgcggtattttttgttcctgtgttagtttgctaaggataatggccatctccatccatgctcgtgctaaagacatgatcttactcttttttatggctgcatagtattccatggtgtatatgtaccatattttctttatccagtctaccattgatgggcatttaggttgattccatgtatttgctgttgtgaatagtgctgcagtgaacagatgcatgcatgtgtctttatgacagaacaacttgtattcctttgggtatatactcagtaacggggttgctaggtcaaatggtagttctgtttttagctctttgatgaattaccacactgctttccacaatggctgaactaatttacacttccaccagcagtgtgtaagcactttttctccgcaacctcaccagtgtcttatcttttgactttttaataatagccattctgactggtgtgagatagtatctcattgtggttttgatttgcagttctctaataatcagtgatgttatcttctttcccaccttaaccccgatagccactaatatattttacatttgtataattttgtcatttcaagaatgtaatataaatggtatcatacagactgtaaccttttggtatttgcttttttttttttccttcctcactataactctctggagataacatccaggttgtgtttatcaatagcttgtttttttttcattcctgagtattcatggtatggaggtactactactgtttagccatttacccatttatgtctgggttgtttccaatttttggctattatgaataaagcttctgtaaacattcttgtactttttttgtagttctttttaaaattatggtaaaatacacataacataaaatttaccatcttaaatatttttaatggtatagttcagtagctttaaatattttcttattgttatggaactaacagtaccatcaactatagaaccctcttcatctcgtaacaccaaagctgtacccattaagcagtaactccccatgtgccttccatttagtccctg

SEQ ID NO: 27684 - DNA, 1048 bp, Homo sapiens
tacaatttggcatgtttttgcagtgcctggtactggttgttcctttccatgtttagtgcttccttcaggagttcttgtaaggcaggcctggtggtgacaaaatctctcagcatttgcttgtctgtaaaggattttatttctccttcacttaggaagcttagtttggctggatatgaaattctgagttgaaaattcttttctttaagaatgttgaatattggcccccactctcttctggcttgtagggtttccaccaagaaatcagctgttagtctgatgggcttccctttgtgggtaacctgacatttctttctggctgcccttaacattttttccttcatttcaaccttggtgaatctgacaattatgtgtcttggagttgctcttctcgaggagtatctttgtggtgttctctgtatttcctggatttgaatgttggcctgccttgctaggttggggaagttctcctggatgatatcctgaagagtgttttccaagttggttccattctgcctgtcactttgaggtataccaatcagacgtagatttggtcttttcacatagtcccatatttcttgaaggctttgtttgtttctttttactcttttttctctattcttgtcttctcactttatttcattaatttaatcttcaatcactgatatccttttttccacttgattgaatcagctattgaagattgtgcgtgtgtcacaaagttctcatgccatggttttcagctccatcaggtcatttaaggtcttttctacactgtttattctagttagccatttgtctaaccttttttcaaggtttttagctttttgcgatgtgttagaacatgctcctttagctcggagaagtttgttattaccgaccttctgaagcctacttctgtcatctcctcaaagtcattctccatccagctttgttccattgctggcgaagagctgtgatcctttggagaagaggcgctctggtttttagaatattcagtttttctgctctggtttctcctcatctttgtggttttatctaccttttgtct

SEQ ID NO: 27685 - DNA, 1074 bp, Homo sapiens
ggtttaaaaaagtctaatgagtaataataggtgaaatatgaacgacagacttttggaaggtaatttataatcttttgtgagaaaactgatgaatttggcagaggttttgaagatcttgttgtaacctttgagaaagtttggttaattcattctgaaaactgattattttggtaggtagaatactgtgtattaagaatagtgataggggccgggcacggtggctcatgcctgtaatcccagcactttgggaggccgaagtggacggatctttgggaggccgaagcggatggatcatgaggtcaggagttcaagaccagcctggccaatatggtgaaaccccgtctctaataaaaatacaaaatttagctgggcattgtggcgcgttcctgtaatcccagctagttgggaggctgaggcaggagaattacttgaaccaggacccaggaggcagaggttggcagtgagccgagactgtgccactgcactccagcctgggctacggagtgagactctgtctaaaaaaaaaaaaagaatagtgataggaatagcttttacattttatatagtaaaaggcaaattatacaggttcctttgttaaaaatcttttgttgaacttctgttattaaaaatggactgtgaagttttttattcacttgattcatgctttaaagctccctatggtcaggggagatgctaattcatggttaaaactcgtttcttgtccaaatgctttagtgtttataggggagattatattgggccaagtttttagtcattctgttaaaaacagttcattgtcttggatctctgtgtaatacaaatattgcttgcttgtaaactctagggaagtcctttaagaataacttattcaggtgactgatattttggtatgtaagagaaagaaagtaggtattttcattatatatttatattattatgtataatactgttatacatttgtctgtatctctacattttttttgctgttgttcagacagattcttgctctgtcgcctaggctggagtgcagtggtatgatcttggctcactgcaatctccacctcccgggttcaa

SEQ ID NO: 27686 - DNA, 1046 bp, Homo sapiens
ggttacatagcataccagtggccaagctgagaccagaatccacagttactcagaccagtgttctttcttctgttccccactatactgtttctatactgtgtgttcttataatgcttttggtatagctttgacttttagtgctgtgacgggtagagagatgcaaagctgaatgatgcagtggagtaatttttatacttctattgtagtcagtgtttgtggaaatggatagtaaaatggagaaattgggtgttttgggaaaaactctttctgactttgtttttcctctgctgtcacactacaactatcaacacagaagaagacttctgtgaccaaatgggtagggagttttctccacacactaaccagtggacaccggctgggtgacctccaattccaacactacctggagatagtgtcagatcccatagattgggggctcggtccccaagactgcctccaccctttcagacaccagtctgaagtctggacatccagaacttctgattgactggcttcaagttggggttcccacgaccccctctttaggttcaattaatttgctggagtggccacagaccttagggaaacatttacacacatttgctggtttatcataaaggatattacaaaggatacagaggaaatagggtaaggtatgggggaagggctgtggagcttccatgcctccctgggcgctccaccctccaggaacctccatgtgtccagctatccagaagctctgtgaactcgtttctcgggtttttatggaagcttcatgatgccagcattccttccccacaactacagggcaggaccctctctggggaaggtcttaagatgcacaattagaaaggtgagggaagagtacagtcctgcccttaagaccgaacacaaaagactatagcaagggctaaggaacttatgagccagaaaccatgtatgaaaataatatatatgtaacaccacgtggggtaagagccctgctcccattgatgtgctaactaactctcttcttccctagaactccttttcaaactcagtaggca

SEQ ID NO: 27687 - DNA, 1034 bp, Homo sapiens
tgtaaggtttgggacatttaagtccttgagttgttttttttaatatgaggtagggacctgattttatcttgtgccatatagaaaatcttttttatcttgttccatttgttgaataatctctcctttcctctagtaatgtgacatgtcacctctcatgtaccagagtttcagaactgtgggtttgttgcttggctctgtgttttactggtcagttcgtctgcctatccctagaccagtaccacacttcagaaaactggatgaagaacattaacgaccaccacatctagcccacctgtaggccagcttgtatgggggttctgtgaagaaaatgaactaaaatgcaaaccaaaagcaacaattgaaaggactgtagtatgtggtatccttggtggagagccaggtttcagttagaacaagataaagaaaatgctcagagatataatgagattctgctgatgatgtactgtgagttccacagaatttagtgatagagagttggcagggaatggggcagaagaattgatgtattgttaccttctggggatgagaacatgggatattagggggacaagatgattaggggctttttgcagtgaccaaaatgaatagggagaaaaggcataaatagattattcctggtgggatgattcctgggggcagattgtgatagtgaggctgtgaatattgaggattagggagggaagggtattggctattatcttggatgcaccaagccagtccccgtcttagcctctttctgggaaggggcaattttactgtgagctcacaagacttcctcttgactcctgtgcaagtcaggaagccagtgtgactaaagaacaagtattttaatacctcagggcccacttttgaatcctgtcaggagagatgtggtcttgctctacagtgttgtcttgggtacctggcttttaacatattttaggtgttctagagttgcactctgatgtaggtcattttttgcttgttagctttaatcttgcttggaattaaatacccaaaatactgaagattat

SEQ ID NO: 27688 - DNA, 1022 bp, Homo sapiens
cagtgctttgtgtggaaccttaaaaaaaaaaaaaaaaaaaagaatgtgttgtagttaagcaaaatcaaacttatagactcttaagcaaacattttgcaagatcaggaatgtcttttagctaatggttttctagcatattttataatagaattatctttattggttttacttgagaaggcagtgtgtaatagcaaagtaactattctgtgagttaaattatagataaacacacgaattcccacacactcctttcctagataccaaattccaatccaaatatctgtaccttgtgagaataataagttgagcttaagtatttaatgtttataaaggcaaagtcatgaaggaaagatggtttggtatgaaggccagcttgtaatatgtttttcttgaaagaattacatttattttttaaagggaaatttttgtgtttctgtataagtatgcttaataagtttttcccactttaggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtaatccagtgtatgtattaccaatttaatcttttagtacaacatgattataagaagtaaaatatttgaactggtagtgatctctgttttatattctaaaatgatttttttgcttttcggttaactctatcccatggaacatcactcctaagaaagaaaacaaacaagacagtgctaaagtattatgtatgaatcatccccacatctttgtcctttcagacatattggctctgtttttaagatggtgtaccttacacaataatatttccttgcaactgcttttagagctaggaaccagatgaagttaacttttaaaaatgcatggaggaaggggcagaggaatttgaaaacagattgttatctctagatccatgctatccagtatagtagccactagtc

SEQ ID NO: 27689 - DNA, 1024 bp, Homo sapiens
gtgagcagcaaggtgaggaagagttggatgctaaaaaaatgagctcatcggagtcactggtaaatatcagaacagaaggaaacaatggactgggatatttttaccacaagttctcagacctttataaagataccagcagtcacctgcttcaggctggcacaaaggtgatcagccaagccaggcttgtggggaatctgtgtgccccgagggggctcccctcccaggtaacaacattcgtcagaagcctgccatttctgaagcacttagccccacacatgcccttgaagactgacatgcagtcaacagaatctcattctccggaagctcgggttggcagcagcgagagcgaagctgcagggagcctgaggccagcagagggtgcggcgccttaccgggcctctgtctttgcagctacaggtttaccaggttcctcgccaagctcagtttttcgccttgaatatgaagatgctagaaagagctctgcatttaagcagagccttgtgcaattcccggaccaaatgctgaaactgcaagagtgccctttaaaagaccttcttaggcatgtgacttgttctctaccagaacctttgggcaacatgaaggaagtcaaaggcatttactggcttgctgttgctgcctgcacagcacctgaccctcaaccagcgtgtttgctcctgcttcagtcaactttatatgctttggtcctgtcagataatctcggctcaatgagcatttttcatgctctacctctctctggtctacaggagattcagattggctttggtggacagagtgttcgattcctgagctctgcagagggtcttctgctcactgtattcagttacaacaaatacctctctcaacagctgtgtcgtgacctcctgtgtgtcctgatgccagagcctgatgccgctgcctgcgctaatcatcccttgctccagcaagatctggttcagctttctcttgattggaaaacagaaatccctgatttagttttgccaaatggagttcaggtgtcatccaa

SEQ ID NO: 27690 - DNA, 1116 bp, Homo sapiens
cttcttcctgtcccaatgaaaaaactccccttttgcctttctcagactaactgcccctacctgtactatggatgctataggattaatagctagtatttattaactaagttaacagtggttgtgagtaccctcattggatcctctcacccactgaggactaggattatttttgagcctgtgttcagatgaggtaattgaggtgtaggaaggttgagagattgtcccttggtcatataggagccagaatttggtctgggctgcacccatgcctgaacccttgctctcagctatggcgctaccctttcctttcctgcccgctcagagacctctctgtctatcagatattcccagcctcttcccattttttcactcaatctctctgtctcctgcttgttgatacaaggatttaaataggcacaagtctatttcatctgttaaaatgagcacccattctcccaaaaccaccacctcccctttacaactaaacctaccaagaaagcgctctactgtatttacattcaccatctccaggttcctctcactcactcatcagacctctgcagtccagccccagccccagcccagcaaaggtctctccaagatgaacctccacgtcatgaaggtcattgggtgctccttgggctctgcattttacttggcattcctgggttattccatgctactgatctctttctctttctttagataccctcttccctctgccctttccagatttttctctgagtctctaactgctcactcccagcctcattagagggccatttatctctgcccgtcactgtgaagtctgtaatctttctgactttgcagcaagctcctttattctccttctacacgtgtgtcctgggtaacctcacccactcttggggcttcagttcttgtcaacatgccagtgaaggccaagtccataccttcagccttgataagggcctgcataccagctcgttgaatgtttcgtgctgcctgctggacgtctcagttggatgaccctttgtaaacattggattctataagtgtaaaactgagcttagcttgaaagcaggacagagaagagattaaaattgtgggctctagaatcaaacctgattctgccag

SEQ ID NO: 27691 - DNA, 1009 bp, Homo sapiens
ccccactgtaccttcaaattggaggaacagaattgattttcctattgttactgaagagtagtagtgatggccagtggtggtaactggaatgaagtgagagctgagctgactctctcttgtaagtgaaggcctggggaaacattaagaagctcgagggcatcctgccccttccctccccctgggaagaggaccccttcccaatcattagggagcccaggaagagagggctgggcctcaaacaaagcctgtggtgcctcaggtgagacctcctagccctctgtcattccatctggctagagaaaagtgggtggactgcagactactcagtcaactagaaacgtcacagatatggccaggcaagcatcaaggagtttcccatcctatgttagggcacatggaatatttgcacagatacgcctaagcatatacgagatgaaaaaaatgtagaacaattatataaacataactatagctatgggtggctgcatagatgggcagatgggctggtagagaacaagaaagaagaggaatatagcacgcaaaagataaaagatcccaatatagatgaaatcacacttcatgggagagaagggaattccttacaattgtttcattcggtagaacaaatgaatgagaaacatgaattcaataaacaaagcaagatggtaataaaaagcaaagtgagatgaaaaaagaaagattgtagaataaagaaagcctttgaggcccaaaacaacatcattgcaggactaatacataattttagaaaatatcaaggaaaagaatagaccccactgaaaatcaaattactaagagaataaaggcttgttaggcccattgaacacaaatggaatgatcaagatagtaaagcaatcagaaactgaaagaaatagaagacaaagaccagtgtaatataaggacaattggtgttcttgaagtagacggtcaacaaatgaaatagaaaatggaaaataaaacaagacaagctttgtgaaatgaaaaataagta

SEQ ID NO: 27692 - DNA, 1074 bp, Homo sapiens
tgatccacatgttatgtagaagtgtgttgtttaatctacaaacattttaggattttccatttatctttctgttgttgatttctagtttaattctatcgtggtctgaaaggagaccattttttttttttttttttttttttttaagacacagggtcctgctctgtcacccaggctggagtgcagtggcaccatcataagctcacggcagcctccaactcctgggctcaagcagtcctcctgcctcagcttcccaagtagctggtactacatacatgcaccaccacacccagttaattttttattttttgtggagatagggtcacactatgttgcccaggctgctctcaagtttctagcctcaggcgattctcacacctcagcctcccagagtgctgggattataggtatgaaccactgtgcccatgttcctttacatttgttaagatgttttatggcccagaatatggtctgtcttggtgaatgttccatgtgacagtgaaaagaatgtgtaatttgctgttgttggatgaagtagtctataggtgttaatcagattcccttaattgacagtactgttgaatttaagtatgtctttactggttttctgcctactggatgtgtgcatttctcatagaggagtgttggaaatcttcaactctctaatagtagatttgtttatttgttctttcagctctgtcagtttttacctcacgtatatttactctctattgttatgccatacacattaatgtttgtagttttggagtattgatccctttattgttatataattttccttttttttttttttttttttttttgagacggagtcttgctctgtcacccaagctggagtgcagtggcttgatctcagctcactgcaatctcctcccccagggttccagcaattctcctacctcagcctcccaagtagctgggattacaggcacccaccaccatgcccggctaatttttttgtgtatttgtgatagagacggagtttcgccatgttggccaggctggtctcgaactcttgacctcaggtgatccatctgcatcagcctcccaaagtgc

SEQ ID NO: 27693 - DNA, 1027 bp, Homo sapiens
cctgccttcgttcacaggaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtgctgcggtctcgtctggtcttctgctggggctcccccacccgctgttgggcccaagatgaagaaccaaggggtgggggcgcactcgggaagagagtaagcgtgggcctcagctgctttgaaggcagaggctctgcagctccgcgtagcgtggggtggggctgagactcgctgcttccggggcccccagcagttttccttgtcacctcccagacctcagtgccctccgggcaggataagggagcagggcctgcgacacctgagagccagatacatttactgctgccccgcatcccggaggggctgaggtttgtgagcgcggctggtggcccgggctgttgcgtgatggaggtccgggaatgaacaaggggtctctgtcctggctggggcttagacacccacaccccaggagggtgggccagggctggagcagcccactgcctgccctcgggaggtggagtttcacctgc

SEQ ID NO: 27694 - DNA, 1034 bp, Homo sapiens
gccggccaacacctgggtggggtggctcgagtcaggggccggagtccttgtgaccatcacttctggggctcgcctcctgtagcacatgcccacagtctggggaggcaggtcctggccgccgtggctaggggtccatgcagcagtaggtgggggaggcatggagggtgtcctgcattccctcgcacacggtcagatgtgtcctaggccatcagttcacaaagttcccttgtcctgaccctcgtcaccaaagaagcacctccctgtgtgcctctcagcagaggcagctccccaggccacagcccatgttccctggcatttgggctctgcggcttggggactgggaaaggaagccagctgccctgagggcccagaatgacccacaaccaaaccttgtccaccttcctttcccaaaaagcatgggcaaactttgtttctcctggtggtgtttgttggggtagagaggttgttgttttgctcttgtgttttaagatcagattcttgggccacacagcatattactaggataatgaactcatgttgtagttaggattaatctgaattttcttgcatcatgtagatgtgtctggcagaaattggtgcttttatttccttctcaaacagttgatctgaaagttatgtgtaggctgggccatcctgctctggagtagagaggagcgattcagccccagatattctagaattcgggcagtggctgccaagggtgtgattgtcagtgtgtccttgccactggcctgctgacacctcttcctcggagtctcattcttttggggacgctcttggggtgatttgccggcggaggctgtcacatgatgcagggaaaagctgtgagggccccaggagagctctgagggcagggtcacgattccacctctcctggaaacccagctctccggtgtcaccaactgggactctggtgacagctctggggtcagtgctctggatggcggggggaggggagggtgttgggggctgctcaggcttccctgggagctcacgctgggtgaggtgggggc

SEQ ID NO: 27695 - DNA, 1031 bp, Homo sapiens
ggggtgtgcctgcccatgattgtgttttaaaggctcctggacggttgtggtccatctgggcctggaactgggcttggtctgtcaccatcacgtgtcattcctacgaaggatctagccagggcccccaggctcccagtatctcctgtcctctccagactcagggtccttgtccacagcctggggctgggcagaggattccctgctctccagtctgacaccaaagattctgtgcctgtcaagtctgtgattgacagtgaggcctttggcgccagctgtcgggttcaggtcctggctctgccacttcctagcaagttatttcagagcctcagttttcccatctgtactatggacaggatagtaggagctgtcctgcagggtgactgtgggagttaaccatgctattacacccagagtgcctaggactagatcagtgcttttcagaaaaagagctcaatgtgaactctacaaaattttattcaagatatctccaagtcagactggcggttgaggttgtagaaaatgtctcttttttgctgaggtgaaaatggggctctttccatattgtgactgtcctgccttcacctgaggccccttcactgccagccagctctgcaggaatgagggcgggggtggcctgtgctgaccttcggtcctggagcactggcatcagggaggtgccctgcccctcattgcctgtctctccccggacggcctcttggggcctgcttggaagaaagtacccattgaaggtgctgatgacatccttctagaagaactgaatcttagaaatccaggagggccttatgaaagtccccagctgggcccacccagccacgggacccgcttctgaaattgttcagtgtgattggctgtgctaacaacattctcttcaaggcaaagacagttgtcacctgaggtcttaagatggaggcccgtggtttccatcaaagattttaagtttggggttcctgaaggtgggtgggtttttgtttgcttgttgctggaatcagagttctaatcaatgttagtaa

SEQ ID NO: 27696 - DNA, 1035 bp, Homo sapiens
aagacattctcttgtatggttacagtatggttgtttgctgtgataaacttaactttgggtctacaatctgctctctgtattttcatgtttgtcttgatgtcctctacaagatccagtctaggattgcatctggttgtcttagctattagtctcctttactctggaatagttcttagtttttaacagtatcagtctttttagagaatctctttacaaatcctgtatttctgacttttggtaggtttcctcatgtttagatctggttatgggctcctggcagaatagaagtaatatgcccttattggggtgtcacttctgattggacagtgtgtctctccttcattcgtggtggtaattttgattactcaattagatagtatccaaatccagtttctccactgtgtagttactattttaacccccatcaatctgtggtgaggcaatttaagaccatgcaaataccttggtcttcatcaaacttcctccctaggtttagcatgtattaatgattcttgcctaaaccagctgttactctgacgattgcagaaagacgatttccctcatctctagctctagctttcctacccaagttggcacttgtcatcctactacaaaaaagccttcccttttctcagaaatttcctttatctttattagagtcatggactcccagtttttaaaatggtttagaattcattattgtattaccaagttatttttgatgcctgtccagactttgccaataggagcacctttaagctggcatgtggttgtaacagcctaacccgtcttttttagagtgataggccatgctaatcttactctctgctccagccttgaaactggccattttttcaaggagccagggttctttttctttgggaacagttaccagcatctgagtatgctcatcgtttcggggtatctctgcttctgtgcccttcagtggactgagctaggaaatgtatgtgtgtgtgcacacatatgccgttgcacacacatgcaggtttcagggatcacaagtccggtccatgt

SEQ ID NO: 27697 - DNA, 1050 bp, Homo sapiens
gccaccatgcccagctaatttttgtatttttggtagagacggggtttcaccgtgttggccaagatgttctcgatctcctgaccttgtgatctagctgcctccacctcccaaagtgctgggattacaggcgtgagccaccgtgcctggccactttttgtatttttagtagagacggggtttcaccatgttggtcaggctggtctcgatctcctgacctcaagtgatctgcctaccttggcatcccaaattgctgggattgcaggcgtgagccaccacacccagccagaagtcagttttaaaacttaaattatttgagagtaggtatattttcaatttgattcttacaagtgacctaagggatctggaaaagaggtaaaactttgcatggtaaaggtccggcatgcccaaggctggacttggttctaaagcctgctttgttaactgttgtaaacggccactgtaagcattgtaacatctgtggcctaagtcagagactcaagtgttggccagcagggctaaggagtactctgagcccttcaagcttaaggggggatggaggcagaggcaagtgagaggggaagagtggagcctggcaattatttagcaagttctgtagcactgtggagtgggtttgttgactaagcagaaggaatgctgaacttttggtcacacttgatgcttcccgagtgagagtacaaatgctgacttagaagctctagtcatttcacaagtttctacccatgtttgtctcatctggagggttatatgctataatatgagaaagttcatttaacttgcgcctgggggacattgagttaatgatggcctggatgctgaggggttttgccaatactctcttttagacagttctttaaggcccaaatacaacattgcattatttgcttatttggtggttaggactgtcatgtcaagtgattggagttttgcttgaatcccttcctagggcgaaatgtctgggcaaaatggctgctagtgaacctcggatgtttgatatgctgtggttgcagtcactcataacctagtggtttt

SEQ ID NO: 27698 - DNA, 1201 bp, Homo sapiens
tcactgcagactcaaaatcctgagctcaagtgatcttcccacctcagcctcccagagtgttaggagtaaaggcataggccaccgagcctaggtgattttttttaaggctttgctgtgttgcccaggcttgtctcaaactcctggccgcgggcgatcctcctgcctcagcctcccaaagtgctgggattacagacaagaacctctctgcctggctgggtttcttttattcatttgttggacctgctttcttggtagcagtggtgtattgattcccagtaggatttatctgccaggagatccttacagatcattagttcagctgttttgctttgtgaattcatttgaaagtattataatttcggtacttagtaattagatggatttcttgacatgcattagatatttaaggcagtaatttaactctggttccatgttgattccattagtacatgggcttgcagccttgtgaaatgatgattcagtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctataatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctcaaaaaa

SEQ ID NO: 27699 - DNA, 2106 bp, Homo sapiens
cctaatttttgtattttttggtagagatggggtttcaccatccagttcaacatgccgggattacaggcatgagccattgtgcttggccaaggctgttaagttttctagatttgtttctgagctgtaaactcctcattcggtgagacctagtggtcatctaaactagaggttgagtttaaaattcagtttctcaacctggggagcactgttgacattttagcctgatcacttttgttgaggagtgccctctgggttgtaggatgtgaagcaactgtttttggcctctgctaggacgcggcctcctcccctcccatggtgataagaagtcaaaattgcctgtttgagaatcactggtttaaacggacttccttctaaaatggtgtgatatgggtggggtcaggttgtgttacagaagctagtctttgtgtgcttgttgcgaatttttcaggttttctattaatcttgcctaaggaaataacatgccatgtaaaaattagcattgttggatatctttgtgagaataaagcttttccactaatactgaggaaccttaacaaaaggtggtgaaagatggttttcttcagcaggttctgggtacttgagggttgcaaagggagggcttcgtgtttgtgtttgtgagtgtaggctttggacactggaaacttacctgagtttcttgtgctgcagaggggaacttggtttaaaattctgctgtttcagcatttttctgtctttattatcagggtcttgatgctcgagcaaattaggtgagaacagatctataggttagtaccctgaatgtcttaaatagcccgtggtcacaacagtgtgtagtgaagttaaatagtatttaaggaaacagtctaacttttaatgatcccaatagtgagaaacggctattaaagtgtaaattaagtttctctgcatgatctaactttccaaaaagtggcttcttcacccttaatacctgttttctgattggccattgaggtactctgacaagatctcctaaaagagatcttcacaccttcacatgctgcctaaaggcaaaccatagtaccccaggaggagtaagttgcagtttgaggggcagccaacacttaagtttaaaaatgggggtccttggcttgactcttctttttacattttggcataacttttttaggcattcctatatggtctggagagaaaactaattttctgcctgaaaagctcagtttctgaagggcacactcctaagcattctagtcatggtaaatggtgaggaatacaaatccagatggctcccttgtcagggttttcactttttctttcaagagcaccgcagagctaggacattgtgctgttagatacttggtagctggtgggtgataaaatgttggacttcttccctcacccttcctatatctttcatgaattttgttttgaattcttgtatttattttgtttagaattctttttctcaagacagtcttgctgtgttgcccaagctggtatcgaactcctgagctcaggccatcttcctgcactcagcctcctgaatgggcccctggtctgagtattggaatatttacatctgaatgatttgggaaatttgctgtacctcaaactcaagagtgaaagaaatgtccaaccaaaaagcgggcagcctgctctccatgctgccatttgtatttcaaactgagatgaccaaggttaagttcaaacaggcagctctaccactgttgctgaatcgtctttcttggtaaaggtaaattgtcaaacctatttcctgtgcatcttggtttgatcatgaagtgagaccatgaaggaaggcagtaaatgtccttcaacaccctcatccacatgagtaatatggaccatcttagctttgttgaagagggcttgttccagccttggcaacagagtgagaccctgctacaaaaaagggggcttgctgacttgatatggtatgccagtgaacttttgggagggagccatgatgggattgggtagtaggtgaaggcttttagctctgagtaaaggaaactggcatttctgttttttactttttgagacagggtctcagggtctcggcctgctcccaggctcgagttcagtggtctg

SEQ ID NO: 27700 - DNA, 2776 bp, Homo sapiens
ctcagactcctgggcgggcggccctgcgagctccggggtcgctgcattctttcccttgcgcgtccataggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaagattcagacgagcctccactctttttcattggttctttaaatttgcctcggtagctttgcgatgcatggtttgcgagcaacctttcttgcagaatcgtcaacgtaagtttttctgaccgatgaaaaagaacctctaaaaatacaaggctctcttaaaatgtaatttggagccgtcttaacttacacatttcttgagaagttaaaggcacctccatagagaaacttgttcatctagtaagtaaataccagagtttcaaagcggctggattgttccaacaagggtatcattgcattaattattaaaatagagctttctatacaggagggtgttgtttagagtggttttttttttgaaagttctttattactaaaacaaagtggaaacttgagaccacgattctttgtaaaacattataaaggtacttttctccataaagggtagataatggattgggattttggtagcattttattttttctttctttctggtacattcttttagctgtcttgattcggagtcagctaggtaaaaggactcaattgcttcaccccactctctggtagtacagtatattgcagctggtttttaaaatgacttccaccaccctgatcctccagcaaaattggagaatggttatgaaggccatttcctgcctgttttagaggctacagaaactgtccgtatctgtagcgaagagagttacatgacattgttttcctttttacattacaggaataaagagacaataaaaataaataattaccctgacgcgtggctttatttttgttttctgatctctgctgatgctgataacctgctgtggtctggcctagatggtgttatggttaactgaaagggagtttggggcaagtatgaaataatgggaaactaagtcttgggcaactttttgccataatacaatttcggtagtcaactgaaatgttttgtgtgttacctgaaatgtgtgttacttaaattgtttaaatgccctcctgataatttactttggtttggaattctccctaaggatggagttaattaagactcactaaggtagggggacatacttgattcttcaggattttgaattctagcccaatactcattttggccaattcagcaaaactgaaagggaatactgtgtcagtcgtgtctggtagccagacactggcattttgttacattctttagccgagggtgttggggtttgccttcttcctcagaaaatagttcaggggaagagatgcatggttaatttggttcctaactggtcctctatttactggtttttgattttttttttttttttgagacggagtctcgctctgtcgtccaggctggagcgcaatggctcgatctcagctcactgcaacttccgctttctgggttcaagcgattctcctgcctcagcctctcaagtagctgggattacagtcgctcaccgccatgcccggctaatttttgtatttttgtggagaccgggtttcaccatgttggccaggctggtatttgaactcgaccttcgcagcctagtgctatttttaactagggggttctccttccttgacagtaacaacttggccttaacttactgcttggttacagggactttggtgaatgatatctgtcctcttacctactcaggagtgtttgtagactaagtactgctgctctggtttcgtgtttaactggtgtggaagctgcctctaggggtatttttgttctccattagctagaatggagtgcagttggttagtataggaacaatcctgaactttgaccaataccatagcaagtccaaacttacaaactttgtggactgaagctttatgctacccttgcaactattttctaagttgaggaagtatgacgtatcaagcttcccacgccttagttctagttcagtaacttgtactcggtgtcttaagatccccatttgtgaatactctaaaaggtcattatctgttcacattattttggccataggtagaaatggccaagaggcttttttttttttttttttgagacagggtctggctctgtcacccaggcgggagtgcagtgtcacgatcacaactcactgcagcctcgacctggggagctcaggtgat

SEQ ID NO: 27701 - DNA, 1050 bp, Homo sapiens
agttaattaagatacctccaagcaaaggactaagtctgttattaaatgtggtggtaggttagcaagatatgttaaagatgaattgctattaattggaaaggcaagtttaacaattgtgagcatgatacgattctgttgttacagacataatgatacatagtcacatatttaagcaaatgcattggcaagaataggcatctaattattgactgtcgtgagagtgatggctatagatgaaggagtccttgctgtgggacacctggccagtaatctatcctctgtattcctgtttcttttctatttatgcagtctcagggatggtgtttttaaaatgaaagaacatgtaacatttagaagaaaaggtgctaaaatatagaaagtcagcctgatgccttttttcagcttgcttaacctggcaagtgcagctcttggttttgttttttatttattaaactggttgtctttctaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggtgaaaaaacagaattatgtgtcagctgataatggtttcctgtcttctgtattcacagctcacctattgtggatgtttgtaattcttgaaagaaggaaatttagttttaaatttttataggcttctgttcatccatacagttatatattcgctctgcaacattttaaaccctctgtgcttgttgtggccacacgtgaggggcttttttaactttggtttgatttttacttgaggcacaacaagatatcacttggagcttgaaagagaacagtgaaccagcccttaatttagtgaaatatagtttcctggatttgctcattaataggagtaattctggctagattatgcatttttgcttttagcaaaaatcaagtggcattttcagaaat

SEQ ID NO: 27702 - DNA, 1050 bp, Homo sapiens
gaaaaaagaggaattgaggatcacctgaaggttttggcttgagcaagtgactgtaggttaggccttgcctactaaaattgggaagatggggagagtcccagtttgagtggggaggaaacagaagctcagttttggacctgtttgagatgtgcagtagacatccagttggcagtgttaggtagacagtattaaatatggagctcaaagcagagtaccggtccatcctgacagagataaccttcaacaagagggagaaaagcatcttactctggatattatgaggcctcaaaatctaacttataagtaatattttgttatatttactctcctagttgtgactggcatgagaatattgtgttatagaaggtaatcatcctgtctgcatttagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggtgagcactggtgtggatggtcaactctgcagataacccaagatgtgctcatcaatactagcaacactaaaatgaataatagcaagtagcactactagtgattactctcgtgatgatgtgcccgtgatccaattggcagctatttcagacaagtaggaataaacaaggctgatagaaaaggcaagcaaacaacacttggatttgctctgccacttacatgttgtaagtcgttttgttgattgttgactgtatgtagaactggagcaaaagaaatgtggaatccattcgagctcattgttggaagaaggtggaagagtcagagattggtccaaaaacctgttttgcacatcacctttgagcttaactgcctgaacaaaagatgtatgctagacagggttccatcggcatctctttttctgtaatgtactattttgatttcaattcaaagagagtgtcattttccttcagtattctgttgtgtatttaaaaa

SEQ ID NO: 27703 - DNA, 1035 bp, Homo sapiens
tctccccgcatacctccttcccccactgtgcctgtgtatgtgccactccctgaatatatcatgtctccttatcgtgaggcttgactgttctccttgcctggaatgagcaccccctcctcaccaaacttagtttcctggtaaatcggaacgttcctcaagttctcatttctacaattacctactacttagccttttccaccaaacattttcatttcttcctctctgtttcccgtgcagatcttgactataacataaatcacattgcattataattgcatgcatgtctttttataagactttgtaaggtacttgagagcattatatcttttcatttttttatgcccagaacttggctcatggtagacacctaataaaacatcagtgcattccagatagtttgaaataactgctacatgtgttgaatgctctatttttgatgccctgcaaatcttgcttcttaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtaagtttctgatctaacaaaacagccttttatagactagcaaagttccacatcttctgtatttattttatttacatgatgatagtttaatttgatatcctactttttcttcagacataaatgctgttatgtcccatagtctattaagtcataatcgtaatgttctatagctatgtaatcaaaactaaaattttgattgcaatcttttattcataagcttcttgttgaactaggcaacttttaagaaaaaaaaatctttttttccaatggttcatcctttttcagatttacatacaaatgacaaaacatgtttgatttaacctttaagaaaggtaaaatcttcaatcttcttcccattcaacaatggaagaactaaaccacagcagatattttcgggtgattttgttacaggta

SEQ ID NO: 27704 - DNA, 1025 bp, Homo sapiens
tgatgggccctacactccctccccacttattgcacctgacatcaggcagctgtgggagtttactctggatgctgtgctaagatgacaactaaagaaacgagccagtggaattactttggagtagtttttcttatctctctgtcctctccccagctaatgactgatacttactgccttaaaatcgtgtcagttgggctttagtttttataatatttaactagaagtggaaatgtgggcagttacatattaattttgttcgctatgtttaagaaaatgaaacatttctaattaagctaaggatgggggcattgctggagcaaattttccctttgggggtctttttgagaagtaaatgcagttagaatcaatatcaaagcagttcttatttgggagcccttggctgagttaacagttggaactctgcagcaaaggcacatagaagactgaaaaataccattgtcttatatgattaaaaaaaaatgtaagcacagtaggggtatctttggaaagcaccctcaggaacggttcatcgcagcccctttgtccctcctgggttctcctgtgatgtcctctgcaggctaaatcaaatttgtcaagtggagccttcatcttgtggccactgcttttctgagtgatgagggccaactcacctgccatctgctttttctatccctcatgggcaatcaaagagcctattcctgtgcctagagggttgtaaatgggaagcttgccacatgttatgtttaccattcccaagccgactaaagattccaaaatcaaaccgtggtcaactgatagacgtttccacaaccatttgagccaaggttttcattcttctcatcaaataacttgtttcagggaaaaggttgccacacaatatgcagtgtgcccgttaggaggagttcaccctgaatcaaacagatggtggctttttaaaataaacgtccacttcaatagaacaatagtctcaatggcattcaccatctctactcgctgtaactatcagcatttgatggagagaactg

SEQ ID NO: 27705 - DNA, 1026 bp, Homo sapiens
actccctcagtgttctactagcagcaccaggtttagatccaggcagtctgcacgcagaacccagatctgccgcaggccataagctttcccacctggctttcgggtagtgcccctcctgtctgcccatgaggcagatgtgtctgcagtgcacttccctgccccccccgccccactcccattggttctggtcaaaggagtttatccctgctcgagattatatcacgaaattcagttaggagcatctttcaccctgcaacccctttctgagctagttgactggcttccccaaggtcccctgtgagatatattcaggtatggcttccctcggttcatgctggagactgagaatgcctgcaaggcatttcctgctgctgcttctacttttatgtttctcatcactcccttaagcagttccagctctgggtagggttaaggccttctcccatgacctggattttcagattccctcatagggatgtgtattctgaaggtagtctcccccgactgacactctgaggatttatagttttttacctgtctcatggagtagacttcagctttctgcttctttcaaaggatctgtggattcttgcagttttcctgttgagttcctgtattgctccttggaaaaaagttcacagtgtgaatctctacacactattctgtccttcccagtgggagacgcatgctaacactgcctccaatctgccatcttctggatttgcttctatagccctatgcacttctgtcggcaggttttatatggggctgtgcgatttgacctacaagccagtagatggtgtttatgggtaaaagctggctgtgggcaaggtggctaggtatatacttgatccttgtttaccagcagaagctctctattgcctcaggcaatggagtggtccatggaatgcacagtggtctgagctcactgcttagccctgggtgggcagggggcaaaatgggttgagccagactggacaggctcatttacagctcccctggtgttgggcacaagtagcagtgctg

SEQ ID NO: 27706 - DNA, 1060 bp, Homo sapiens
gcaatcaatggaagcatccagcccttgttggtgacttgagatgcacgccagcctcaggaaacatactcaaaataattgagtataccataattcattagttatcttctcctacactctaattttacacattcttagtatgttatacatgtaggtcaagttttatttcataggatagaaagccatttgatcaatccctgtttctccatgtgtaaaatgaaaataacatctaccttgcagagctgtcagtgaagatttatcagtgagagaatgagtaaaatccttgtaaaaggttcagtgtatgggggtacattttaattttctctagttgtcaaaaatatgatttatgtgagctgaataagaaatttgaattatggttttaatttccaaatgagtaaatgaaagctccttgttcctgtagaacgttatgtaaattaacacagtgaggctagagaagagacagttttaaaatggtgatgtgacgatgtctaaactctgtggtaataggacatatttttcatcaatttgaggcaaaacagataaatgtaatctataaggaactgagaagaaataactattttgtccttaagaacgatacacctgttaagttatgtgtctgctttgggattcggtttccttttatagtttcccaacaaaatcgtggcccaggtagcttgcgatgtccttcagttgctggtttcctactgggagaagcttcagatgtttgaaacctctctgcctcggaaaatggcagaagtaagtctttttttctgtaatactaaaacataagcatttcctttttactgtatttgatatttaattaattatagatattcaaataattgttagagaaccaactattaaattgccacaagtcactcgttttaagattaagttagactggttcttctcagctgtgatttcaggcactatgtaaagaagccagcagtattccagacagaggcttatacttggggagtttgaaaggcaggcacgaccacaacaaagagaccttttgtagattgggcttcattcatcaagagcaatttggatggtgccaaca

SEQ ID NO: 27707 - DNA, 1050 bp, Homo sapiens
catcatggttgtttgcattattaatcttcaaatgcatggcattctgctaccttgctagccaggtttgcacgaatcctttcattgcaacatatgtcaacagaaatgtgcttccatctgctgccggatagcttgatgcctgatattccgagacaagtcccagcacaatgagtacctctgtgagtaattacaggtgtgtgctgaggagcctagggcattaatcagaggcttaattatgaaaaaggtggatcttttgttccactcttggatcctgagtttaccacacactttctaaactgcagcatccatctgctcggtcccttagaatgtttgccttgactgatatggaccttaaagtgtatcaaaggacgtgattaaagcaggcttaaacattaacctggaagaagcatggttcatgtttttttttcttccttccttcctttttcacttatctatttatctgtttatttctgatgtaggaaaaaagtctgctgaaatgctaaaactttaaattagtacttgctaaactatttaccatatgtgaactctactgaattaagcattatacagtaattttaagaatgtaaatatcaagatttgtagaaactaagacccatgtaaagaaaaaaaagtcttaggaaaaatggtttgtgaacacatacaaagttttttaggaagataagttgttaaatgaggtaatttttattatgacagactgaacatgttagaatttagcatgttactactgctttgctctaatgtgatactgatagaattaaatcaggattatttttaaggattttttagataaccatactgaaatctaagaaaagaaactaggattttgtgtgtgtgtgtgtgtgtgtgtgtggagattttgcttcttactcttatattgagactataataggttgtataactataagtcacgttactatagtatagtcatgtaacatttcagtcagtggcagaccacatatatgatggtggtcctataagattatagtgctgtgtttttactgaaccttttctgtgctagatgtggtttgatat

SEQ ID NO: 27708 - DNA, 1046 bp, Homo sapiens
gtggtgcgaccttgactcactgcaacctccacctcctgggttcaagtgattctcttgcctcagcctcctgagtagctgggattacaggcacacgccaccacgcacagctaatttttgtatttttagtagagatggggtttcaccatgttggccaggttggtcccgaactcctgacctcatgatccgcctgccttggcctcccaaagtgttaggattacaggcgtgagccactgcgcccggcctataaaagttatttttaacgccattttttagggctctcttatgagaatgtctttcttgctgctggtaagtttggtgtgcacaaagatttgtggccctgtgtagtatatttataagctgtgtgttccaaggaaagtgaaatgggtgatgctcattgggaatgtccgtgatgctgccctatactgatctgagtgtgtttgtagttaaagggagttttctcttttcctttcaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggtaatttttttcacttgtcttttgagttgagggtaaatatattttagtaaagtatacttgctcagtcaagagtcttgtcaatgggacaaaggcaggtggatctcttttttatcccatctgatgcttctgagttgctgagttctgtgaggatctaccaaggagagtagcttctgtactcccattctagattggcagtcatctcctgcaactctagccagggccatctgcgtgttgcatctttgttggtcactgttgcaggagagttgtttaataagccatcatattttacatgtctatttgtgagactaaaaaaatcactaccttctccttgacttgtttaaataaatatcttttggagaaactaaattgagaatgtttgggtagacttttgttgtgcagtggcctg

SEQ ID NO: 27709 - DNA, 1034 bp, Homo sapiens
cattgtcatcttttaatgtaaaaatctctgcatttcctgaagtctttccttgtgggtggtggggtatggcgacctcaggctttgctcagtgactggaggccagcccaaggcaaacagctgccattgtatgccttttattttatgctgggtcctgcatccagcagctactactgacaggtgcttatggagaaccaaattttaggtgattggacaagctatggacagtaagccccagaggactaggaaacagaaaggaatttccaatttggctcctaatgtttttttcttctgtaagcaatgaggactcacaggacagaagcatcccttagagtggtaaaggtgggggtcaaatcttcctctccctattatttaaaacaggtaaaactagttcaaatgaataattaaaaacagttttggaggggaagtggtgacacgagatgttacttttttggggaacatggtcacctgattcagttgtctgtactctgtgtgtttctatgtatgcgtacacacacacacacacacacacacatacacacacacacacacacggggagagaagccaaaacttggtgagttttgaaagatgtagaattactgacttttaggtgcactgggacatgtatttctttagctatatatatgtgaatattttttcaaaatttgtttctgattttatatgtagtctaaattcattttaaaaacatggtatattgttaatattcctagattaaaagttatttgttgatcatttttctgcctcatacaggtattccagatatacaaaaattattaagatagagagttgaacttatggcaagtagtatctcaaatccaataccatataattttcatattgattatggaatttaaagaatgagaaactgacttcttattaagtctttggaaaaggtagcatttgatgcctcaaaggtgaaatgtgactttcttaattcttttaaatataaagtagatgatattgattctgtttcattggattcatctaaagggaaaaggatataaacctctaaagt

SEQ ID NO: 27710 - DNA, 1035 bp, Homo sapiens
tgcagtctcccttttgcatcaagacttataggtgagaaacttgggattgacccaacgggatataccaaattactcagttcaccttggaggaagggacactggagataagatgttcgtggaagtctgaaattacattcttgttgttatctgttgcagtccaggtgccctgagcttcctggcatgctggcctctttcacatagtgtgccacttgatgtgttggtaactgacactcttaagaggagatcctgtggaaggcaatactagcaaaaatgcttccaagaatcttttaagggcagatggtagaaactgcattagggctaaagatatgggaaattcacactgaaacctgagcatgtttatttattgttaggatagcaggagacatgtagagagcttttttctctttaattaaaattaatctgttaatgcagttttggtaagttgattttttttaaattaatatatacctttaggagagagttgtacaaaaacttgctattataagtctattacttgttttctgtttggatatgtagtgtggtggctgttacagagtgacatctagtgtttgatgtggtttgtgacactgtacaggttggaagggtctggcttgaagcctttgtgcactggcttttcctgcaggccttgggcacttgctgaatgaatttgacagggtggccagtcccaagacaacctgcaggtgtacaatgctttctaattgtgctgaggcaggagtttaaatcctctgaatttatggggtggtgggaaccaagtagtggcatctcactggggttttgttattctctactcatcactcctatagaaactgtcttggagtgattttttcccctaaaacatggcataaaacggatggccaactagtgctagtaccaaaactgaagagatcggaaaaatgcagtagttttcaggcagaaaatagaaacttgcatgaaatgaagaatagcatggcagatttggttgtgactgagatctcctgtgtaagatacttttgtgagaagaagactccttttgaa

SEQ ID NO: 27711 - DNA, 1074 bp, Homo sapiens
gatctcccagtagctttctgtgccagcttgctgcatcagcacacccacctcctccatgctagagaaattgtttgccagcttatggcattctgaggcacgttcactgcagagcctaccaagagagagggccggggggaggaggaaatgtggagtgacacatgggggcacttgcaggtttctttgaggaagtcatgtgtgacccaggttctgaaagaggagacctgttgattaaaaaaattaaagttagttttattcagaagtcttgctgaggttcgcaaccagggagagtcagagagtgtctgttagactgttccaaagtagtgctttagcccacagtttatatacaggtggcgcactctgcatgtgctcagaagttacattaagtgtgctcagaagttacattagagcaaaatcttaccaaggtttgggtgtgagggtccatctggttatagattatagaggcgtagtcattaatcctgtcagatattatcttatatacaggaagaggcaagggctaagacgagtgtatcttttttgaaaatgtggtgattcaggcaggagatgtgggaaccggtgctgtatcctgcttatcatcttcagggcattcttctcaagggctgcgccgagtctttgagtcaggggctttgtaaaattctgctggcaaggggttttgtgcaattctgctgttatgtaagcaggatgaacagacatagtgtctacatttgctactttgtctcatacactgaaccagctgcatgaagatctgggagtgggggtagcatcctgcaggggccccaagtgaagaatatgttcgggaagtttggggaatggaaagaatccacagtggttagaggatagggagtgaaggggagagtggtgtgcagtgaagttcgtgttgagtgggggaaatcaggcagggccttgcccggccatggtaaagagttcggattttaagtactactggaggcagatggaaggttttgagtggaggagtggtctgatttgactgactctattaaatattcgagttggccgctatggggaatggaagaagagtggaagcagggaacccag

SEQ ID NO: 27712 - DNA, 1048 bp, Homo sapiens
tcagacttctatcaacacagatgttgtgttcaatctccattcggctagcgactgtttactttcaatttaaagcaaatcagagactcaatcctgttcactaaatgcaagcatcttccatagacttgctttgttaactccattgaatactgatgattttaaaagactttttagaataaatttgtgagccataattatataaagacctatcaattggatttttagatgtgaatttgtgctgaagagaaaataatgcattatgtgatggcaacacaaattgcagacacagttcaaagcatggataatactccctcactgcttaccataacactaatgtgtggatgaaaccctgtatgttaattatttgagtacagttttttgaaacactattattatcctgcaacccagtgagacagagaacgatgatacatttttaaaaatataaataccctttcactactagtgagatttggtgaacatctggggaagtttcaaagaagatgcctagactggggaactgcattcacatcccatcaggaatttgcgctctccagtaagtattgagataactttgtgatttcaggatcacttttgtttttattatttttaactttagaggtaatggaagtttctgggagaggtgggtttggttttgtttttgctttagaatgtttacttgcaattgaatgaaatgcctttcgttttttgaaattccatgtaaccttcagtaattgtttaggtgacttctaaaaaagtttaactaggaactaggaacattgcctaaatttaagttgtgcaaactattttgcagtagtgaacagctatattcctatttcatacacatcaattcaagcctgttctcttttggccctcattccataaataaggcgtggagaaacaagccacaggaggattctgctttactgagtggaggagaaatccatcgagaatgggccgtttgctagttcattcgtttggtgactttttcctgatgggaaatagcagagcagtggatcaccaggaatagagtctggcgagatcgcagctccag

SEQ ID NO: 27713 - DNA, 2350 bp, Homo sapiens
acccgatcttataatcaagccagtgttctgacaaagaaaagcattctgggagtggaggtgggatctaccagggcgtcctctcctattccagaagagtgggcaggggtgggggaggacaaagatgccctcccactctgcagaaggcagttaggtgacttctccacagggcagggttctgccagttctcctctggcagccagtgcccaggtcccatcctggttggtgggggctgggccaaccccttgtcatcctcggggaagcctgtatgtacaccagcacctccactgggtgccaagtggccatctcggccagcgagtgtcccctgagaactgagggggagtaggctgagggtgcacctgaggggcacgctccggagcctgttctcactcctgggcctgggcctgggccttccatggtttcgatgacatgagcaactcccctctccccccaggatgataatgtgtaccaaaaaatagatttttcagtagccaattgatcttactgctttaattaaatgattacttttttgcctaatgtggggaaaaggtaaaataagttaacttgttcttctgtgcatagtgttgggctccctaatctgagagatttgcaactttttgctttgttttgtttcattttttttctgagacaggatctcgctctgacacccaggatgtagttcattgatgctatcatagctcattgcagccttgaactcctgggctcaaaagagcctcctgtctcagccttcccaagagctgggaccacgggcaggcaccaccgtgcccagctattttttatttttgtgtagagatgtggtctcactgtgtttccaaggttggtctcaaactcctggcctcaagctatcctcccaccttggcctcccaaagcactgggattacaaatgtgagccactgtgtctaaccacaagaattattaaaaggaattttacttaagtatctacttccagatctctccatgtttctttactagctacaaaataaaagaattaccccatcagcctctgtagggtaagatgaattgtgtggaatgggtatgaaatgaaggatagttagatgtagaaggtaaaacaaaaggaatcagctttttgtgtctgtgacagaggatctgatacttgatggtctgaccacaaggcatcgctcagaaatcagcagtccttttcacccagtgaacagccagctgctttgagcagagagagctgtggttggaactcctgctctgtgactcaggggaggaggcagagcttgccgcagaatgcagccactgcccacagcccctgtgcactcccttttcccttgtgctggcttcccgctgccagcatctgcaagtctctgcctggaggtgagcaggagggtgctgggcccattagacaggtggctagggctggggagttcatggtcttcacgcagtttcaggtggaggttgcaggatatatggcccagcttcctggccccaggtggaacaaccctgagacatgttcgccatttcccacaggcccccagtgggactgagccctagttgtcttcagtggcaatcttctcattaccacctctcgtgttgattctttttcccttcactttctcatttttccatttccttgttggtccccattaactacttgcacatgaatctttgtctcagggtctgcatctgggggaccccaaagacacagacacttgagctgttactctgcctttatcttagacctagcattggtctccagaggtcactcatgacttcagggcctattttaatggcctctttccccatgtgttccttgggaatgtccattgttgatgcgtccttctgtactaagtagagtttttgggctgcaaggaggcagttagcacagggaactacgtagtgagggacatggagactaaacagcagctggcccatctctctggcttctcatggccaagcctgggacacacagctgccctcgtgcaggtccagaactatggcacttgttccctcaggacccatcctcaaagccagtgacttggtcttttcctatgacaaaggagctcccagaatgtggcagtcccccttcctagagggagaatctgactgggtcagggaggcacccccggtttgcagagcccccattggtcaggttcagtgtccaaaacacctgaggggcaagtggcttctcgaagtccagcccatatggttacttttgacttggacactcaaggcacagggacacatgacacaggcacagggtgtgacaactgcatgcagaaagagccactctcattcctcagaagaggctgtggagatgagtggctgagccatgtgccccaaaattcatgttgaagtcctaaccccc

SEQ ID NO: 27714 - DNA, 1026 bp, Homo sapiens
cttcttccacaggcacaagaaaggctcccctccgtagggtgtgccgaggcctcgcctgctctcctgtatcttcctttcttgcctggtttgctgttgtttagagcgcacccccacaacagggggcgtaaagctgaggcgtgggagggcagaagccgggaaagcagggtgcctctgggcggcccccgtgccctggagcgcagaaaaggcgctcgtgtttgagctacctgggaaagtaaacaggtaaacactgagccgacttagagggccacttgtcctggagtggggccacttagcctgtgtacattcgcctcccctcctgggcctccggcgattgttcagcctccccgcgcccgctccagccgcctgaacccgaactcaattcgttgcggaacccagagcagcagagagagcgaggctctcctctagcttccaggggcacaggttctcttcctcccctctcctgcctttcccccgggcgtaggactcccaatgcgtccgttctcaacctaggaagaatgaatagagctagagatgtgtacggaatctggagccccaatgctgataataaagatcgagttgaggggtccagctgttcaggttaccccagcaggggcgcgcggtgttcgggacgctaaggagacaccaagcaaatctcctccggcccggggcatgctgggttcagaacttccagcacccagctcaacttcctccccaagcatgcagcagaacgaggcatcttgcagagtgcctacgaggtctccagaccacggcagctgagcccaaagctcaaacccaaacttgacggaacggaggacattgaactcgcttgggtgcaagacggtacctggaaagaatttactaaagaatgccgagtgggggagaccaggagctgaaactggtgcaggcagacgctgacagggtgggagtggtgggcccttactgaagaaccctccggagggggaagggagcggggcagggcctctcagcctgcgggtgtgcgggatcgcagagaaccaaagctcctgg

SEQ ID NO: 27715 - DNA, 1029 bp, Homo sapiens
ttttctagtattctgttcttctattgtactttttgccttgttcctttttatatataaggaatgcaattacctctcaaaatttatgagaacaaactcaagtccatagaaacctctggagctgagaatcctcagttcaaatgctggctctgccacttaccagctgcatgatcttgggcaagttaatctgcctcaaggctttggcaagatcaaagggttgctatgacctgatgcacacatggtacctgacttcaggtaggtactgagtgcatgtcactggtggcagattgcattgcccaaaggcgtctgaacaattaaagatgtcccagacctcctgctctaacaacatgactgacattgctctcactgagaggtggcgtctatgttcctcccgtttaatctgggaagagaggagttcccaggctaggtcatagaaggtgatgcaggttccactcagctcacctgtgctcactccctcttcttttttttcctctctctctctctctccctccaactccccatacctctgtctctctctgctcacccttgaatgcagctaccatgctgtgaggaaacctggactaggccagctggaaagaggacatggacaggcctatttggggaggagctgagtgaggccccagtgacagcaaacatcagttgtcagatgtgcaatggatgagccttcagcaggctctgctgtgcccttttcaaatgcatatttattatgcagccagagttggcagcaagcactaagctgtgacagtgcatgaagtaatttaattggtgaggcccattcttgcaactacctctgtgactagtggagacaactcagatcccagataaaggatggggtgctgggtcagcatgccaaacccaagctaccccagggggctcagaggaagaataatgtgctggaaagtgctctgtggcatgtaaaaatgggtgtcttctcaggatctagcagtgggactagatttgggtagaagtgccaaatgagagaaagcaaagaccctaaggatgagatttaat

SEQ ID NO: 27716 - DNA, 1216 bp, Homo sapiens
ctgaggctggctttgtcctgatttctgaaaatgggtccattggctaggaccagtcacaggaggaagctcacaaggctgcactccagagcaggtgttggttggttcatctacagccagaaccaacttcccagggactaagcagcatgtgttcatgtgctctctatgtgagcaggtgcaggtggctataagagcatgggtcagaacaaggaaacacagtagatggcatgatcccagtggccaagggcacaagttgacagggcctgaaggatctatgttctcaggaaggaacatggtcaccagggagaccagataccccacagtgagtctggtgaccacattcccttctcaccagccctgcccacatttgcccctgtgaattaccctacccctttttttgggcgtttccacattctggtggtggatattttaatttgttcacctcatgggctgggaatctcttttctcttaaaggtgacattgcataggtatgttccaagtcttattgacttttaactctcagggacactgttatttctctgcttctaagccagttttataaattactgtgtaggaagtgcttagcacatggtacatgtcttagtttggattccccgagaagctgatccgaagcaagtattttggtgcaagtcattggtttgctaggcaaaggggtgtagggaattgggatgggtgaggagtagattacccaggctgctaccactgtgggtgactggatcctcatcacgctgtgcagctcctcatagaacagcatagaacatatgcttcagaattattccccctggagggccaggagcgtgtgggaactgtggaatttacacacaactcctgagagtgagggctgccggggaggtgtcgttttcttgtctggcaagagggacagagaagcttttcttccactggcctggaaaaaaagcccttaggcatttggaaatcagctagagccccctgaaaagggaagtaccaggcctcagacaggcactgaaggtgtcaatcatagcaggcattttaagtggctccacaagcagcttctggaggacccagcacattcagtgtacttcacaagcaaccccgtggtgaccttgggcatagcctcggaggtggctattcctattgacccaaccatgtaggccaactgtagatctgagtggaaaggggctgtgaacctcattaagccatgggtgctcaaagctgatga

SEQ ID NO: 27717 - DNA, 1029 bp, Homo sapiens
gaatcatagcatttcacaagcacgtggcacatactcaaggccctagaaccaaatgtcaacgtttaacaaatacagcagaatcgtcttttcattgtgaatttttaaaagcaataattaagtcctgcatgaaacagccaaagaagcatttgggacaaagttactggttcttcacaatcaactctttaaggcataatcggaggtaagtgtgctgagacttttggtccctactgctatgttctcacatgctcccaaggaaatagacatgtcagttacttgcctgtttccatctctaggtgtggaaatgagaagtctgggtttctggaaattacagaaatcaagtcagaaaaacctggcaaaagtaataatactctgtgttctataatttgccacagtcacctcattttgcaaataaaatgactacacaactttcaagtactctaaagcgtcttaatttttcatgcctctgcaaaaaaatactatattgttttgctagactctttggtaggacagcttttacctaatctgatttttttaagacaaactgaacagcctcatctcatttctaagttgattttatgacaaacttcctagctgcgtatgtgctgagattacgctagcagttttgcaggtgttcaatctgtcagtcatactttgtttactgcctacaaatggggggtggggaggaatgaatgcaacaatctatttcttcagttgcatttgagggtccccacagaaaatctgatttgcttcaattcaacagggaagaaatgactgaaaatatgtggccccagttttatttcagcttggaagaaaaataccttgaaagtagttatgagagaagtaaacccacatggaaatataaggcagagtgagaagccaggaagactgctaactacaatatcaggagctggttcagttctctgtactctgcaattaagaccagcagttatctataaactaggtaatcaagaattagaacgattagcacatacaccctacaccagaattaagtgaggttatgttcactgc

SEQ ID NO: 27718 - DNA, 1357 bp, Homo sapiens
gcttttatgaggagaaattatgttaaatttatactggctgtttactttatagcatcatttaattaaactcttatttatattgcattttagagaattttttggaaattacctttaattttatctaagacttcttatatcttaattttgtgaaaatgtatattgttcataaaaggaaactcttatgttcccttactcctaaatacctaaggagttttcagatccagttaatgggagattgtaatattcaatcgttaaaaagtctgattcatacagtattcatttggttttttaaaaagtttttcaaagtatttgttttgaggaaagaatgcaattggatatttaatgtggtaaaattttgcaaagattatttctttttagttagaagagtgtaattaaaagtattaatttcttaccttccacacgcgtgcacagcggaaattttgtgtttttcctttttcttttagcagtccattttgtttaacacacagatcccaaattttgagaataaatatgtcataaagaaatagggtatcttcaatacctttggtataagggttaatcacagtttatttcccaaagtgacaaactggacacaggttaaataagctgttagagtggtaacattgtaatgcatcagtactttagaatatggtgcaggcattaaaatccctggtttcagagaatcttcagtgacctggtaaatgtttacatgtcaattaaagaagcacatgagactgaatgttgtataatctcattttcagaaaaaagtttgtgcatatagaaatgtgtctaataaacgcaaaaggaaagtacatctgagtactaacaacggatttgagcgggattattgatagattatttttctctttatattctgtattttaaaaggtgtaacagggatccacattttttatgtagtttagagggaaattgttttaatttttgttcatctgcttacctttctaattttgtagtcaggcctttctactttgctgcctctttaaaccaaacgtaataaacttggagctgtcactgtatgccagcatcataaacaccatcattttatgatagggaaaattttttggctcacttgtttagaaaattagtaaaatttattagcattattatttattagatttgtttcttcattttgttagtatgctacaatttagcatctttgaacattatacagaatgttgactttgcttaagggttgtttgaataggcatttcaaagtgcttttgcttttggctgcatggagagtagaatctattgaggtgattgttcttgtgatgtggtgccatgttccaaaattaatatatatgcatggtattaatgaggaatatgtttgcattca

SEQ ID NO: 27719 - DNA, 1051 bp, Homo sapiens
tgataggagatgagcggtttgtgtgacttcatgggtttcttagtttaaatgctgcgttgtgtaggtacagttaagtgcggtttctttaatgaatggtgctgtggaggggtaggtttgtgtgacttctaattctgtgatactcttttgtttcaagaacgtatttccatcacttgccttctttcctttcactgccaaacctccatagagctgcccccaccttctaagttgccttctcccagaagcagtgtcttctggaaactgcagcctgtggcaaagcccttctattcagttcccaactgcagtgctctaacctgccaggtcttccacctggtctggggtgtttgcccaccctggtagggcacttccttgctgagagttcttccctggacaatgattgccaggttaaactcccctctcctgtcgacagacgcccctctgactggcagcagaggcagtgttgctagctctggtagttttggattttttatttcctaaattatatttaatggaggcttgctgaatactgcctccttttgctgtaggcacggattatgggtggttgtgtatgctttttgttgatctataaggtttttggaggatgtgtggatatatttatctaagcagccaccatgattttttgggaatcacatgtctcatcagtattttctgaagactgaaattcagcttaaatttttataaagactgaaattcaatttaaaaactgctcttggtaaatcaggttgtatgtaacagtcatttctgaattaatctagcagttaccattatctttcttaagtatttaaatatgtttgttttgttttataaataggtccagtgtatacctatttcttctctataaagatgactactccccatataaagttgaggcattagaaaactattgtcaaaataaagtctaactagttttctttgttatacttgttctcataagctttatttcaggaaattgtgcttaaacacaaatactttggtcacaggccttaaatgtctctgattattttctctgtttgagaatctatgatttttgtcc

SEQ ID NO: 27720 - DNA, 1015 bp, Homo sapiens
tgggattagctgagccatcagttactggccagagcgcatcatggccggggtggggtgggcatggaaatgggatcgacagaaatcagaggcagcagcgcaccttctgcatggcatgttaaagaaaattcaagggtgcgctttctttctcccattgcgagtcgcagtccggaagagtgtcttaaggctgactggtgcagcccgggccccattcccctgctggcagggccttggtcctcccctgacctacttcccctctgttcatactgggccctgtgcacaaaggtttcttctcagcagctgagcctttgttcatgatggtcatagagcactttccatatatatatttggaccaagaccagtttggtgcttggctaaaattttttttctgaaattgaggggctatggttcactctctgcttgggtgaatttttcagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaaggtaactgtgaaaactgttattccaagaaagaaaatggaaatgaattgaatcatatttttttgacccttatagcttaaaaatctagttctgcttgtagtatttggctctgaatgacacttagaaacacatttcattcttcatcctgaaatgcagatttaaacatttggaccctttggttcttatggttttcctttttctgggtgtttttattgtcaccctcaccatcgtggctttgggcatctgcctgcctgtcagtctctggttccctgtttctgggtgttttgattgccaccctcaccatcgtggctctgggcatctgcgtgcctgtcagtcttgctcctccatctgccatggctttgccaggccttctgtgctctccacccccctc

SEQ ID NO: 27721 - DNA, 1027 bp, Homo sapiens
aactttgtatttctcttaaaaagacattggcatttatttgtgtaaattttaaaagctttagctttttttggtgaaaaatcaaatcttgctctttaaaactgaaacttaacagcagttgaagtgcaaaccaatgatcttacctcccaaagagagcactttcctgtctttttctttttcactgggttacttctcattgtactttgtcaccaggtcccagctttttctctttctttgatgagctggtgacatttcttggccaggcacagtggggtcctctctggtgggtgtgagccgcagggacctgccactgctgtctctgccacctcatttggaagctgtcctgggggctggctggcaggttgctgacagtggaaggaggtactagctctggggagtgctgggagagagtaaccaccaactatagcaggctttattttatttgtttttaagtagactttatttttaagagcagttttaggttcacagcaaaattgagcagaaggtacagagattttctgaaaaagagtttttattacgattgggtgttgcatttcgtcaaatactttttctgcacacatgccatgcacagcctcccacatgatcaacatcccccaccacaagggtaagtttgttacaagtgatgtactcacatcaatacgtcaatagtactcggagtctgtagtttacggtagggttcactcttggttttatacattctatgggtttggacaaatgccatgtatccactgttatggtatcttacagggtgttttcactgccctgaaaatcctctttgctctgcctgttcattccacccttttcttttaacccatggcaaccactgatctttttgccatctccatagttttgccttttccagaatgttatgtagctggactcatacagtatgtagccttttcagattggcatctttcacttagtagtatgcatttatttaaaattcctccatgtctttccatgggttgatagctcatttctttttagcactgagtaatattccattgta

SEQ ID NO: 27722 - DNA, 1045 bp, Homo sapiens
taatgcattgccatttgcagtgaatgggctgtagttgtttgagcatgctccatgttagcttttcaaacactaagacaaaatttttctcttaagtagttctcacctctgatgtaagacaaaacctgccaagtcccaggccagagaatggagatgaggcacccagtgggtgcttggatctgctgccacctgggtgcctgcacgtggcacagtggcaggacagacggacggcagtacggggtgaacccggcctgggtggaccctgcctggcggagagcatcggggtggatttcagcttaggtccagacagtaggaggataaagccaagacctcgggcctcaccgttctctggggtggaggcttagacatccactgtggatccccgggagggcatcccccctgagcagagcccttctgatcttaatgcagtccacgctagcacagaggctgggcaccatccacgctctaacactgtgcctgttccttgccaggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgtt

SEQ ID NO: 27723 - DNA, 1106 bp, Homo sapiens
ggagtttgaatactattaataagagcaaatatgtattaaatgcctttatcttcacatcagtcctttgagcaaacagcagatgttgtttcacattacagagaaggaagaggaggcacagagaggtcagagaaccggcctgaggtcactcagcaagtagggcagcctgtgttgaacgcagcacttggttctagagtctgtaaaactcactctgccccccacctgattgatgggctctgtgcccccaccctgtaccctcaacaggtcccttgccatactgtcccctccacctctcagaaagagtatggggttcctttctagatggtgaatcttagtttgctttgtgctgctgtaatagaataccctgaaactgggtgatttataatgaacagaaatttattggttcacatttctggaggctgggaagtccacatcaaggtgttggcatctggtgagggccttcttgctgcatcgtcccatggtggaagggcaaagagaaggcaagagagagcaagaggaggttgaactcacccttttataatggcaccaatcccactcatgagggtggaaacctcttggcataatcacctcataaaggttccacctcttaatactgttacaatggcaattacatttcagcgtgagatttggaggggacaaacattcaaaccataataagtggtgagtttgggtggtctctcttggcatgctggagctgggcttgagaggcccgtgtgattctgactgcctgggccatgtagtgcttgtggactgggaacaaacagcggggtggccagggccatagaaactcgcccagatcctctaggtgttgtcagcagggccacctgagtgggccctaggcattaggtggggacagggctgaagggcaagatttggttttccagatacactcatgggatttgtctcctgaaggaaggttcacggggtccaatgacaaggggtaccgccctaagtgcatttcaggaaggggtgtgctctggcagctgcattagagtgggatgtgtatcccagcagcctctgcctcacctaggggtccccacagacttggaacacctctgagccagggggccagcccccagcagaggctc

SEQ ID NO: 27724 - DNA, 1057 bp, Homo sapiens
tgtgtctttgctgtattatttgagaaaacattgccaaatctaatgctgtgaagattttttcctatgttttcttttttttttctttttgagatggattctcgctctgttgccaggctggagtgcaggggcatgatctcagctcactgcaacctccgcctcctgggttcaagtgattctcctacctcagcctcccgagtagctgggattacaggcacgtgccactgcatcgagctaatttttgtagttttagtagaaacaggatttcaccatgttgaccaggatggtctcgatctcttgacctcgtgatccgcccgcctcggcctccctgttcgtatgttttcttcaaagaatttaagttttacctttttacatttagatctttaattttgagttgatttttgtacagggtgtgaggtaagggtccagtttcattctttgtcctatggctatccagtggtcccagcgccatttgctaaagaggctgttcttttccctgttaaatggacttggtactcttgttgaaaataatttgaccatatatgtgagggattatttctgggctctctatcctattccatttatccatatgattacctatgtatctattattatctcagtatcaaactgttttgacactgtagctttgtaagttttaaaaccaggaagcgtgagtctcccaactttgttcttcttttttcaagattgttttggctcttcttgctttcttgtattttcataggaattttaggattagcttttccatttctgcaaaaaaagatgttgggattttgattgcattcaatctgtagaaaaattggaaggtattgccatattgacaatattaatccacaaacatgggatatctttccatttatttaagtattttaaaatttctttcaacaatattttgtggtattcagtgtacaagtcttgcatatcctaggctaaatttattcctaagtatcttattcttttatgaatttttataaatggaattgttttcctaatttcctttacagattgttcattgctaatatgtagagatacagcaattttt

SEQ ID NO: 27725 - DNA, 1051 bp, Homo sapiens
ggcagatgacctggtagatgcaggacttctgctgggccattgcactgacttcattctgctctgcatgggtcctatggattcatccccctcgctgccccacacctcaccttctgctgtcttttctgtgttaggcagcagtcctggaaactttggaatcccctttaccttgtttgccacccaacgttccgttggtcatcaggtcctgcagcgccatcccctttcctgctgtccttcccactccaccaggcacctgagttattcgcaggctcagcctccccagcctccctcctggctggcccatccttcagacctgttggggatctttccttccctcatttgcatcttctcacacctagaatgaccttagaccttagcgttccagtctctacacagaccttgccctcactgcagtctctgtccctgcccatgctggctggcctcagcccataccctgcctgaggctgggcctgcaggtctggcaccattgtaagattgcacaggaaaaggacttggtgctttctgagagcttctgcagtgtgtgcatgtgggtgtgcatgtgtgtgtgtgcacgtgtggatgcatatctgtgcacgtgtgtgagtatgcatgtttgtgtgtacatgtgtgtattcatccaccagtaatcctaatttccatctctttatttcctacagtaagagttccctatttcattgatttgaaaaaaccacaggatcaaggtttgaatcacacgtgtaactactacctgcagccagaggaagacgtgaccattggagtctggtgagtgccagtgagctctgcagcccctccagcagcaggaaaggaccctacatgactgagctggtgctgtctttgacattggcctctgaaatgttgttcatttttatcttcacctcttcctttcctaaaggaaagatctcagtacatttgatccatcctaatgttgagggattcaatggctttaaactctattcccagcctttcaaaacagcaaaggctttgtgaacagattattatttttagagagacttgtttctaggaaaaacgaaaa

SEQ ID NO: 27726 - DNA, 1025 bp, Homo sapiens
tagtttacatacagtgaagggtacatatcttaagtgtacagtttatatacctatatctttagagatagataggtagagctaccacccagattgagaactagaatgcttttattacccaaaaaggtccctgtgccccttcccagctggaggactttctgtgctagtgttgctccccagcactggatttctgtccacagaagactacactgccctgggggaccagcgtatctgtcttcagctgaggtgagtaaaaatgttgacaacatgagaagtcagctgaagccatcatgttggagatgccttgtcagttgtgcattccaggagcctagctgcccttggaaaagatgaccactgaaaaatatagtacctttaaaaaaaaatgaggccttttttcttttttaaaacaaattagttttttatacccttaaaaaaatccagatacacagtactttggtttctgtggaattttgtgctggccttgtaggtattgtagtctccttgagtgaacttggaccttgtgtgttttttcacgctgtgtatttacttttggagatgtgggaggagaaaggtgcagaagtatcaagcccatgaggtcaaaggcagaggctctgggcacatggccctgggaacagtcctacaagcgaggctccaaggaaagggccgcatctgtgggttcgaggtttgagaacaacggggctcgcacacggtgggtgttctgtgaaggacagcctgagaggcaggtgctgacagcattagaacaggatgaggcaggggctctggggtcactctgtggctagattggtttgcacatagtgagtctggccttatgcgtttgggagtttgaggcttggaaagctgggcctgatattgctgaggcagcaggtaagctggtggagtgggaggaggaggaaaggaggaggccgcagaggaacacaggaggtactgagaggtgccggactccctctgcaggcatctgggcttatgagtttgggtgttcagtctataatagacttaatcacagaaac

SEQ ID NO: 27727 - DNA, 1050 bp, Homo sapiens
actatttttttatcttccagtttttatggttatactttgtattttctcttgccttattgttttaacttgcacttccagaatagtgttaataacagtgatgctagtgaatatcctatctctgtctagtattttactgctatgttttgctttggtttgattactggtttgaagcaggtataaacttgatcatcctaagggaatgtcctgtattcctatttcactaggggttttattattgggactacatgttgaattttactaactttgtaagcccctcttttatcctcactattgatgcagctgatatgtttgctcctgaaataaaacctatttggtgatattatgttagcctttcattatgttccctagatttcattttttattgggatgaaatatatataacataaaacttaccattttaaccattttgaggtgtataatttagtggcattaaatactttcacattgttgtgcaaacatcaccaccattcatttccagaacttttcaccatcccaaatagaaactctgaaaccgttaagcaatacctccccattttccccttcccacaactcctggtaagcactgttagactttctgtctgtatgaatttgcctattctaggtacatcacataaatggaatcatataatatttatcctttgtgtctggcttatttcacttagcataatgttttaaaagttcatccatgttgtagcatgcatccaaatttcattctttttatggctacataatactccattgcatgtgtatccattcatctgttcatttgtcaatttattcatctgctgatggacacttgggttacttccaccttttgactattatgaataatgctgctatgaacattggtctacaagtatctatttcagtccttgatatcagttctttggagtatatatcgaggagtggaattgctagattatatagtaattctaggcttaactttttgaggaatggccaaactgttttccatagcagctggactattttatattcctacctgattcgtttttatactcccagcatgtg

SEQ ID NO: 27728 - DNA, 1059 bp, Homo sapiens
acacttggtgctgtaccagcagccagccacatgaggccttactcacgttgcataggtgagaactacttacctggctacacctgcctccatgttgagctgggaaatgtagcccccagctaggcagccattcccatgcccaactctacactccgtagggaagggacagtacaaggttttggtggtctcctagccatctccacctcaggacttgggcccctgatctgtatggtcacctcttcagagggccagagagcagctcccattggcggtgtgagagtgtttgcccagagttactcttttgatattgtcagtattcttatattcttattctttgccagtgatttaggtgaaaatggaacctcatggtttaatttgcatttctatgtgtcatcttaatttagtgacgtatgttttgggaacaggaaatataacaaaatagctctgtaggccgttaggtatggtttagatatggtttgtttggccctgccaagtctcatgttgaaatttgatctggcaggaggtaggaggtgtctgggtcacccagggggaagattccttatgaatggctgggtccactcttatgggaatgagtgagttctgactctgagttcctgtaaaaggagcctggcaccttccctcccctctgctctgcgatctctgcccaccacatccccttgctttccaccctgagtggaagcaacctgaagccatcaccagatgtggatgtgggcaccatgcttcttgtctagcctgcagaactgtgagccaaataaacctcttttctttataaattacctagcctcaggtattcctaatatagcaacacaaaaatggactaaggcacctttgtcatctgaagataaatttctagaatattgtcttatcatgagtttttgttttgtttgaataaaaagtgaaggcgaatgattttgagagctagtttaggagagtcttagtatggccttgacccggaaggctgaaaggcagggtcctggggcctgtgacctgtcctgatgatcaggcctgtgggatacagtagtggggaggaggttttcctgc

SEQ ID NO: 27729 - DNA, 1048 bp, Homo sapiens
tctggataattgctgtgaacagtgtggcctgtgttgagagtattgctcctgtgttcttccatccatttagcaagtatgtctttttcgttgacctagccttcactgaaggctagagtggataaaatgctgcacaagagtgggacaaatcccagtccttgtgggacttctgttctcatgaaggagaaacacggcaacaaagatagcacataagtatacagtaaaatttcaaagggtgataaagtgctataaagaaaaataaagcaaggtaaggttatgtggctgtgtgtaaagcacctgaaaacatgccgtaccacagtggtgaaatatttttgtttctgccaggaaaataaggccttctcacagtaggatacccagttgttcagttctgccgactgaatcctcatgattttttgttttcttctttgggaacaaagagacatttatggactgctcttgtgtgttttattaaggccttaaagttttcaattcagtagagtgaaattgctctcaacactgactgcttttgaatatgattatggagattgttgttaagatttccgcctaaaagctaagaagaatttaatctgttagtcttggggaatgagatttggcgttactctcttgttccttctaagagaataccatggaattaaatgataaaacacttttcctcaacaattttgatggttacattaatgaaggagttgatgaaaactaattgtagacattattattattattattattttttgagacagagtctcactctgtcgcccaggctggagtgcagtggtgcgatctgggctcactacaatctccgcctcccagctcatgccattctcctgcctcagcctcccaagtggctgggactacaggcgcccaccaccacgcccagctaatatttttgtatttttagtagagacggggtttcaccgtgttagccaggatggtctcgatctcctgacctcgtgatccacctgccttggcctcccaaagtgctgggattacaggtgtgagccactgcacccagctaattatagacatattt

SEQ ID NO: 27730 - DNA, 1118 bp, Homo sapiens
ctttcaagtgctgggtctgaagccatcaccatgcagagggggacagcttctgtgctgctatgacacgagtgtttgattgtattttcagtgtcaactgttgatgactgggtttatattgaggagccccgagcgtgcagaacaaggcatgtcccctgtctccccggcccagccccttgctgctgctaggcggggctcacctgggtctgctagctggcatgcagggcagccccaaggtgggggtgggcttttcctctgagggattgactccatactcagccatcccccacttccccaaacatcctgctctatttgttcccggtgctccgtccccagcagcaccccctggaactcacagccttctctctgcatctttctacagagtcccaagtcagatgaagaggccgagagcactaaagaagctcagaatgaattatttgaagcacaaggtaaagcctcagcctcgcattcagtgctctctgcctttgcccagagctttgaaagctgaacagccgggtcattgggcagtgtgcaaccacaagtttaatttcctgggaaatgcatggggtgggttgtgtcccgctggattcttcctcctgcaggagtggtcagaatgtcatcatcacagcagtgaggccgtcactcggtcctcatcctcccaaggtcagacccaggggcagaggcccgtggccgagggagcatcgtggttcgtcacactttatggtctgcaagtactgatgtgaccccagctggcaggtgtggccctgtggtttcaggcaggagggccttgcttggccctgtcacctcagactgcccctgcacctccttcctggcacgctgggctagatacagcctctcccttgctgtgcaggggcagtctcagcacccaccagggttttatctgtctcacaaatggagtgtaatacctggtcctggagctcagagccttacatagcagccagaaggccagcagctggtacacataagcaaatcatagcatgcagcctcacagcgctgtgcagcgtgcaaggggaggctgaccatccatgctgccgtggtgccctctgcaagatctggcattttgggaagataagctacatgcaggagcatgattgagactt

SEQ ID NO: 27731 - DNA, 1045 bp, Homo sapiens
atccactttatttcattcttgtggctctaaaagttttccccttttagaaggatgtttgcagacgtgtgtatggcaggtttagctagaaccttgtaaatattctacctggagttctgagattttcctgacttttgacttttcctgtgtggaaacattttttaaaaaacatgttagggacattgtggagttggttggaaagagtggctcaaaccgggctgaatgggcgtgtctggagatccaaggtccgagtgggctttccgtgctgacactgctcagctgagtgcattgtgctgcacgacctcaggccacgacattgatttagttccactcgtgcatgatgagctgccagcttttgtttggatgtaaaataaaaactcacattgcctttttcctagcacagagcaggagagggagaggggaagtgagactcagcagacattgatggagggtccattaagagccaggtccatgctgagcaacggccagagagacagtgtctgggacgagcttggattctggatgaggctgggtgtgggagctgtggccatgggtgccggggccagccctgggtgaggctgggtgtgggagctgtggccatgggtgccggggtcagccctggatgaagctgggtatgggagctgtggccatgtgtgctggggtcagccctgggtgaggctgggtgtgggaggtgtggctgtgggtcccggggtcagccctgggtgaggctgggtgtgggaggtttggccgtgggtgccggggtcaggcctgggtgaggctgggtgtgggaggtgtggccgtgggtgccggggtcaggcctgggtgaggctgggtgtgggaggtgtggccgtgggtgccggggtcaggcctgggtgaggctgggtgtgggaggtgtggccgtgggtgccggggtcaggcctgggtgaggctgggtgtgggaggtgtggctgtgggtactggggtcagccctgggtgaggctgggcgtaggaggtttggccgtgggtgctggggtcaggcctgggtgaggctgggtgtgggaggtgtggc

SEQ ID NO: 27732 - DNA, 1889 bp, Homo sapiens
aacagagactgagaaaatggtctggtttaaagggacaggaaaaccgtgtacagtgcttgtctctgaattggaaactggactggggtgaaaaagatagctgtaaaggacattgttggcaccatggacagaatttgatctgaatggtggattgtataaatgtcaaatttccctagtttgttgtactgtgactgtctccttgagcttagtgaatacattttgaactatttagggatacaggggcacaaagtctgatacccgatttcaaatggagaaggagaggagcaggggtagatagatgatatggagggagggaggaagtgagggagagaaaatgacaaaatggttgtggtaaaggggaaaagtggaaacaggtggtgaagccagccgagtgagggagtattggagaattttttgtactattcttacaagtttttttttttgttgttttgtgttttttttgagactgagtacttgctctgtcgcccaggctggatggcgcgatctcggctcactgcaacctttgcctcctgggttccaacaattctcctgcctcagcctcctgagtaactgggattacaggcccacgccaccatgcccagctaattttttactttttagtagagacggggtttcaccatgttggccgagctggtctcgaattcctgacctcatgatccatccaccttgccctcccaaagtgctgggattacaggcgcaagccaccacacctggcctattctttttttttttttttttttgagacggagtctcgctctgttgcccaggctggagtgtagtggcgcaatctcggctcactgcaagctccgccttctgggttcatgccattctcctgcctcaacctctggagtagctgggactacaggcgcctgccaccacgcccagctaatttttgtatttttagtagagacggggtttcaccatgttagccaggatggtctcgatctcctgacctcatgatccgcccgcctcggcctcccaaagtgctgggattacaggtgtgagccaccgcacctggcctattcttttaaattttctatacatttgaaagtttttcagaataacaagttaaaaagctagtcctatattcactgccatctaaagacctccaaccaataaaaagtttactatatttcatctattctaagataaacctttttttttctttgcttgatagtatttttgacttgggggtacatttaaaaactgatgccatcttagcactgggtcacattttgacagcagtttttcgtcatcatttgtcttagaattagtggcatctcaaatttgatgaaatactgtatttttctctggctctgttatgtgaggaggtgggaaaaaagaagactcctaggagctttgcatgtgacattttttcagcccctcatgcccacatctacactcaaggattccacccccataccatgtagctacattaaactcaacatattccagactggatttctgtctgcacctctatctaccatgccaatctgtgcttcctctgtttcctccctcaaggaacagaaacctgatatttagccaccgatggccccagaaggtccaacaggaggagctccaggacctgtctaggaggggagatgtggacacttcctgtaaagtggggcatgcatgaggaggaggtggcctggatccttccctttctgggtaaagggtggaagcggtgtggattctttacttcgtgtgttctgatagccatgtgtcactgtgtacttgttctttgggtcttcacatctcctcctgttgcattttaaagcatttcaatggcatttttatgcctaataaagcattctcctagaaaaaaaaaaaagacggtggtgggcacaaggcccttgcccagccatgccatg

SEQ ID NO: 27733 - DNA, 1033 bp, Homo sapiens
aaatagactggtcagatttggcctcatcgagtaggtgatgtttgtgcacagacttgaaataaaaataacagaagcgctgcttgaattgctaggctgagtgcaggcctcattttgtgagcgtgttttaaaattgttaatagttttatttggaattcatccccttctgtcgtgctggatccctattgatttcagtagggatagcaccatgttcaagaggctgaagatgagacccggagccagcaaatgaggaacggtttttgagggaacttatatacaagacggtccattggcggcgggctggacagaactgcagccacttgtaaaaagaatgcagtttatatagcattttcacttagcaccctccctgcagcaacctcctcctggctaccttcatttaatggaaaaaaaaaaaaggggggcctctatcccctctgcaacctgagttccgcaggatgggatgggccatggttcagatcctcctcataaataaggaatgaatctctggattggacactcctggactccttatcttggaacccgaatacacattcctcatagaccacagggtcattctaagggtgtgcgtaagttagtgctgtcaggtgcacctgctatacgcttcatatccaaatgattagtattcagaatacacttttcttaaagtgttgtaaagtattagatggttccaaactaagccctcaaaaagtcttttaaaatcagttagctaaactaaagtattgatgatactaactttagttctgggtctagggagcagacagaagaatagagtttcctttttcgtatacgttcagagagagccttaaaatagagttttgaagtgggtgaagtttgagttcatattgatctactaacggatagcccttctgtcagagcagggcccctttcttcaggccagcgagcaccttgtgggctctttataccaaaatctttttcagccctgccttaccagtcagacacaaagtatcatcacgcctccaagttagagagctttttccttcacctccaattcaat

SEQ ID NO: 27734 - DNA, 1077 bp, Homo sapiens
aacacctgtcgatctgccacctacagtcagcatttagctttgtgctccgtattctttatcgcttacttacccagctgtgcattgctctctccatccataagtccatcttccttttgatgctctttaatattgtggacatcattatcctttacgcataaacacttcagcatgcatatcaataagtagtattataatgtttctttgtggttctttttaggatttatataagatgcataaatcttaagtgtaacattcagtgagctttgacatatgcataactttgtgtaatctggacccctatgacaacacaaaagaattactctcaccccagaagtgcttttgtgcctttttccagtcatttcctgcccccacgtccaccagagaaaatcactattcggattttgttcaatatgccttaatttcacccatcttagaacttcatgtaagtggaattacacagtatactctctatcagaaaattagcaggttgatttttttttatggttattgttgttgactttgtcctattgtctgcaaaaaaagcaggttcatacagactgtggagttctttcccattccttgcttcccaccaccccataaaaaatgtgggggcatccactgagaaatttggagctggcctgagttttcacgtgcataaggtctctgcttttggatcggggccactccctcagtttacataggtgggaagggactcctctgtcatcttgagtatcgtagaaatgacgaaatatcatagactgggaggcttaaacaacagacatttatttcgtacagttctagaatctgggaattccaagatgaaggtgctggcacctttgcttcattgtgagggtccccatcctggctcacaggctgccgcctccttactgtgtcctctcatgggctcaccccacgatctcaactaaacctgtttatctcccaacaactccacctccaaataccatcacattgggggttaaggcatcaacatatgaatttgggggggatgctaatgttcagcccattatcaactcccttctctcgcccccatatcaattgcttgctgatttgtctgtc

SEQ ID NO: 27735 - DNA, 1047 bp, Homo sapiens
atatttatactaccatcaaaaacaacatatttaaacttctaagagtaaatgtaggggaatatctttgtgactttggaataggtaaagatagcacagatgggacatgaaaggtaaactatttatgtaagtatatagaaagaaataacaaaaatgttttaaatcacctttcaactgccgtcagaggaagaaatttcactgtttttcttctccaactacatgtaaaccaaaaagtatcagagtcaagtaccaatttagatgtttattttgccacagttgaggacatgccacagaaagaggccagtggctttccccaaagatgagtttgagagcctcattgtttaaaaaggaaaagtaggctggaggggaaagaggaaaggtgtggtaatccacctgtgacaagagaaaaggagcaggtaggaaaatagttatgcattcatctcacactcagtaaatcagcactttacataagatacggtgtgcatagagtagctactatggagatatttaacgttttatctgtagctatctccttaagaacaaaaggaaaggcagcttcttgcatgacttagctttcagcttaatgtttttccttttggcagagtggactggggtccctagttttattttcttttcataacaccatagtatttgttcacttctgtctcaaagttactggctagtggatgtatgctgtgttcatcataatcaccacatgatagcatctttgttccttcacatttccttcttttcacccctatatgtctgtgtttttaattttatttttttagtcaaaacattcacttaaaagtatagtgaatactctaatgaaatcattacacccaccactttaatttacagttcttttcctgtatttctactggaatttttttcaaaaaattcggagaaaataatataatgaacccagtacacattattcagttctaaaaattatgaagtgtggccagtaatgctcaattgacttttgagggtgagaaggggtgtttaagcacatccagacatcattttcactcatgaatgttccaaaag

SEQ ID NO: 27736 - DNA, 2822 bp, Homo sapiens
aaaaaataataatttttactttatgtaacatatctgggatcaagtggactgggttgtggagcaagctgggattttgggggtttctgttaagaattagcttcattgaggtataattgagacaataaaattatctcccattttaagttctagttgatgagttttgagaaatgtatatagtgaagtcttgatcatcaaatcaacatatgaacatttttcatctcccaaaaatgtaggagctgtttttttatcttaggagaattttaatgaaatatacgtggaggagctaaatgtttcaagtttgcctcatattcatatctaatttattggtaactaatttaaaccactttcttacggctctcagtttctgttcctacaggatattaactcccacagatggcaacagatggcaggagtgagaccaaacagtttgcagtgttctccattcacaccctggaaatgaaagttttctctatttttcctctccaaattatcttggaagggatattcaatttttttcaaatttactatgaaaaatattgaagtaggaactaaagtagagagaatatataacagatctctctgttcccttgttgcaccttaacactttgctcttcttatttcatccaaccccctccccaccccatgctttctgttttcaggctagagcatcttgaagccaatccaagacaccattttatctgtaaatttactgcagctacttctctgaggactatttttgttgttactgtcttgccttttaacgtaactagagtaccagaatcatactcaacaaaattagcaatgtattaatttcactcattacccagtttatgcagaaattttccaggtctcaaaaatttctccttacaattcagatttcacactcaggttcattaagatgggaagcatgagagaagaaatatctagaaaccagctcagtagtgccccttgtctgttttacttctctcgttgtgatctaggtaaaggaagtttccctaccttggcaaacttcccatttgcttgcttaggtgctgaggcttgttcattctttccttgccatagctttttccttcccttccttccttctgcctgccaggctcatctcctaattctacttctacccataaggacaaataatgatcacaccacttacctaattgcctggccctagttctggtcccaactataatcagaaatgtggattctggaatggcagtgaggagcgacgtggactgtatctccagtaaaacaccataactggtaatttagaaaaccaaaaacaaccatttaaactacacggaatttgtcttaagaccactcaggaatttagagaaacatttattcagaaaaatcaactgagcctttctgagaacagtgagagtctgtaacatttgacacacaaactgctaccctccccacccccattttggtccactctgagagaaactccactgtgggctgtgaaaatcacaagatggaaccctgtccctctccagttctcagtctatggtgacagcttttccctgagagaggcacgatgccactattcttaacttctctccccctgccagtcctgtgttcctgaagctggtttcatgtaagtatagttgagaagtgtgtttgggtgtggacctccttgaatttattcttggagtttgttgagtgtgctggccttgtagattcatgtctgtcttcaaattttgaagttttggccattatttcttcagtaatctatcagcatcttctagacacccatatatatgtccagttaatggcaccttataactcttttggctctgtttatttcattcttttctcttctgcttctctgtctctgaaatttcaaattcttctctttatgtttactgattatttcttctgcctgctcatctgccgttaaatccctctactgaatttttcaattactgtgttttcgggtccagaatttttgtttgcttcctttttgtaatctctgttggtattttgttcatatatattttcctgatttccttttctctacccgtgtttcatgagtttttgagaatattttagacagtctaaaatctgtctagtttgcctgaagcttatgtttctccggggaaggtttccgtcactttattttcttccacttattgggccatgttttctgagtttttgttgttgttgttagaaattaggcattgtggaaaaaacaacctccttttccggtttttgcagactgactcttttccagggaggatttttgctattatcttggtattcgttctaagctttgggatcaatctgaggagaaggtttaagattttctcaggcctttttggagcatggatcttacctttgcttgtggctttttccattttctcataggcaactgcttttaaatatttatttgtcccaagagtctctcctctgggcctttgatggtctgttgtatgtctccacccataatatcttgccccaggcatctgctcttcaatctgtctgcatctttgccaagcatgatccagtgcttttcttccctaaggtgtgagatcctcaaaacagagcagtccctcaggcagcctccaacagcttagaaccttgtaagaaaggtctactgtgctttctcaggtttgagggaaggaagtggaaactgagatgctgctttagaagctctgttgtattctgcacctgtaattttttgccccagggatctataggcaagttcaccatgagatttttccattagacaacacttggacaggatagaacattgggaataaggtgtattgggctgcaaatatgactgtctcctgttttgtttttgttgttgttgttgtttt

SEQ ID NO: 27737 - DNA, 1078 bp, Homo sapiens
ggactacaggcgcccgccaccacgcctggctaatttttgtatttttagtagagatggggtttcaccatgttgctgaggctggtcttgacttcctgacctcaggtgatccacccacctctacctcccaaagtgctgggattacaggcgtgagccaccgcgcgtcaggctggctgtctcttccagacctaagaaaggcttagaacaaaggaggtctggctacattaatggagattcgctgcagatgcaaattttcccactaaagatagctttgcggggctatccatttcaatctgttgcccctgtggcagccacttcaaaacatgtcaaagaagtatattttggggtaaaataatttccttcagcatctgctgtcatgtgatgctgtaccagagtcaggttggaaagtgagcctcattatataagagtaataaaactcatctgatgagattttatggtttctcgggcaggattccccaagcctcatacataggcatttgggcaagggaaaaaaggtgaatttagtcctcaccaggttggtagggcttcctcggttattggagtgggagtaacagcaaccattgggcccagcagtttttttaaatgtctctggggctgtggactgaccatccaaataactgattttaatcatttcattatggaaaaattgtcagcagaacccccaagtagagagacccatcagtcaagatatacctcatgaccttgcaagctaatctagcttgacccagatcccctcctaatctgtgcagattcattgaggaatgtcatagccatgcctactggttaagacatagtcctttacagtgagagttgaaacccaagctctatcactttcttggctgtgttgctttgagaaaggcatttaaatgttttgtgcctgtttcctcatctgaaattggtgggtaatagtcacttcataggacagttgtgaagattgaatgcagaaaaatttgtgccacgcctggaaccgtccctggcatatattaaattctaaaaaagtgttaaatattataatgaatatcaacacttccttattctggaagcaccgacaggatatgct

SEQ ID NO: 27738 - DNA, 1035 bp, Homo sapiens
aactatgggatttataattaaaaatgagtctatttgaaacaccacattataaaaagctattaactgaatctttaaagtgacagtaaatgatgacttaacattttaaagagatacagtcacatcgcatgtgtgaattcagtcatctgtataaaatggcatcattaccttgatcatttcttcttctcctgctgttttactttttgcttctatgtcccctgcttcattgcatctaataaagcagctatttgaggccaacaaagccattttcccctaagtgaaacaaaataacaaaatagccatgaggatacttcttgtggaagaaacattaagtgcttagactgaattaatttttcctccctgatttaaaagtcacagaaaagaactgagagaaaaacctcaaaaatataatacaagaacatatagaaaaggaaaccaaaatcacctttcattttactattcaaagattaccacaataaacatttgtagtgtatcttcctagtaggattgcttcctttctaaaagatctactgaagataaaactgatttagttctgcttggaaaattaactttaaagacaagaacataattatgaatgcatactttattcagatattaacattttaagtaaaatttattttcttcacaattagaaaacatgaaaaggtacatacaatgcctttggtgttttgaatttaagaatcaatgtctgagggacttttgtgtgtgaaaataaatattcatatacatttttagttgtttaatgtttgatgtattacactggtttctattaaacaaaactgtaaaacctgattttcttgtgtatttaaatctgggttataaatttggttagcttaactcccgtaacaaatataacgtttatttataacttgtatttggttgattcttttggaaaacttggaataccataacatttagacaaaatatttataaatacaatgattacaaaatatgttaaccttatatcacatccagttaaaaatgtgctgataacatggatttaatttcttagtcaag

SEQ ID NO: 27739 - DNA, 1053 bp, Homo sapiens
tttattttttcttattgcttgaggccctttctggaaggtaagtctggattatctacttcacactgttttagagaagacttgtggtttccatttaccccttactccctccgctccatggcctttcagggagaacactgtgggtatcatgctgggtggcctggagggtccaagtaacaggaatctagaaggatggaccagatgtgaacaaaagaaagcctgagtaggacacaaaacagagaagtggggctgtaacatctctaagatattacagcttgctacttccactctctttgcaaatgtggtgaaacccaggctggagtcataaaataatagcataggatcattaactaaagtttgtctagtgcttccttgtgttcacacattatctcattgaacctctgacgatgctaggaggaggtaaatagggttttcctcttaccttgggtgaactgaggtcttctgactaagtctcaggtcctttctaccatttgtgctgcatccacatctctactgggaagaacacaggctctgcagtcagacacacctgggtttgaaccacctccattttgtgtgtgttggatcttgagcaagtgaattcacctttgtgaccatccatgtcttcataaaataagaattttaaacacacatgagggcctggcatatacaaaacattgaataaatagcagtgatctttttattgacatcagaagggggttggggacccagaggctatttgggctcctatggcatagctcttggaacgtgttaattttcaaggacaggggtttgcaagtcagagcaatgtcaagtaaagaacaggttctttgggaggccaggatatgctaatgggtgaacaatgtaagggaggcataataataatgccaaaggcctcctagagtacctgttcactgcacttttgggtctttggtttatatatgaagaaaatgaggtgcccccagaggggaagtgggttgccattgttacacagtaagttaataaatggcattgctgagattagaactcagtcttttgtctgccaagaaagcttacttt

SEQ ID NO: 27740 - DNA, 1081 bp, Homo sapiens
ggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtaagaaccaagccccttgtgtgtcccttttctttggcctctggtcagagatccccaacagcccttcttctgtatctctttctgttgtgttgggtgattgttggagacgttgatagttgaggaaacctgactggcctcatttcaccacaagaggttaactccttggaaatacaaatgaccctgtgcttcagagatcaggcatctttcaccctggtcacccccatgactccactattccatacttgtgttccagtttctcagcaaagaaaactgtagcctatgtgttcattaagtcccaaacctgtgagggtaggaagttagttcggtgt

SEQ ID NO: 27741 - DNA, 1062 bp, Homo sapiens
tgtgtgtgtgtgtgtgtgtgtgtgtgtgtgtgtgtgtgtgtatgtgtgtatgtgcaagacagtctcgctttgtcacccaagctggagtatattggcgtgatcttggctcactgaagcattgacctcctgggttcaggctgccccctagtaggtgggactacagacgcatgccaccatgcccagctaatttttttttggtatttgttgtagagatggggtttcaccatgttgcccaggctggtctcaaactcctggactcaagtgatcctcttgcctcggcctcccaaggtactgggattacaggtgtgaaccaccacacccagcctggattcaatttttaccagtttatactccagaacatctccatattcccactatagtccttaaatcatataggcaggggcgtagcctgcagagcctactactcaaatgccataaatttttacggaaagaaaaatagcaactgtcaccctaacagaactgaaaataaagtaggcaggttcgtggaactcttcctcagatactgccagtgggacttactgttgcaatttctcgagctcctcagcctccagctctgctgtacttttgcaggtcacagcccgtgcacggtgtttggtttgcagtacaggagtctgtgggtctctgcaaatcttggtcacagaagatttggagggtaacaggtctgtaaacagagatgacagatgttcatctagatccgcaagacccagtttacttgtaagtggtgattcacctatgtagcccagagagggataaaccaaccacagagtggtgggcccacaacagtcagctcagcttacattggtcaaaccaaccaacattcagttacttctcccctattcctcttttattgaggggtatgactaaggtagcctttgggtaaactctactgtcatcttctgaactgaaaatccatccatgtctgacaggttccttatcactgcacgggcctagactgactttcttttttttgagacagggtctcactctgttgcccaggctagagtgcaggggcataaaggctcactacaaatccaacctccc

SEQ ID NO: 27742 - DNA, 1035 bp, Homo sapiens
cacagccgagacctcagagaaggcactgcatgtattcagagcacacattttgtatcagccactttcaagagtattatttcatttaatcctctatacgaatcttacaggtaaggaaaataaatccgtattttagaaattgaggaaactgaggttcagagaaataaagtaacctgcctatggtttcccagccagtaagtggcagctcttctgatagcaagtccaaggttctttcccctttcagatcaggcactagaaagaatcttaggctgaaaatatactgagttgtgccagtaactgggaaggattgtgtttgttttatggaaacaggttctgtcagcttctctatagtctatagttgttaagattaaaatgtgagaccagaagagcagctttgaaagagaagtagaattctttcacagttttgctgaggaaggacaagtctgaaggaacaggccttctgcttatgtaagacaaacccaggaatctttctggatcagaggagttttcagacaaagggcagagagagactagatccccaaaagggttcctaggtaacactagcagctttggttatccaagaggctgctggtgactgtaggtagggacttcctgtgccttttgaaaagtgtaggagagtaggatcagggtgttggctcttttctttgtgaagacatagccccattaaaagcagatcaaggtgagcacatggctgctgctttcctcctttggttctatcagtacaagctccttagccaccaccagcctctttcctagaagcccattactcactctttcagtagcagcctactaaactattgtgtcttgtttgtgcttgttcaggagaacagatgaggtggacgtgtgggaggtggggacgtaatgttctctttctgagtttgtgtggagtttccagggctaggctcctctctcacatcagccaaattgatgtgacttgtttccttctggctgccattcccaactttccagaggctgaggtgcatgatttcaaattgaagggggagtagaatttgactt

SEQ ID NO: 27743 - DNA, 1049 bp, Homo sapiens
cgagagatccctttatccaggagtgggcagggcctacacagccctggccttgtctgggatgctggggaggacaagctctggggcctgaggagccgagaggttcacctactgagaaagtgggtgaaccaggcgtggtggctcatgcccataatcccagcactttgggaggctaaggcaggcagatcacttgaggtcaggagtttgagaccagcctggccaacatggcaaaaccccacttctactaaaaatacaaaaattagctgggcgtggtgatgggcacctgtaatcccagctactcaggaagctaaggcaggagaatcgcttgaacccaggaggtggaggttgcagtgagccaagatcacaccactgggctacagagtgactccatctcaaaaaaaaaaaaaaaaaaagaatggaggtgaaggtgagcctggcccagtggggccacgtggggatcagtgcccttgcccttcgccaccacccctcagcccaggacacatacagagctccatcctgcaggctcctgtgtcagggacaggccctcctgaggcacctccaccgggagcctgttcaagggtgactttcccaggaaccaggaagtgaccaggccgcgttggcgtcatcactccgacctaaggactgcaatgcaccgaacccagactggcttccgggagggctggaggagggcctgcaggggctttggggccagggccctgccccgtgaatcattcacacatggtggcctggagtggctctgtttgctctgagaacacggggagcaggctgtgtgtctcggctcgatctttgcacactgaattagtgtttatttctcaccgcctgtgcttggcctggaggacggggccagggagaacacccacacacaggcagttcatcctgggagcgcttccccggggcatcagtggccagtaggtgttgggggaggggctctaggaagtggagcagtctggtagcaggggtagggaattgtcccacagtacagatgggcaaatcaaggctggccttggaggctcccagaatgtctgagagca

SEQ ID NO: 27744 - DNA, 1026 bp, Homo sapiens
gcctcagcctccccagtagctgggattacaggcatgcgtcacaccacacccagctaatttttgtatttttagtagaggtggagtttcaccgtgttcgccaggatggtctcaatctcctgacctcgtggtccacctgcctgggcctcccaaagtactgggattacaggcgtgagccaccgcacctggccaggttgttttttctatgtaagagtagattatatcctcactcccatttacaatagttcagagcccattatgaactccagaactactacagttcctttgctggattggaattttgtcacgaatatactctgttgaataaggggcattgatcaggctctgcagactgtcaagggggattttgctgcaatgctgggggatttgggcaggatttttcttactgttagcactgcacctttgcattgattcactgttcttccaattctgtttagaaatctgctgtctggtaatctcacttttgattgcagtttatttgcttttggagtatagtgttcattaggatggtaatagtctggcccaagaggagatgagccagaaatacctgtattctttccctggagggaagaggactggcttggctgggatgggaagatcaagtggggggagggggtgttgattgttcagttctttttttttttctttcattttttcactttttggcctatcattcttgtttcctataactgttcagttctgacactattgtttatttttactatagtggcattaaaaaaagaacctgggggccgggcacggtggcttacgcttgtaatcccagcactttgggaggccgaggcaggtggatcacaaggtcaggagatcgagagcatcctggctaacacaggtgaaaccccgtctctactaaaaatataaaaaattagccgggcgtggtggcaggtgcctgtagtcccagttacttgggaggctgaggcaggagaatggcgtgaacccaggaggcggagcttgcagtgagcagagatcacaccactgtgctgcagcctg

SEQ ID NO: 27745 - DNA, 1804 bp, Homo sapiens
agatggagttttgctcttgttgcccagtctggagtgcaaaggtgccatcttggctcactgccagctccgcctcccaggttcaagcaattctcctgcctcagcctcctgagtagctgggattacaggcacccgccaccatgcctggctaattttttgtatttttattagagacggggtttcaccttgttggccaggctggtctcgaactcctgacctcaggtgatccaccccaccttggcctcccaaagtgctgggattacaggtgtgagccactgctcccggccttcctgtccccttcttatcctttgtccttgtgcatcccttctttctagtcccaaaggctgccatcccagaacagtttcttagccctacatgcctagttatggcagttacatctccacctccattctcccatccagactccagtttgccctggagcacacttaactacagcacaacttggatcatcctgcttctctcaactgtttaccttgcgtaatgaagtctgtaggcctcagtttggcattcaaggcctttcctaatctaatctgcaacgtaagagcctccaggccctcatcagtgtcctcttcctttgacctggtcctgcctgtgcaagaagctcttattgtagaagtacagtttgttagagctgaagtggccttaagaaaccaccagatcagtcttcctcaaattggtgtgtccagagtcagaaatactctccccgcaaccccagccttggaaccctggagattcaagcacacattgacacatctcaggttctgaaaagtcctacagtaaagaaacttgcttaaccagtatctgtgaagcacagttaatgatggaactttttggtttctttttttttttttggcagggggagagtcaagtaaaagctttgtaaagtactgatcttttttggcattttattttattttattaatgtatttatttgagacagagtctcgctctgtcacccaggctggagtgcaatggcacagtctctgctcactgcaacctccgcctcctgagttcaagcgattctcctgtctcagcctcccaagtagctgggattacaggcccatgccgtcacgcccagctgattttttgtattttagtagaaacggggtttcactgtgttgcccaggctggtctcgaactcctgagctcaggcagtccacccgccttggcctctcaaagtgctgtgattacaggcgtgagccactgcgtccggccccccttttttttttagatggagtttcgctctgtagcccaggctggagtgcagtggcgcaaactcggttcactgcaagctctgcctcccgggttcacgccattctcctggctcaacctcccgagtagctgggaccacaggcgcccgccaccacgcccggccaattttttgtatttttagtagagacggggtttcaccgtgttagccaggatggtctcgatctcctgaccttgtgatctgcccgcctcagcctcccaaagtgctgggattacaggcgtgagccaccgcacccggctcccctttttattttattgatttttttttttttttgagaggcagtctcgctctgtcgccgaggctcgagtgcagtggcacgatctcggctcgctgcaacctccacctcctgggttcaaatgattctcctgcctcagcttcctgagtagctgggattacaggcacacactaccacgccaggctctttttttttttcttttttggtcaagagggggttttaccatgtcagccagggtggtctcaaactcctgacaaagtgctgagattacaagcatgagc

SEQ ID NO: 27746 - DNA, 1054 bp, Homo sapiens
ccttgatatgaatcttggttctgctgcctcctggctgtgtggccttgggatattatctaatatttttgttccttagtttcctcatctataaagtggggatgaaatcatgcctatcatagggttgctgtgaggattaaacaagatgaaatatgtcaccctgcctaggatatgtgagtctccataatctactatcatcatcattatctactattgcatcagccacgctcaggtctttgattttatgccattctcctatctacagaatctagattttcacaactatttacaccttgtttgaaacagtaaaatatggattttggggggttatgtttctttatctcctcccaaaaatggatcatttagaatgattttactagacagaaagccggtatagagacattttaacctcactctgaagtttcttcttttttgagacagggtctcactctgtcacccaggctgaagtgcagtggcatgatcttggctcactgcaacctctgcctcctgggctcacgtgatcctcccacctcatccccccaagtagctgggactataggccaccaagcccggctaatttttgtattttttgtagagacaaggtttcactatatttcccaggctggtctcgaattcctgacctcaggtgatccaccctcctcggccttccaaagtgccgggattacaggcatgagccgtcgtgcctggcctgaagtttcattttcaatgggggtataaagttttctgggcacatgctcccaaagtagatatgtgaacaaaccttgtcacaaatgtgtaagaggtttcaaagcgaagtactgtatttaagacgtgtttgcagatgtttcagttttggctgtttcttttcaatccacttgctcacagatgtcaatactcagggttaggcctgtggtttctgctttgtaagtcaaaattgagtgtgtctgtcccaagagggctttcccttccttcccagaggacgtgtggcttatgggcactctggttctgctgcttctcctctgagcaccccctgcctctttgcacccactgggtacac

SEQ ID NO: 27747 - DNA, 1028 bp, Homo sapiens
tgcagcattggaagtggaaataccttttctagtgcttaggggaaatgtaggccaagaagctgatctctgtcatggaatgctgtgggtgaacaggcctatcccgccttactctgtactattttgttttacttatgaatagtcctagggaggaccttacagttgctatccctcccttgtaatccacatatgctgaaggcctcccttgaaggtaaacagcaggcagtcacctgtcatcctttgctgtgtatcacaggtgtgagcctcagcagcgatttcattgctggcttttgtggtgagacggaggaagatcacgtccagacagtctctttgctccgggaagttcagtacaacatgggcttcctctttgcctacagcatgagacaggtgagccctggggttggggaggactgacatcattcctgaccagtttgggggtggtgactgtagagaacagggcagaaaagagagtggcggcaaggcagtccttgagaaaccacaggctcttacgattcacttccgttcatttttctagtacactctgtctactctgaaacggttcagcaatttgatgatacatgattactgtgccagtattcctcattaaaatattttaaaattatgtttagattgtttgcaatttgaatatggaaggagaaaaccttttctttacgagaaacctaaaattgtttcttaacatgcagaactcctttttggtctgcagatgtgatttattttaccggggcccctggtcatcttcccagccatcctcagtgattcctaacttctgttttcctaggcaagtgaactcacttggaggcttcccaggaaacaaagcagattcccaggcaaagcagaaggagattaggaaagaaggagagattagtgcacttttcctgaagagaaggatagtcctggttggctgtcattttcttgattgtaggcatggatttgcacggttcactcctcattccctcagtcacctttgtggcaatgtgcttgtgtttgggcaggaggttgaaggccccctg

SEQ ID NO: 27748 - DNA, 1063 bp, Homo sapiens
tttcactctgtcacccaagctggagtacagtggtgtggtcagagctcactgcagcatcacctgcctggactcaagcaattctcccacttcagcctcccaagtagctgggactacaggtaggtgccaccacgcccagtgaattttttaattatttgtagagatgaggtctcactatgctgcccaggctggtctagaactcctgggatcaagtaatcctactgtcttggcctcccaaagtgctgggattacagtcatgagccactgtgcctggcctccctgctctagttctaagtcaccagtttgctatcatcctcacattctggcagtgctgtcttctcttgccctacccccagataatcagttccttgatttggcccctagctgctcccctgctctgtgaggcattttccataccccacctctccaagtgcttcctggtctaaagttgtctccttcctctccccttccagctctccctcagtaccaaaactcactccttcaggatagagacattctgtttaaatagactgagatggtgacaaaactccccaacctttctaggccatttgcctataaaagaaggaacttaataacattaaagtgaatcttagtgaattcaaggccatagacttgtggaaaattaagattttacttgtattttaaagtatctgttagtcacttaataattttgcttgtttagtaatttttaaagattttttttctttcatttagattttttagactacagttgcaaagagtatagaatattgtacctttaacagaatgtccgtttattcattcaaacaatggttatctattggaagtcttctaaataagcaacttttataaaaagtctttttaatctttttatatgaaaaatacttaaatatactgaaaagagggaatagtataatgacccctctgccccagctaacaatcacctaaatttaacaattgttgcattttgccatatttgtttcatttacttttattttttatttttttttggctggagtgtagtggtatgatctcggctcactgcagcctccacctcccagattca

SEQ ID NO: 27749 - DNA, 1052 bp, Homo sapiens
gcagatgtggcaggtcatctcattggaaaggtaatgggccacatctgctctttacacgtgtatagcagggttcccctaaccctaggtggtagaatggtacctgtctgtggcctgtgaggaaccgggttgcacagcaggaggtgagcagcaaagctggcattactgcctgagctctgcctcccgtcagattggccacggaattagtttctcaggaacacaaaccctattgtgaactgcgtatatgcaaggcatctagtttgtgcattccatttccttttttttgagacaagttctctctctctctgttgcccaggctggagtgtggtggcgcaatctcagctcactgcaatctctgcctccctggctcaagtgatcctcctacctcagcttcccaagttgctgggattacaggcacataccacaatggctggctaattttttattttttaatttgttgtagagacaacaaataaacatggtcttgccatgttgcccaggctggtctcgaactcctgagctcaaacaatccgcctgcctcggcctcccaaagtgctgggattatagatgtcagccaccgcactggctcaagattgcatgctccttgtaagaatctaaatgcctgaggtggaacagtttcaacacacccctgcttccatgtctgtggaaaaattgtcttccatgaaaccaattcctagtaccaaaaaggttgggaaccactgatgtttagcacctgccgtgaggcagctaccacaatgggagatggtgaaggtgtagaaatgaatgatacttgttccctgcttgcaggaacctgccagtttactagggctggcagaagtgtcagtaataattaacagcaaagtgtgatgagtcttgtgatggagagatagaatagagctttgggaacccagaggaggaccccacctagacttcgggggtgatggccagagcaggcttcccagaggaagaaagctgaaagtaccataggccactagagagaagataaataccagccagagaacagcatgtgtaaaatcctataagctagtgaagat

SEQ ID NO: 27750 - DNA, 1061 bp, Homo sapiens
ctatgtcaggggctttcagcacctcccacccccgcctggtccagggcttctgctcatttgagagggagacagggaagttctgagcctaggagctgaagagaggacactagggaattccccctgcctctagctccagtagtaccaactagaactgattctccgtgttgggatctccacccgttcgtccagggttgggagagaatcccactcatgctcaccccccggggctctcaagtctcatccactttctggttctggaatctctgccctcccttctgggctttttttgtttaagactgagtcaaacagggtcttgctgtgtcctacaggctggagcagtggtgctgtcaacggctcactgcatccctgacctcctgggctcacgtagtccacctcagtcttctgagtagctgggactgcgggcattcaccaccacaaccagctaagttttaatttttgtagagatggggcctccctatgttgcccaggccaatctcaaactcctgggctgaagttatccacccaccttggcctaccaacgtgttgggattacaggcgtgagccaccttgaaaggacccccatccacacccatatgggctcctgggatcctcatccttgggagagattttcgaattcctccctcaccccctaggacttctgcatacaaggcctagactcccagcatcccttcccacccacttgtccagctttctctgccccccagctgcctccccagccctgctccccatcccccgccctcacagccggcttcttccgagtgaggtggttgaggaacgatttccaccaggccttgtccatgtcagccggcctctccttgcgggcctgcttgggtgctttggtccttttgtgggaactatagtttcccatggcagggctggtcaccactggggacgatggcccacactccgtctgctctgccccctgggccctggcaacattgtgacctcacgggctgacctcaccaattgcaggctctgagcaccgccttccagggcccacaggtgaatctgggctccactcagtcacttctagccttggt

SEQ ID NO: 27751 - DNA, 2494 bp, Homo sapiens
ggacactgacagccagcgatatccttggattggccgtagggtgtggaaggcaggcttagcaggcaggggctccacccaagtgggactagagaggcttggatttaagagagagctctgattttggttgcaagtcctggctcagcattttctcactgttgtgacactggataaattgcttaacctcttggcctcagttttatctataaaaggggaataataatatccaattctgaaattgtacagattaaaaaagaaaagtggctaggtgcggtggttcatgcctgtaatcctagtgcttcaagaggctgaggtgggaggatcacttgagcccaggagtttgaggctgcagtgagctctggttgagccacatcactccagcctgggtgacatagcgagaccctgcctctaaaaaataaattcccagcaccaggcctggagttgtgttgaacattttacatggaatcgttcccggtagccattattaccttgggattcaatgggtagagtgatttcattatacagatgtggaacttgaaactcaggcgtgaggtaggttttgagtgggtaggaggttgggaggacaggagtgactaggcaggtgtgagccctgccttgtgagctgttggagtgagtgaccccctagaagtcaaaggtcatgtggtccttgactctgccaaccctggcctacgtgacgtgtcaggaccttcgtagcattgcagaccctgcagagcagatggttatggtgatcaaagcccctcctgagacccagctccaagccgtggactcttcggaggtgagatctgggaactccgggcccaactgggctgggctgggctgggctggtggtcacctgggcctcagtttaccctgcctgctgcttccacccagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaaggtgggtgatgggtaggtgggtggggtggggcagggcccctcttctggggggtgggcaggcacgacagcccctgccttcctccctgctggggcatccccggcctgtgatgctccccgtctccccagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctct

SEQ ID NO: 27752 - DNA, 1056 bp, Homo sapiens
cttgaactcctgagttcagacaatctgactgtctcagcctctcaaagtgctgggattacaggtgtgagtcaccatgcccagctgaaaacttaactcttaactcttttttttttttttttttttgagatgaagtctcgctctgtcacctaggttggagtacagtggcgccatctcggctcaccgcaacctctacctcctgggttcaagcgattcttctgcctcagcctcccgagtagctgggactacagacgtgcaccaccatacccggctaatttttgtatttttggtagagatgaggtttcaccatattggtcaggctggtcttgaactcctgacctcaagtgatctgcccgcctcggcctcccaaagtgccaggattacaggcgtgagccactgcgcctggccaaaaacttaactcttaagaaactagaaagttgacggcaggatcccagccctattcatttttttcctttttttccctaaggctatttttgtttgtggtggttgtgacagtttttgttttttaaagttttaaaaattgtagtttttcctgtatcattcacaccattcagatatggcactggtctcccacagtccttccagaggctgccccgaaatgtattctataataatataaactgaaccagagaaaagtttcatgagctttttaatccaaaagggatcatataaatatatcgccctgtgacagtgttttgcttgtctgtatgtgtgaggggattcttgtcaacctgcctcggtccttgacagctgcgtggtgttcaaggggctaaacaaagcacagctttcgtgacccccttcatggatgggtgttcgagtcatccagattttttcagcagtgaatgtcttcacccctgcgtttcggggcccctctgccagtgtttatctagggagaagtggcagaaatggcatccactcaagcctttgttttagggcgtggcactgacctgccttcaggggtggacaagggtggggatcccagggagaaggcaaggggtgcagatggcagaagcatgctagggtttgggccccaggggc

SEQ ID NO: 27753 - DNA, 1046 bp, Homo sapiens
ctgaagctgcagaagggattctagtgacagtgtttccttccacattgttcacttttacctctccatgagtgcatttggggtgtataagaatcagactttgaacgtggctctctcctaaaccagaacaccatgctgtactcaacctctcaaaacgaagcccacgtcaccacaatttgtgacttcagatgggttgctttctatgacaaatttgaggatctttataaaaataaattttttttcctccgcttgtctcgttccagattcacagggggagagtttgtcttagttcagccttgaagggcatttggggtgagcaagttttgattttcagcagagggtgccctgtagagtgggacccactctcgtgctgcccagatagaagacagagggagatgatgatcatgtaatcctttagataaaaaataaaaatgaaattaattaaaaaataaagaagacagagggagagctgagctctcttctgagtgttgttctgagaaagggcttctgaacggaggggacctgttttctgtgctgggactctgtgctcaaagctgctgcagatgtcataatttaataaacaagacagaagccaggcggaatgcaagtgtgggtcccagtgtctgcgacagaaacctcattctcattgctcttctggcctctccctccagcttctccttgtgggctggatgtcagctgggagaaggatcagggccagaccacatcagctcctttaggacactcctttttatttttatttatttatttttgagatggagtcttactctgttgccaggctggagtgcagtggtgcgattgaggctcattgcaaccttcgcctcccaggttcaagcgattctcctgcctcagcctcccaactagctgggactacaggcgtgtgccaccacgcccagctaatttttgtattttaagtagagacggggtttcaccatgttggccaggctggtcttgatttcttgacctcttgattcgctgcctcagcctcccaaagtgctgggattacaggcatgagccaccgtgcccggcca

SEQ ID NO: 27754 - DNA, 1078 bp, Homo sapiens
tgggagacggagctggcagtgagtggagattgcaccaccacactttagcctgggtgacagagcaagactccatctcaaaaaaaaaaaaaaaaaagaaaagaaaataggcaaaaatgacctcattcatgcagaaaagagttaatatagcagcctaatgttgctatcttaagaagggcttccctttccatcttggacccagcagaatggctcccagaaagaagggtggcgagaagaaaaagggtcattcggccatcaatgaggtggtgacctgagaatacaccatcaacattcacaagtgcatccatggagtggcttcaagaagcgtgctcctcaggcactcaaagagattcggaaacttgccatgaaggagatgggaactccagatgtgtgcattgataccagcctcaacaaagctgtctgagacaaaggaataaagaatgtcccatactgcatccgtgtgcggttgtccagaaaatgttatgaggatgaagatccaccaaataagctctatactttggttacctatgtacctgttaccactttcaaaaatctacagacagtcaatgtggatgagaactaatcgctgatcatcaaatacctcaaataaagttataaaattaaaaaaaaaggggggggggcttgcttgcagcactagctcgtgactgggatctgagaatctggtttgtgggacatctcctttgttgataaggcttattttgcccacctggggcactgttctattgtaccagattatgtagactgcttggacaaaatatgtgattcatggtgaacacttccttctcttctgggagtctggaattttggtcatggtggctggtcacctacatgaccaatccctaacagaaaccctggccttgggcttggtgcagcggctaacacctgtaatctcaacactttgggaggctgaggcgggtggagtccaggagtttgagaccagcctgggcaacatggcaaaaccccatctctactaaaaatacaaaaacattagccaggcatagtggtgcacacctgtagtcccagctacttgggaggctgaggtgggagaatcacctgagcc

SEQ ID NO: 27755 - DNA, 1041 bp, Homo sapiens
ggcatgtctgtcaacatgtttgagtggctctcctctagacagaaacgagaataagcaagctggcaggcttccttgcatcctggggcattgagtatcagcccatgtttagtgccggaagcgccacagcagacagcttgtgttttcttacccctcgaatagctgcgcttccctggtctgggtgcccagctaaattctcagcctgggcttgtggagttctttgtagatgtatttaagaaggcagaaacttctctacctcactgcagccaccaggtaattctgtgtgttgctttatttgcagaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacacggcctcccacgcgagtgtggtgggaccttgagacttaggaggattgcctgttttcagtgtccagggaatgactccatagatttgaattc

SEQ ID NO: 27756 - DNA, 1324 bp, Homo sapiens
tgagaccccatctctacacaaaaactaaagaattagacaggcatggtggcacacacctgtagtcctagctacttgggaggctgagatgggaggatggcttgagctcaggagtttgaggttacagtgagctatgatcatcactgcactccagcctgggcaataaaacaagaccctgtctcttaacaataaaaaaagtggtgtcatatactgtatctttatttcaaagtttaaataaatggtgcagtgaaattcacttaatagctaaataatcacagatcaaaacaatgaacagattttttagaagtttggtgagatttccatgagagataaggtttatatattttgattttctttttagattacatcgtcagcccaaacatctccttgcatttttgttggctgaattgggtacaaggtaagaaactgtatacatttacatacagtactgctggacatttcataagaacctttcttgaaaaggatatgtaacacacttagagaaaatgttcacctgattattagagaaacttttaggccagtggaggagtgaaatcacttcatttctgtgggagagcttggctgcttaggaatagggcacagagttgacatctgaacaggcctgctggtgtaccaaccagaggaccacagaactgccatgtttagactttcctgttactaactgaaactcttgagtctttttatggagcaaatattagatttttagaggaattggttttcttaaagtcagacttttttttcctaaattggtaacaggctgttgaagaaatacagctagtaagttgatgagtggcactggagaaaccattgaaaccaggatctgtgatgaaataggtacttacctgtcttcagggctcaccttttgaaggcactgagcaagtcattcccattcaggaaggccaagatctcatggaccccatgccaatgagtttgactactatctggaagcctaatgtccctttaaaaataagtaatgtagagtaggtcatgataatgatgactaatgcatattgagcacctcttttgtgccaagtgcttttttgggtgccatctcaattaatcttcacaatagttctatgaagtagaaagtaatattcctatcttcacgttcggaaacaggttcagtaaagtgaagttgtagttggtcacatagctagttagtggcacagtcaagatagatacaatcaggtctatctgtccctgcagcttgatcacctaacaggcttgacacctgtgcgtcactggcagtacagagataattaaggtgttctcttcctactctctttaaactgttgggatttgctac

SEQ ID NO: 27757 - DNA, 1034 bp, Homo sapiens
ctggtaagatttctgaaatgactgtagccattgtcccaggtcaggatgtaggcacacacaaaatagatattaatgaatgagtaaggttgacagcacagttcaggatagggagctggataagctggtagaaggaaggagaaatcagaaagctggaaactgagactggccttttctgctcttctgggatgtttatgactcatttctaggttttaatatgccctgtttacatccatgcctctggcaactaatcttggggtcaagctttactttgtttccattccattccatcacttgatcctaattccccatggcttctgcctttccctctttgataatgtcatctattggagtgatgcccaaagaccacgccacagactggtgccaggctgactgtcatataataaaaaataaatatttgttctttacgttcttggctcacaactgctaaaatccttggaatctccgaagtgataacagggtctttggtacgctaatgagatttctgaaatgactgtagccattgtcccagttcaggatgtaggcacacacaaaatagatactaattaatgagtaagggatcccttatctggggatctctagatagctttaggatgggggctggtcaccagaaggacaaagctatgattttagagggttggaactttcagtggtccccctgccacctccagagagggaaggtgtggagattgagctcagtcaccagtggttaataatgtaatcagttggccaggtgcagtggctcacacctataatcccagcactttgggaggcccgggccggtggatcacctgaggtcaggagtttgagaccagcctggccaatatggtaaaaccccgtttctaccaaaaatacaaaaattagctaggtgtggtggcgtgcgcctctagtcccagctactcaggaggctgaggtagaagaaccacttgaacccgagaggcggaggttgcagtgagccgagatcatgccactgcactccagcctgagttacagagtgatactcagtctcaaaataa

SEQ ID NO: 27758 - DNA, 1774 bp, Homo sapiens
ggagaccccgtctctacaaaataaaaaaattagctgggcatggtagcacatgcttgtggtcccagctacttggggagctaagatggtaggatcacttgagtccaggaggttgaggttgcagtgagctgtgatcatgccactgcactccatcctgggcaacagtgagaccctgtttcaaagaaaaaacaatacaaaaaaatttacaccccgcttaggtattgttttcctatatctgtaaagtgaggggcatagcataggttgttgccaaagtcccttccctaaattccatgattcattcaaatgtccaaatttgctcatgaaagtgaaagtgaagtatctgtgatactttacaaattgaaagatgtgtacatgtttcagttcacctgatgtttaatagtaacaagaaggttgggtggacaatttattttattttttggtaaactcccctttggtgttttaatgtatcacatactcttttaagagtatgccttttgaggataaagcatatttggaatgtgagcatcattaaaaacaatcatttggtccctttttgttttttgtcttttaaacagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaaggtgcgtggttgatgtgagagagttactgttgtcatagaagccctggttctatgagcgttttggcttttggatatgcagcgacctctcagcctgacaaggctgttccagtgaagtcaaggccatcagtagtctgtatgcagtggacctttttagatttctgataggcttgttgcagggatgtttccatttaattcacaagttgcaaagatgaaaccttgctgttccagagctggttttccagttgaacccatcaggtctcttctctgactttttaatggtagttgtatttgagtgtgggcagaaagaaatggtactaagataggcagttttgtgtcttagcaagtctgaaaatgtatatgagagattaaaattatagcctaaagtatttggggttagacaccagctttagttacttacccctgtgctgtaacatagacataatttgactgttagagagaaatgtttctataaacattgtatgtgtctgttgaatataacactgtgccaggatagagacaactgacattcactgagcatctgccctgtgctaagtgtcttctacatgtttaaaacaaatttggaaagtaactcattcctgttgtaataagataaaatggatttgtaaatagtttcttgaaaaactttgtagcagaaggatcctaaaatatttctagtttataacatggcaggtcaaatggaaaacttgttgaacagaacctattattactcattaatggtaggtaaaatttcactgataacttgtatttactgcacagctgtattttaatgaatgtgaaataatttgttaggccttttgatgattagttgattcaataaaatgttgagctagacagtagaatttaggtgaacaaggcatatactcttagtattgagtagggagatagataagcaagctggtaataagtacctcagttggagtaagcagaagatactatccaatcactctggggatacctaacccagttgtggggaaagatggataagcttagagaaggctttggtg

SEQ ID NO: 27759 - DNA, 1030 bp, Homo sapiens
tttggttttttaatttttgagacacagcctggaatgcagtggtgtgatcatgaatcactgcagcctcgacctcctgggctcaagcgatcctcctgcctcagcctcttgagtagctgggactagaggcttgtgccaccatgcctggctaattttattatttatagagatggggtctcactctgttgaccaagctggtcttgaactcctggacttaaacgatcctcccaccttggcttcccaaagtgctgggattacaggtgtgagctactgcacctggccttgcttccctgtgttctgtgagcctctccaacaaattaattgagcccaaagagggttgtggaaaccccaacttaaagccagttgtcaaaagttctagaggctccacttttgactggtgtctgaagtgagggcagtcttggggactgagccctcagactgtgggatctgatgccatctccaagtagatagtgttggaattgaattggaggacacctagctggtgtccactgcagaactgattgtttgcctgctggtggggggaaatcccctctcattttggggtcacacaagtctgttgtgtgttgatgactgttgtggtggtgtgaaagcagagggaaacatggtttgagaattttttcctgaacaatgggactgtcagtcaaggtggaccaccctttcttggccccacatcaggtgaatcagcctctcctgggaattactttgaatggtccagtgcaaggactgaagaggttggagctgacattcctgtggctttgcttggaagacattgtccgcttggctcctctagcacccctcaggggctatttttttttttttggaggcacgttgtataatctttcctttgaggtccccaagtctccccaggagactaaccctctacctttttttctctcaagctagctagagttctttctgttgtttgcacctaaaatactctgactgatttacttctcactttgtaaacgtggaaatggtagcatcaaaagtgacttgttcaggctgggtgtgg

SEQ ID NO: 27760 - DNA, 1774 bp, Homo sapiens
acctcccttcttccaggagttctggtttctgttatgccagcctcttcctttcctgttcggaggtgtcctgtcagttcccagaaccttttgtttcagaaaacacagcccctcttttcacatctggtctcagacttacctctgatttcaggtctgctaatctgtcacatgtgtgacactgaccgggtacccacaatgaaagatgatgtgtctcctgctccacccccaataccccaatactccactcctgatatctgggctgcccccatcaaagcttcatggagaaagaaggaattggccaagggtcctgcagtatccaggcctagccctggttggattttttccaggaaagagatgggaagatgaggcctgtggttggtggaaagtggctgtttatggagcagtggactgaactttggaaagaggagccctgggtctgctgctgactcactgtgttccccgcagggacagaaatacctacttcagatggctgtcttgacgctcgaatgatagaacattagtgaggagtttttatgctgagtttttttttttttttttttttttttgagatggagtcttgctctgtcgcccaggctggagtgcagtggcgcgatctcggctcactgcaagctccgcctcccaggttcacgccattctcctgcctcagcctcccgagtagctgggactacaggcgcccgccaccgtgtccggctaattttttatatttttagtagagatggggtttcaccgtggtttcgatctcctgacctcgtgatctgcctgctttggcctcccaaagtgctgggattacaggcatgagccactgtgcccggcctttatgctgagttttaagggctgtatgagacaccaggtggtgggagggagctgttttgagagcagggaatttaggatacttaggaaattagaaaattagagaagtcataggatcttggaactaagggagaaccttagagtcctgtggagcagaacccagcatttgtatgtggagaaacggaggcccagagaagttgtgacttatccgggtcactctgcaggtctgggtgtcccacccgagtccatgtcagggctctttctgcacaccaagccccatgcccacctctgtgtgactggctgtggtgggaggggcctcctaggctagaggtgctgggatcccttttcagtccagaaataatgagcttagagggtctggaagtagcatggactaaaacccaggaaggatccacagggactgttgatgccagtgaggactccaggaagccggatcacggggactgttgatgccagtgaggactccaggaagctgctgttgggacagccctgctttgggagtctgaggttccaggaaaccccaggaatccggattctcatccctgagacctactcaggactagcccaggggaccgagctaggaaacctgcttgaggtggtagaggcagccaggggtgtgcagtggtccgggcgggcttcgatcagttccaggttggttgcttctccaaactggctccaagacaggcatgtggctcaagttggtctggactcaatcccgggactttaggacttttgctagaaatctggtgtggtgcaggagcgactccaggattcactctgtgggctgcttggactcagactcccccaggactagaggctgcttctccctggtgggaggagttacaaccttgcaagggttctaaagacccccgggtgctgggtggtgggcttttcctgacaacttccataagttattggaacctaaatt

SEQ ID NO: 27761 - DNA, 1061 bp, Homo sapiens
cctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaagaattttgagcctttattttatagataatcctctgccaacaatgtatgccatgaatagggggttatagttgtgctgatgaagcattcacggggtactctgcagtggaacggctgtctgtggtccttaggcttgaaagaatgggtaaagtgaagagggaactctttcgtttttttttgagacagagtctcgctccgtcacccaggctggagtgcagtgatgcaatctcagctcaatgcaaccttcgcctcctgggttcaagcgatcctcctgcctcagcctcctgagtagttgagatcacacccagctaatttttttttggtatttttagtagagacggggttttaccatgttagccaggctgatcttgaactcctgacctcaagtgatctgcctgggattataggcgtgagccactgtgcccggctgtttgcagtatttttaaaagtgcactaagtggggactcacattaagttctaaagatacaatgtcaagtaaaacccttaagtcacactcaatggcccatgatcagtgaggcatgaggggctgaaaactgctcactctggcttagatgctcatcagtgt

SEQ ID NO: 27762 - DNA, 1050 bp, Homo sapiens
tgagatatgataaggaagatacagacacagagttggccaaagccctgacacccacccagtcacagccacaccagaagcccaagtcccagagaggcagacaggcagctctatgaacccacatcccctacactgctcctcttgggtgctctgctcctgcgtgggagttctccttggctaggtcctgcactagtctagggtgtcagttcccggctaggcagagggcacctccatctctgcctagaaggcctggcactcatcacagtgtgggggtggccagggcgtgcttctgtggcagccacacccctgacagccatctgtctagacctcctttttgcaaaggcatcacaggtgaaacctgctacattggggtgatgggcacctttctgccaagctgccctccaaagctggactctatgcccaccctcaacatccttgacagtcttgccaaccttctgcccaacattatctcttgtccgtcctctcaagggcctctgtactcaggccataattgaccactccctgaatacccactgcagctcctacttctgctcatctgtccagacagctgcatttgtctggaacagaacacatgcccttctccttgttcatcttctcagcccagctcaagagacccccttctggccaggcacggtggcacacacctgtaattccagcactttgggaggccgaggcaggcggatcacttgaggtcaggagtttgagaccagcctggccaacatggtcaaaccctgtctctactaaaaatacaaaaaattagctgggcatggtggctcatgcgtatagtcccagctactctggaggctgaggcaggagaatcgcttgaacccaggaggtggaggttgcagtgagctgagatcacaccactgtactccagcctggatgacagagtaagactccgtctcagaaaaaaaaaaaaaaaaaaaattaataaaataaaaaagagacccccttcctggccagctcctctggcagaggcaatgcccacactcttagtacagacccctagtgcagcatccatcactggctttg

SEQ ID NO: 27763 - DNA, 1049 bp, Homo sapiens
tgtcaaatccaaaatgttagatagtatttataagtgttgaatcaccgagagtgatgactgagagaggaagatggagaaccagcagctaacatctttagggagtctttagggagtgaggagtggcctggaggttggtaggtgtcagcagaaaggcagggtagtgggaagtatcatgtgagctatttttcaaagggacgcttctttatgttgtaatttttgtgtccctgtgtgattaaatgtgttctcccacaagtcagaaaggtgcaggtaggcagggaccgtgtctttcttgagtactctggcttcataaatacttgttgcatgagtgagagaatgcggtgacagagtgctaagccctagtgtgttgagtccacacgtggatcggggtccatgcagtgaccgcccctcttggttggtgggatgaggggactcacggaactcccacctgtttcctcccgtagccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgaggcccacagctgtatcaccccagagtccttgccctccctgggttcagccagggaagaagacgactgtgccagggtggggaccttccaggtgtggagctgaccgcgggcctggaggggttcctccctctcactcggtttcctccgtttcccagtgctgccaccccttgtggtgagtgttctgcagattttctccctggctgggaaggtcactgttggctaccctcaaggcatcctcctgatggatgctctggcaggaaaaattcaacacccatgtcctacttagtctcttaagggccagcttgccttggcccttcgggggtcacaggcctaccctggacccatcatggctgctggatgatggcagctctgattggttcagcctgggtcatgtgt

SEQ ID NO: 27764 - DNA, 1050 bp, Homo sapiens
aagtggaggtgctgtggaggcagttggatcacatcgagtctcaagttcaggggagtagtttgggctggatataaatacgtgggagtcatccccgtagagaaggtatgtaaagccataagactggatgagcttaattggtaaacataagagaactgggagatgatggagccctgagggcccccaaaccctaaagtctgttagctaaagaggaaccaggaaggtaggtggaaaagcacaggacagtcacagaagccaagtaaagaaagggtttcaggaaggagggcaagtcattcatgcaatctgtgctgctggtagaaacatggtcttaggtaattttgcatcaggtatggagatcaggctggtctttggacggaagagcagttttagtggagtatggaagtccttaaggaggagaggggatatggaatcaggccccatggagcagggatagtgtagtgaccagccccatagggtcggtgggtctctccctgtgtgcggcgacgagagagtgtagaaataaagatacaagacaaagagacaagagaaaaggcagctgggcccgggggaccactaccatcaatgcgcggagaccggtagtggccccgaatgttgggctgcgctgttatttattgcatataaggcagaaggggcagggtaaagaatgtgagtcacctccaaggataggtaaggtcatgtgggtcacgtgtccactggacagggggcccttccctgcctggcagccgaggcagggagggagaggagacagagagaaagacagcttacgcaattatttctgcatatcagggactattagtatttttactaatttactactgctatctagaaggcatagccaggtgtacaggatggaacatgaaggcagactaggagtgtgaccactgaagcacagcatcacagggagatggttaggcctctggataactgtgggcgagcctggctgatgtcaggccctctacaagaggtggaggagcagagtcttttctaaactcccctggggaaagggagacacccccccccctcccgccgccg

SEQ ID NO: 27765 - DNA, 1039 bp, Homo sapiens
cctgaggagggcctctccagtgattgtgatccagagccaggcaggggcgttcctgtcttccaacaacacctgccagcagttcagggatcctgggtttagggggaggtacccagcagcgcctcacaccctctctctccccccagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtctaccctgagaccacatctgcattgcactcctagagggggtggcccctaataatgttctggaacactacacacaggtgtgggtttccagagcgagcaccgcggccacagaacacaagtctgtgcgccagagcccggggatggtgcgggcagccccaccagcaccctccccactcccaagcaagcggctggaggcacagggccaggcaggcctgagcaatctttattctgcagagggacaatgaccacagatccatacaccacgtggagaccgaggggcggggagccaggggccagtctttcaggggtgggcaggtccaggcggtgggcagagcctcgggtgggtgaggggcagatgggcagacaggcaggggcctaaaaaaaagatgaaccacacagcaggggtgctgggagctgctccccaccctcccccatcccaccagccagcacccagagggacaac

SEQ ID NO: 27766 - DNA, 1092 bp, Homo sapiens
aggcccagagctggcagaggcagagggggactgttgatgggaaatgtctctgtgggctgtttccctagtgtttgccaggccctcctcaccacctctgggtatttctgggtccctgcagttttctgctctgctactggggcctggcccatgccttgtggatagcagagccagccccttcctgaagtcccctgaggattatttttggttcaaaggatggagtcaggagtctctagggtaggcctggtccctgactcatctctctctctctttcccctgccctgccccagggagcaccccatcttcttcatgtttatccagatcgctgtcatcgccatctttaagtcctacccgacagtgggggacgtggcgctctacatggccttcttccccgtgtggaaccatctctacagatgtgagtactcccgcctctgccacagatttgtgtcagcctgggcctggatgagactgctgcagggaaaaggaattcataggcatttaccaggcacctgttatgctggcagcactaggaggggagcagaggcatgaagcacaatatctgcttccaggtgccgcggacttgtgatgataaaaataattgccatttattgagcacttactgtgtacctggccactgtggctctcacagtgttacatgcattaattagctcatttgatcttcacaccagcctttgaggtaagtatccacgttttgcagatgagaaaactgaggtacagaaaggtagagccactcattcaaagtcacgtgacttctaattagaagagccgggattggaatccagatctgtgaacccctacccagtgctgtccagcagggctttatgatgatgaaaaagtcctctgtctgcacagttcaatagggtaactagccacttgtgtgcctgagaacctgaatttttaatttaaatttcagaagccacatgtagctaggctaccatactagacagcagaactctatgccctgggctttgaaccattccccagcgctgcacccaaaggttactagaaggcagaggggcaaagttagacttccctgcccactgtgacaacccctctaagctctaaccatcccct

SEQ ID NO: 27767 - DNA, 1045 bp, Homo sapiens
ctagtgtttataaacaacaagccatcaggggattgctggagtttcttttttaggaattttagatgtgcctcactgtgtaactggaatagtcctgcaagattaagtgcaagttcagtttttataaatagatgcagtacatacttcaaattactttatcgttttagggccctgttccccaagcaaaccttgactccaaaaccatgtcttcaaaacagaattatacttaaaatttattgcacatcttgtaaccacaagtttgccaagaaaaaaaatcattttccagtctaacactgagagcactttaggtcgaataaaacactgagaaaaatggtagcaaacagaaacttgggggccactaatgggatttgcaaagagtgaaacctcatttcctgagtgtgtgttcaggacttgcctaagagaactgctttttttttttttcttttttgagacagagtttcgttctttttgcccaggctggagtgcaatggcaccatctcggctcactgcaacctccacctcctgggttcaagcaattttcctgccttagcctcccgaatagctgggattacaggcatgtgccaccacgtctggctaattttgtatttttagtagagacggggtttctccatgtttgtcaggctggtctcgaactcccaacctcaggtgatctacctgcctcagcctcccaaagtgctgggattataggtgtgagccaccgtgcccggccaataactgcttttaacagcctacttgattcagtttttcatggccttgttgttttattccctggcatacttctttttaaatatcagtagggtggaatgggaagacaaaacaatatttttactttagagggtattttttttttctctcctgggctgttttcttcctcttttttttcttcctcccttctttgctaaatggcagtctttttcaggaggaagatcaagatgatcaaggaattaactcagaacctaaatactttcttcattgaatttatctatggatgccttctctttgttgaattcttttcttctcttttctc

SEQ ID NO: 27768 - DNA, 1049 bp, Homo sapiens
cttctctctttctctgcctcccttctactttctgtcaactagggttgttctagctggtgagtttccttggtttgaagaataaagcacacaaagttcttttctctccactctctcgtctgtgacattgtcacatttataaccgtctgtcctccaaggtagtttttagatgtttcaagtatacagaccactttggtggtgaaagatctcatcaataatctcttcctgtttgtctctagagctggattagcagaggggtaaaactccttggactggagtgactagttcctccttttatgaaacaccattgagaggatgtgttatttttatttttttatttgaaacagggtcttactctgtcacccaggctggagtgcagtggttcagtcttagctcactgcagcctcaacctctagggcttaagtgatcctcccacctcagcctcctaagtagctgggaccacaggtgtgtaacaccacacccagcttatttttttatttttatttttgtagagatggggttttactatgttgcccaagctagtctgtaactcctgggttcaaacagtcctcccacctttgcctttcaaagtgctgggattacatttgtgaaccaccatgccccgcctgttattttcagtaaatagttgaccccacactaatgagagtgagcatgggtattgtcattttaaaaaacatcattacaagacacctgttgggctttatatcttggaccatcagttgcatcctactgatttctgggccacttggaaactcctgttgtaaactagggctctctatccttagttttagagtatcctgttgtcttaagccatctgaaagggaatagctattttttcaaagaaattagcttttttctaatgacaaaaacaaagcatgttcattttagaaagtttaaaaaatgcagtgaagcaaaaatgaaaaattgttcataattccactacccagagataaccactataaactttgtggccttaggttttagtcttctatttatttattttattttttttggtagtccgagactgggca

SEQ ID NO: 27769 - DNA, 1046 bp, Homo sapiens
aaggggcttctgtgcttttactttgaaaatatgagaaattggccaggcacggtggctcatgcctgtaatctcagcatgttgagaggccgaggctggtggatcacttgagcccaggagtttgagaccatgccgggcaatgaggcgaaaccctgtctctacaaaaaaaatatgtaaaaattagctgggcatggtggcatgcacctgtggtcccagctactcagaaggctgaggtgggaggattgcttgagcccaggaggcggaggttgtggtgaaccgagatcctgccattgcactacagcctgggcaacagagcaaggctctgtctcaggagaaaaagaaaaggaaatttgagaaatgaacactaaagttaaaagtagaagttaagatatagttttaagctttatcagataagcatccaaaataaattcttaaacacaaatgcataatttactgctttgctaagcagggagggaaatatacaaaattcagtttccacaagagagtaaaacatgttgttgcagagtttatctaggattttagactgagatgtcaagatgtgactgtggcatatccatgccataatctttatcttccaggatggttcccttctagagggcattacatattttattccattccttaagggcctaagttctctgtgtcctttgaagcctgattctgatgtttctccctttaatgtaccttcagatttctcaacctagaattgctaactcttgctttggacttttgtagtattttatactttgtgactccttcatatgacatcagagtgcactcaagtgcactacatgtatatatcttatctttaatactagactgagttcctgatgtgcaagaggatatagtttggtctctcagggtacctggcacagtgccttgcccctagtaagttctttgcaactatttgttagataagtaaataacatatcaaatttatttatttattatgtatgaattgaatgcctgctttatgcccatcacttttgctaagtgctatagaaaagtacaaaattatgtgaccattt

SEQ ID NO: 27770 - DNA, 1023 bp, Homo sapiens
aacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtccct

SEQ ID NO: 27771 - DNA, 1045 bp, Homo sapiens
atgatcatgccactgcactccagcctgggaccctgtctcaaaaaaaaaaaaaaaaaccatgaaatgtgaagtgcctctttattcttgtcaatgtcaagattctagttggcatcagaacaggataagattaaatggagagatgatttcactctaatcctgcttgcctgcctttcctgcagcgtttcttcctggggcttctcaaagcagggaactaccagggtttaaaacaagatgatcttttttatagaagtttcattaatgagtctttaaaatataaagaagatataaagaataaaagagacacccatgtatctaccacataggttaataatttataataaataggaccaatattggaagccccctttgttgtatcctctctgattataaaataatactatcctttaaatgttgaaaaattatgtcaaagatggaaaagctcctaaaattaattcattcaaacctagatattatagaaccaaggccagctgccacaatatctctatacctggttatcttggcctgagcaatgacttgtaactttattcccctatgacacggttgaagatacacaacccttcacacttaggccactctcccctgtgtgtacagagggtatgttttgtttcttcctcactagttatttcaacttctttttggcatgaaaatgagagcgacattattttaggagtaacctttaatctacccctaatttatgtattttaaaattgaatccaaacaaaaagctaaatccatcatgatatcaatactttgtgttatttattacaaattatttgggcatatcacacttcccgtcagtgagatgcagcagcatagctgagactgggaggtcatcagtctttggggagtatgtccagaaggcattgagagcaggaacatgcctgcttgcctcagacacatctgaactcttcttataagaatcccaggggtctttgtatacatttattgccttctttctgcaaactgggggcctgcaggctgaatttggcctataatggttttgagttgctatgcagtgtcttaa

SEQ ID NO: 27772 - DNA, 1014 bp, Homo sapiens
gcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaagtaggttgtgatggttttgcctcaaattttattcatttgttttctgtgtggataacttttttgatggaaaattttacagaatataaaactagaatagtataatgaaatccccctgcttcaataattatcaactcatagtctgtcttgccttcatctgtactctcttccattacccttttgagtatttcaaagcaaattcgctgggtaaatatttcagtgtgtgtctctaaaagataaggacactttttaatatgcccgcacaatattgttagcacacctagaaaactaatacttccttagtactctcatatccagtgttcaaacttccctgattatctcaaatttttttcttacaatttgttcaaataaggatccaaacaagattcatatgttgcaattggctggtatatctcttaattttacagtgtcggggggttttggcaatcagagcctgaaaagtaaccagtgctaccatatggcaactccacaaagcactgactttaggcttatgatggctattggggaaccagagaggccaaatgtgttttggaaattaaaactactgctgtctctcaaatagaaatggtttttttgcacaggtgcctttcctttaaaggctctttatcatccctagaagcttaaaaccccacgctaagatgattggaccttttaaat

SEQ ID NO: 27773 - DNA, 1031 bp, Homo sapiens
tgagcattgtgtcgtagacttgatagacaacaggagtatacagataagtaataagtcttggtctctccccttaatttcaagcccataaataattattctttcagggcagtaacttttgtcaatatatcaaaagtaggtaaaatgtcacaggaactcagaaacatctaagaggagatggaacttgagttagagcaggaatcagcagtattttttttctctgaaggggcagatagtaaatattcttggcttttcaggttatatagtctcttgttggagctactcaactttgttatgatagcacagaaagtagccatagacaatacataaacaaacaagcatggtagcattccaaacacttgtttatttacagaccagcagagggccatagtttgctgacccctgagttagagcttgctcaggtagtaaaaggcaaaaaggcatttctggcaaatgaaaaccacagacacaaaggcatggaggcatgtttggacaactgcaactttttaaatctctacgtggtacatgttaagctttgtttatgctgagtgtctgaattctggtttacagtgtgatatttttcaaacttcatcagttcacgtttactaccaacagtgtactgcaaaaagaagaaattttggagaggaaataagatacaggggaatggctaaaaagtatttgcaaagcagtaatgtataagctcaaacttcatgtttctggttgcttaaggaccacatgactaatcctcttaccctttctcattgaagcagtttggactgagatagtgcaactagtttctgaattcccatccctcctggagttaatttagtaatgtgactccaactttaattgtaaatcactaaggaatgagacaaaaatctgacttttacaaaaaaagttcacactatttctggcagggtaacagaagggtagtgcaaactgcttgaatttctctatctgctaatgcaaaactgcattcctgagttatatgaattcatgtttgttttttttttattttgttttgttttttgaga

SEQ ID NO: 27774 - DNA, 1049 bp, Homo sapiens
taaggtagtggtgagctatatgactgtgccactgcactgcagcctgggtgacaaagtgagaccccatctcagaaaacaaaaacctataaaagtattggtcctgtcattaggtgtctcagaaagtagatttgtagcaacctatctcctcttcattgcatgatttttttcctgctggaaatatgtttatattgcagttattgaatggaattggtattttgttcacaagtgttagtgtccccacaccagtataggttctttcttctttaaacctacttatatttagtgtctaccttctgatcataaattaccaaaaggaagtctaggattttgagagtttttgagaacattttcttccattacacacacacacaccccacacacacacacaattggtaagatggttgaaaataaatattcagagttccaggatctctgttgatactaagcatcattcatggtcaccctgcttccctattacaagtaagaattggttatatctccttgtgcttcatgaaacctgcttagatgggttgaagaaagacccatctacattgaacccaccatttttctggtggtaaactaaccataattcttcaaaagcacagaaaactaaagcacttatatagctgtctataaacaaaatttgcattttattctaatgatttcctttttatcacttgactcattttcaggggaaggtgctattaacctggctttggctcagaaccgaagccaagatgtgagaatgaatggacccatgggagctggaaattcagttaggatggaggcgggatttcctatggcaagtggtccaggtaagacctcccactcaattgtatgacattttactagtttccttttttggcttatttgatcatttgagccctgcaagataggtgggggttcatggcatacttaacatctctatttgctgaatcaggaaagctagacatgagtccttcccggaggctagaggtcacagcatgaagcatctttgcaatcttttggtctcgtgcttaaaggttgatgaacactgagccatgcagcaa

SEQ ID NO: 27775 - DNA, 1055 bp, Homo sapiens
gttattgtcagtatgagatttgataaatgtgaggttttccaggaagtaatttgtcatatagaaaaatgcttataattctttataaggttataagatgaccattatatttaataaatagctaatgagcatctgccacgtaccaggcactattttatgtataaatgatgtattatagatagtcatataatttatcatctaaattaggacactttttttttttttttgagacaaagtctcactgtgttgcctaggttggagggcagtggtacaaacacaactcactgtagccccggcctcctgggcttaagcaatcctcccatctcagcctcctgagtagctaggaccacaggtgcgtgccaccacggacctgactaattttttatagagacggggtctcaccatgtcgctagtcttgaactcctggtctgaagcaatcctcccaccttggcctcccaaagtgctgggattaacaaatgtgagtcaccatgcctagcctaaattaggacatttctgaaagtgaaagagaatgctattaattatgctggaacaacagatgtgaaggaacaaggacagacttgtaattaaccctgtatagtgatgggggaggcaagcaagaaaacgagtgagtgaatgattacatggaatgtgctctgcagaaataacaagatgttctgataaaagttacctaaccttggataagatggttggtagaggcctttttgggcatgtgacacttaagattacatgaaaattgagaagctagctatgcgaagagtgcagagaactgttctaggcagaggaaaccgcatgagcaaaggccttggggtgagaagcagccttgtgtgcctaagaaactaaaaggaaacactggggctgaatccttgctattgaaggagaaaaatagcatgagatgagtttaaagaggtagacagggctaaatatgggcagtccaatattggtagccacagactgtatgttgcttttaggcactgaaaatgtggctagttaaaactgacgtgcgctgtaagtataaaatacatattacattttgaaga

SEQ ID NO: 27776 - DNA, 1050 bp, Homo sapiens
ttcgcttagcgtaagatgctcaaagcccattcatgtggcaggatatccttcctttttaaggcttaataatattccattgtggctgggcgcagtggctcacgcctgtaatcccagcacttcgggaggccgaggcgggcgatcatgaggtcaggagatcaagaccatcctggccaacatggtgaaaccctgtgtctactaaaaatacaaaaattagctgggcgtggtggcatgcacctgtagtcccagctcaggatgctgaggcaggagaattgctcgaacctgggaggcggaggttgcagtgagccaagatcatgccattgcactccagcctggtgacagagcaagattccgtctcaaataataatataataatattccattgtatgtatataccatattttactgattcattcatctgtcagtagacattgggttgcttccatatcttagctattgtgggtaatgctgctatgaatatggtgtacaaatatctctttgagactctgctttcagttcatttgagtgtgtactccgaggtagaattgctgcatcatgtggtaattctatttttaattttttttgagaaactgtcgttttccgcagcagcttgtatccttttacattcccactgacagtgcgcaagggttccagtttcttttttttttttgagacggagtcttgttctgtcacccaggctggagtgcagtagtgcattctgggctcacagcaacctccgcctcctgggttcaagcgattctctggcctcagcctcctgagtagctgggactacaggtgtgcaccaccatgcctggctaatttttgtatttttagtagagacggggttttgccatgttggccaggctgatctcgaactcctgtcctcaagtgatccaccagcctcagcctcccaaagtgctgggattattgggattataggtgtgagccaccgtgccccgcaggttctatttctccgtatcttcaccattgtttattttctgtggttttgatagtagccatggtaatggtggtgaggtggtatcttatcattat

SEQ ID NO: 27777 - DNA, 1034 bp, Homo sapiens
caggcttccacgtaacctatagtatatacttttttgtaagttgtaacttgaaattttcagatgctttgaacttgacacataatctagcaattcattggcacaccaaggcaaaacatcaacctgctaaagagatttatttatttatttatttatttttgagacggagtttcactcttgttacccaggctggaatgcaatggcgctatgttcaccgcaacctcggcctcccaggttcaagtgattctcctgccttagcctcccagtagctgggattacaggcatgtgccaccatgcccggctaattttgtatttttagtagagacggggtttctccatgttggtcaggctggtcttgaactcctgacctcaggtgatccgcctgcttcggcctctcaaagtgctggaattacaggctgtttacttaatcttcaactttaaaacctatatgtccttcagttaagcctaaatatgaggtaggaggtggaaattgactccagaggcagggcttgaacaccagaccaaattgaggactgctaaaacagggatggggcaggagcagctttccataagacacatccaccagtgtgccatgtcagtttaccattaccatgacaacacccaagacttaccacccctctccgtggcaatgacctgactacccaaaagttaccatacttctgctagcaatttctgcataaaccacctgttaatctacatgcttaaaagtaggtataggccaggcacgatggctcacgcctgtaatcccaacactttgggaggccgaggcgggtggatcacctgaggtcaggagttcaagaccagcctgggcaacacggtgaaaccccatctctactaaaatgtgtcactgcactccagcctgggcgagacagagctagactccatctcaaaaaaattaaaataaatgaaatacataaaagtagatataaatataactgctggccaggtacagtaggaggccaaggtgggcggattgcttgagctcaggagttcgagaccagcctgggcaacacggt

SEQ ID NO: 27778 - DNA, 1034 bp, Homo sapiens
ttgttgtttttttgacttacaatgttttttgctttgcagaattgatttttttttgcatttgaacttatcaatcttttctcttatggctttattattattttttttagagacaggatctagctttcttgcccagactggattgcagtggcatgatcatagctcactgtaacctcaaactcttgacctcaagtgatcctcctgctttagtcacctgaatagctgggaccaccggcatgcaccaccatgcaagttccatgcataagttttatatctacagtaaatatttcaagacttaaactgaaaatttaatgaaaaatataatgtatagatattatggataaaataggaaaaaaacttacacctaaaactttgtcaagtttaaaaagctaaatttgaaatcctgttagaaaagcgggtcttgtattttgtatgtgtacaaaatattttgttttgggctctaagcatatgcagatagtgtgacctgatgttaattaatctggacagaattaagaatgaaggtatagagagggctctaaggcttaaagtgacagttttatgattcttaagtgatgcttgtataagtctgtgagttttgcttctacaatctttgaatgcttgctgatgagtggcctaaaatctcaaaaaaggctgggggcagtggctcatgcttgtaatctcagcactttgggaggctcaggcgggtggatcgcttgagcccagaagttcaagactagcctgggcaacatggtgaaaccccatctctaccaaaaaaaatacaaaaaaattatccagatgtggtggcatgcgcctgtggtcccagctacttgggagcctgaggtgggaggattgcttgagcctaggaggttgagctgcagtgagctatgatctgttactgcactccagcctgggtgacagagtgagaccctgtctcaaaaaaaaaaaaaaaaaaaaatcagaaaagataatctttgtagacttaatgaaaaccctgttttaacattctctaaagatgccaatgctgacttgataacttg

SEQ ID NO: 27779 - DNA, 1028 bp, Homo sapiens
tattggccttgtagaatgagtttggaactattctcttcactattttttggaataggtcgagtaggattggaattagttcttccttaaatgtttggtagaattcagcagtgaagccattggatcccaggcttcttttttattgtggcttttacttatggctttgatcttgttttttgttttgttttgttttgtttttgagatggagtctctgtcgccgaggctggagtgcattgatgcaatctcggctcattgcaacctccacctcctgggttcaagtgattctcctgcctcagcctcccgagtagataggactgtaggcacgtgccaccatgcctggctaatttttgtatttttagtagagacagggtttcacctgatcttgttacttgttactggtctgttcaggttttggattttttcatggttaatcttggtagattgtatgtgtctaagaatttgtttcttctaggttttccaatttattggcatatagttgcttatagtagcctctaacgatcctttgaatttctgaagtatcagttgtaatgtctcctttttcatctctgattttatttatttgggtcttctctctttttttgttagtctggttaaaggttgtcaattttgtttatcttttcaaaaaggcagcttttcatttcactgatcttgtgtattctttcaatttcatttatttctgctctcatctttatttcttttcttctactaattttgagtttggtttgctcttgcttttctaattctttaagatacattgttaggttgtttatttgaaatttttctacttttttaatgtaaatgcctatagccataaacttccctcttagtcctgctttcactgtatctcacaggttttggtatgttgtgttttcattataatttatttcaagaaattttccaatttcctccttaatttcctcatggacccactggtcattgaggagcatagtgtttaatttccatgtgtttgtatagtttccaaaatttcacttgttattgatttttagttt

SEQ ID NO: 27780 - DNA, 1027 bp, Homo sapiens
atggcactgcggaattttgaaatggtagataattgattcaagctttgagtaactgagtcaagttttagagacattctaatatgatcaggtgatcatggataagtaaacaccctgtagaaaaacagatggtcaatgacaacacacccagcctccctcattttcctatgccagtaacttttgccagcacaataaagaaatctctcttctgtaaaacaacaaactttgagggttttgttagccctctcttcttggtgagtcatctgtgggcattgagagatacatcagcttttcagggtctccattcaaaagcctccccatggatatttcagtgttaatagtcatgtcacacttcatttgatttcaaaccattcttcaaaattacctcttttccatcctattctttacctcttggtttttctttgaaacttcttcagtttttccataatttaaaaaaatattggaaagaattgaggaaaactgagtattgttttaaaataacaaatagaattgaggaagactgggtactgtccaggctaatgatatgctctttttctgtgtctttttatttttaaattattatttaaaaaaaaaatagagtctcgctttgtcacccaggctggagtgcagtggtgtgatcatggctcactgctgcctcaacctcccaggctcaagcgatcctcttacctcagtctcctgagtgaacacgtgggactacaggtgttcaccacctcacctggctttttttttttttggggtagagaatgggtcttcctatgttgcccaggccagtctcaacctcctgggtttaagcgatactcttgcctcccaaaatgctgggattacaggcgtgtgccactgtgctcagcctgtgtctttttaatggtagcaatgttggccttgcccaggatagtactgtatttaaattgtgaatactcatttgaattgtggtcagtaatagccctcaggtgctttctttatttgtgcccaggcagttcttcctgattttatatttgcattgtttatactt

SEQ ID NO: 27781 - DNA, 1067 bp, Homo sapiens
ttgacctgtataagtattttgtttggtttacacaatatttttaatgtcttaaaaatgtacacagacctctgagtttctgacttaaccttgaaaaattggaagatctgtcaacagcaagcccatattcatttatagcggtaaccagctgaaacttttaggtgagatgtgtttcctagttctccatagtctgccttgctgtcttgctttgctctttatttttatggccctgcagacatttaattttctgattcttactttattgaggtattgaatattgtctcccccaaaccagtaaatgacatattgggatggtgggggggatggccagaaattgacagatgagtttgtgggcaagtaaatactaaaacctatttctaaggatgagccatacttgatcataatgaatagaatgataaatgaaattaaaagatgaggtgaaattcagcttagctccttgaatatttaggcatctactatgtattaagtactgtattagaaattaccacattggtgatagaaaattagctggccagctttatgaaatactgtagaagaactctttttacttgtattgtggagctgttgtctaagagagtggttggacgagaaaggaaatataggtattattttctcaaacatttgttgagccctaccatgtattctggaaactggctagaactctgcaagataccaagatgaatctagccaaggtttctatgctgaggaatgtctgtaatgtgttatggagctgggatactagagaatggtacctgaaagaggtggtctgtgaacgaagctgccaagaatagttagtatcttaatacttggagatgagacagtgctgtattttccaggctgagtgaaagcataaacacagaggtgggtatttaggagatggtaaagagtccactttgcttggagaagaggattgttataagggtgttgttggaattaagggtggaaatggagatgaacaatagtaacaataatagataaaacctaaaataaataaaacttaaaaaaattaatagtagtagtggcttttctttccccccagtgttctttgg

SEQ ID NO: 27782 - DNA, 1067 bp, Homo sapiens
tgggctctgtagcttcagaagtttttaaggcagagtcacttcactttgggtatgcagccccatgagtgaagtagacatgtgaacaatcatagttcaggatggtcgatgccaaagaagagttattaaacgctataaggacacggagatgggtgtgtctgctcaaagaatcagggaaggtgttgcgaaggggtgacatttgagatgtgtcctaaaagatacaggaatttgccagtgaaatggagagaagggcctttcaggtaaagacacgttttcagggaatgtattaataactgaatgtggctggagcatagaatgtgtgtgaaagcatggccagagatgagactaggaagaccatgttaggaacctggttgtgaaggaccttgctaaggagtttggactgaatccttagctgagagaggcattcaagatcttcgagaaggggagtatgtggtggaggtttaatttctaggagataaatggatgttctttggaaggagggtagactgaagaccagagaggtaatgaggatctgaactaaggcagagactgtgggcactgagcagagttagaagtaatgaggatctgaactaaggcagagactgtgggcactgagcagagttagaagtaatgaggatctgaactaaggcagaggctgtgggcattgagtggagttagaatttgcaggtgttgattattgacattgtgagtggcttagggggagttttttaaatttctggtttggggtggtgtctgtcaaagaggtttaaaaaagtgaaaggaagtctgggcgtgttggctcacgcctgtaatcccagcactttgggaggccgaggcgggcggatcacgaggtcaggagatcgagaccatcctggctaacatggtgaaaccccatctctactaaaaatacaaaaaattagccgggcgtggtggcgggcgcctgtagtcgcagctactcgggaggctgaggcaggagaatggtgtgaacccgggaggcggagcttgcagtgagccgagatcgcaccactgcactccagcccaggcaacagagcgtgactccgtctcaaaaa

SEQ ID NO: 27783 - DNA, 1036 bp, Homo sapiens
gctatgactatgccactgtactccagcctgggtaacaggaaaaaaaaaaaaaaaaaaaaaaaaaggcaggggttggtgaaatccaatgtagacaggtgtctttctacactggttatgtcctggctcttaaaagagttttgcttaatttataaatcccccaactacggcagctaaaagaggcctttctgcatttgctgataggaagtcagggagatgggaggggtgcctgcttgggaaagcttgtccctcccctgggatacttggcctgtgtctctcccctgtgccagccatccctggcttggggctctgcggagttcagcccagcaccccccttccagtgacctggtctcctctctccctcgcctacccgccttgcccagcctgggctcttggtgggggttcccggaatggtgaaggggctacatgaagctcaccagctctatggcaggtaacaaccctccccctggggaccagggacccccgtttgcatctctccttgggtggccttctcctacttccctggattcttcctttcccaactccccctcctaatatccccttcccttgccaggactctccttcccaggaacccccctccccccggacccctcctcattcccccaggacctcctccaccccctgctctccggcccccccaggctgccatggtcccaagtcctggcctttgcagcagctgtggcccaagatggcttcaacgtgactcatgatctaggtcagtggggcctggggatttgggagagacatgaggttgatggagaagggtagaatctttgagatttggagcccaagccagagaggccctctcttccagtttgctcctcagaccccctccccaccttatcccaccctcacctggaggcggcctcaaacgagggggtctgggaagggcccttagacatccctgcctcgcacttaacaggctcctgggggtcagggcacttagggtgggccactcagcccccatctaccccatctattgcgcgtctcatccggtccagtcctggcgtcccgccct

SEQ ID NO: 27784 - DNA, 1059 bp, Homo sapiens
aaaaacgctgaggcctggcatgttggcgcacacctgtaatccctgcactttaggaagccaagaagggtggattgcttgagctcaggagttcaagaccagcctggggaatgtggcaaaaccccatctctttgaaaaaaaaaaaaaaaaaaaaaaaaagttaaccaggggtagtagtgcacacctgtaatcccagctactcaggagactgagatgggacaatcacctcaacccaggaggatgaggctgtagtgagctgcaatcacagcctgggtgacagagcgagaccctgcctccaaaaagaaaaaaaaaaaatcctgaaagataagaaaatcttgaaagtagtaagagaaaaatggctcatcatgcccaaggatattccaataagattagtggctgactgctcatcaggaataatggaaggcagaaggcagtagggtgacatattcagaatgctgaaagaaaacagtcaaccaagaatcttgtattttacaaaactatgtttcaaagatgaagttgaaataaaaacattcttagaaaagaaaaactgaaagaactcattagtaacagacaaacatctggaaattaagcagcataccgacttatgagaaataccaaaggaagttcttcaggttgaaagcaggtgacttcagacagtaatttgactccacatgaaaaacaaagagcaccttaagtaaaggtaattctgtaattgtaagagattgtgtaaatgcatatttcttctccttttcttcagttaaaaaacttacacaaaccatctaattatattgttgaacctataacatatggaaacatattttgcaataactgtacaaagaaaacgggtggtaccaaagttgtaatggagtatcatgacaccaaattgcaacttgaatccctaggaatcggtgaggagaaccaaaatggtaataagagggtaaatataaaaactccataaatgtatacttgctcttcattccttttctcagtttctctaacataaaattatttaaagtaacaattagaacaagtattgttgggcttttaacatacatagataca

SEQ ID NO: 27785 - DNA, 1026 bp, Homo sapiens
tcacagcaccacttattgaaaaaactactctttcatcattgaattgtcttggcaaccttgtcaaaaatcaactgatcatagacacgggtttatttttgtatttacagatcaagattgttttggctgttatgcatcccttatatttgcatgtgaatttcaggatcagcttgccaatttctgcaaagaagccagctgagattttgatagtgattgcattgaatttgtaggtcaatttagggagtattatcatcttaacaatattaaatcttctgatccatgaactacaagatagctttccatttttttagattgtctttaatttctttcaaaaatgttttgttgtacaagtcttgcacttgttaaacttatttctaagtgtttttactgtttttgatgctcctttaaatggaattgttttcataattccagttttttttgcttcttgctacaattttagaaatacagttgatttatgtatattgatcacatatcgtgaaatcttgctgaactcttgcttattggctctaatagtttttttgagtggattctttaggaattttctgtattctagattgtgacatctgtaaatagttagttttacttattcctttccaatttgggtgcctttaatttctttttttatttttctctagttgccttagaacactcagtacaatgttaaattgaagtggcgagagtggacatctttgtctttttcctcatcttaatgggaaagcatttagtcttcactgttaagcgtgatgctagctgtgggttttttaataaaagccctttatcaggctgaagaagttctcttctattccttgttgattgttttatcatgaaagtgttttgggtttttttttccaaacgctttttctgcatctgttgagatgaccgtgtggcttttggcttttgtcctttattctattgatatggtgtattatattgattttcatatgttgaaccaaccttacattcctgggataaattccactttgtcatagtgtcatggtgtataatcct

SEQ ID NO: 27786 - DNA, 1033 bp, Homo sapiens
tgaagtccccttttgcccctgtctccagctattcggtttctctccttagaaccactctgtcagcttcttggtggatgttcttattgagttaatttatggaaatacgtaaagcacgtctgtgtcttcagatagtggaatcacatgctgggtgctgagaaatcagacagattgcggcaacagcaaattctcatctcccatctcacactcactctaggcaggacataaacactccaaatcatttttctttttcattttttgctcaatgtgtataattaagtcctcataaatgtgcatgagatgcatctctactatgcagatgtacaggaaggctggccatgatccagcattgcccttccctctcagggtctgcatgtttcccaagaagcactggggcacctgccctgcatctccctgggcagtcagggttgggggtgagtagatccttctttggccatcggccttcccgttgggaccgtgtgtctttctctctctcaggtcggcaaccacattgatgtgctcactggcaagtgggtggcccaggacgcaggcatcggggctggcgtggactcctactttgagtacttggtgaaaggagccatcctgcttcaggataagaagctcatggccatgttcctaggtaaaaatggcagagtaagggagcttttcccctcatttttcttgctgatgtgtgatttgtttaaaaacttttttttgagacagagtcttgctccatctcccaggctggagtgcagtggcacaatctaggctcactgcaacctctgcctcccaggttcaagtgattctcatgcctcagcctcctgagtagctgggcatgtgatggtgtggactacaggcgcacaccatcacatccagctaatttttgtatttttagtagaaacggggtttcaccatgttggccaggctggtctcaaactccggacctcaggtgatctgcccgccttggcctcccaaagtgttgggatcacaggtgtgagccaccacgcctggcctgagtgcctgcagaatcagttct

SEQ ID NO: 27787 - DNA, 1035 bp, Homo sapiens
acctcacataccagtgtgaacagaactgggagagaggtgtgtaggaggcctttcatatcttacctagatagcagtagcttctcatctttcaccttttctttctttttttttttttttttttttttttttttttgagacggagtctcgccctgttgcccaggctggagtgcagtggtgcgatctcagctcactgcaacctctgcctcctgggttcaagtgattctcctgcctcagcctcccaagtagctgagatttcacttgcccaccaccacacctggctaatttttttgtttgtttgttttaatatttttggtagagatggggtttcaccatgttggccagactggtctcaaactcctgacctcaagtgacctgcctgcctcagcctcccaaagtgctgggatttcaggcaagagccaccacgcctggccctcgttttttctttttaaagaacaaagctctggttatagtccccatcacgctgtatcaccgttactcctgcagatgtgtgaacctgcctggctagaggtggaatctatgggagcactcagtcaccatctggtgtgggagggagggagagaagcatgaagggacggggaagagtgtggaaggggaggggtaaaggagagggaatgggtggccctcacctcacttttgtccctctcagttacagctcagaccctcccctaggtttcccaggtgtgccaggggaagccttgccctctggccaggcaaagccattggaagtctgtaaaggtcacacacagagaaacagcagcagtgctgatgatagcaacgtccccctccctcgtcccctgccccatgacaggtaggcagtcacagcccagccccgaggaaggagcagtcccccctctccctgccacacaccatagatcttctggatgccctggagatcgtcctggggcagcttgaagttgtgcgtctccatgtactggtagaagggcgccatgatggcgctggggtcgctggagtgctccagtcccagcgcgtggcccagctcatgcacagccacca

SEQ ID NO: 27788 - DNA, 1799 bp, Homo sapiens
ggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggtaaggcaggtggaggacgccgagggagggagtggtctccaagcaccattaattacacccccggagggaacccggagtgacctagggattcccagggtatcatctgttatctctgggcactatagaatctctcaggccaagcgtcaggagatcggggcaaccctctagcaaaggctgctggataatagtaataacaaataatgtaaagtgctttcactcctgttctcattccttcgtcacaaagacactagaaggtaggagttactggcctaacttgactgatgaggaagttgagacttgacctaagtgactcagtaagttccacacctagttcctagtgttggagaaggatttttctcttttttttttttttttgaggccagatttttgctctttcgcccaggctggagtgcagtggcaagatcacagctgtctgcatcctcaacttcttaggctcaagtgatcctcccacctcagcctaccaggtagctagggccacaggcacgtgccaccacacctggctaatttttacatttttggtagagacgcggcctccctgtgttgcccagcctggccttgatctcctgggctcaagtgatcttcttaccttggtctcttaaagtgttgggattataggcgagagccactatacccagccgaggatttgtatctcatctctccctgccactgactgggcaaggtgctttctctttctaagcatccatttctgtctctgtaaagattagctaagatatgcggtcttcctgctcagttacgttggaatcttaaattccctttaccacatctctaccctaccttcctacctgtcagcactgttaattctggtcgttggtcctttcctttttattattattattatttttttttgagatggagttttcgctcttgttgcccaggctggagtgcaatggcacgatcttggctcactgcaacactctcttcaagtgattctcctgcctcagcctcccaagtagctgggattacaggcgcatcccgccacacccggctaatttttttgtatttttagtagagatggagtttcaccatgttggccaggctggtcttgaactcctgacctcaggtgatcctcccacctcggcctcccaaagtgctgggattacaggcgtgagccactgcgcccggccggtcctttcattaagctggatctgtcttccattactgctgcccattgtttcttagttctgctcattgaggtcacttttagaagtctgtttattttatttttttacttttactttaatttttaaaaatcttaagcctgcttgggaggtcgaggcaggtggatcacctgaggtcagcagttcgagactaacctgaccaacatggagaaaccccgt

SEQ ID NO: 27789 - DNA, 1079 bp, Homo sapiens
gagctaggtaatctctgagggcccttcctgctccaaagcttaatggtgtgatacatgacataaactagctctgctaggcaggttcagtgaatgttttcctctgagagatgctcctgccttactgtttgacacctctgatatcatccgtttgtggctgtgattattcctaacacaattaggagaacaactcatgtgggagtagggagatcctccaagtatgggtatcaggaggtctgagttgtagtctcatcctcacatgacagaaggaatgaactctagctctggcctgtttcttgactcttccctttacccctttctggaagatgggacagtagaagtttggcagtatatgtttctgaaattccagaaacacagaaggtattcaacagggggaaagaaaggcgaagaagaagaaaatcccctaaaacactagttggatagaacatgctatgcatggcgtagtacacaggcccttgtaaaaattcagttaccagcaagcctgtcttagcccctgctctgggttaggctctggaccagatgatgggggtgccgagattaatcagacatggttcctatgacccttgagtagctcccagactaatgggagagacaggtgcataagcagctctaaaccacgtgtgtacccaggcagaaaatatgcccagagagctgtgagaacaccaaggatggatggctaatgtagccctggttgaaggtgtgtgggataggtcatggtttgcactcctagttacatccagtctacattttccagccttgagcttcacaatcctttcatttttgaaaattatccatggctgtaaagcattggaactggttttggttttatgtaaacaaaccagaagttattacttataattccttacatttgcagagcattctgcagtttaccaaggctttcagcatacatacattattaaattaatgaatgaatgcatgctaactcacgtgctcttccaaatagccctgtgtgtaggaaaggggccgggcgcagtggctcacgcctgtaatcccagcactttaggaggtcgaggcgggctgatcgcctgaggtcaggagtt

SEQ ID NO: 27790 - DNA, 1026 bp, Homo sapiens
aaaaaaacttggactaggagccagaagaccttgtctctgtgaacctcttgaccatttattagccaagtgataattgggtgagtcacttgacctttctgagcctttgcttcctcatgtcttcagcagggaacagcctctttctcagataaccattgggtcagtattttggcaattgtacagctctgaacagtgagcagttaggacacagcagtgaaagacaaacattctgtgacctgtgtgaaacaatgtaaatgtctgctttactgttttgagctttagactttggtctgacccattgtgcccaggtggagttagcagttaactcctgtgattcagttcattagggtgaccccgcccctttcactcttcattgctgtggagaagaagaaggcagggctgttggatgaagggtcaggaacctcaagatcagtaaggggctaaattttgggtcctctgagaaaatgttgccatctgggcaatatgatatctattttaggatcgctgggaaaggactcgggtcagtgatctcagtgttgcctttagatcctctaggttgttcagggcctcagcatccatgacaagtgacagtggctcagctctattagcaaagaactgaccaacttgttgatctatattcacctgtttgccttttgtgtctgtgcagttgacatggttggtagtgatgtggaacaagcatcctgtagttttccactgtacccagtctgcctaaatttaatagaaaataattaaaaaagccaagtagtgcctgcagcttttctgcgctcataaatgcagtcatgaggctcagggtgcaattagcagcctccaagtgtctctggaaacctgagtgtgtcagcgtcttcttgctgacggtaatcagacctcatggctgcagtcagaatgcagagggcccggagtaatgataccgacctacatgtagtgaacaaattactggaaaaggggctcaggctcctaggccctggtgtgttatgcctgtgctccactggagacgcctgccgggctcaa

SEQ ID NO: 27791 - DNA, 1046 bp, Homo sapiens
tctcttgccctgtagcactggaagaactggctccgtccctaatagcctcagttcaaagggaccagaagagactagggtagttggggacaaatgtggggttcataacgtactaggggtatctcgtctgatgaagtggttgggtatggatgtcagaagaatctcacttggtgatgatcctcaggaactatgtaaaggaattttagattgccctggctgatggcaggaagccccacccagggctagccctagctggtcagaattgccaagcagtcagtgtttttattttatgccatctcctaatcatttcagtggccgccaagctcctagaagcttgacagccacaaagatgatcctaattcaaccctttccaagtgaggacactcagtcctggtcaggaaaaaggcttggtcagtgtcatatagtagcggtagtagcagagactaaaactcacttctcttgattgattctgttgctcttttcgttacttgatactatcatctttgctgttctctagagccactacacacaccctgcattttgtgttgctgggaaaagcctccaatcaaagacctcctgatccttttctcttaaggtcagcattccagtgtctagcacagtgcttagcacatggtaagcctccatccaatattggttgaatggtgaatgagtgagtgaactcacagagtctattcctaaccctatcttcttagaatcaattctatacttacactgcagtttacctgattaaattcatgccaaatcgttaagggttgccaacaggatctgttttaatggtcccagataactcttgcattttaaccagagttttctgtaaatagcgtctttggaaaaagcagtggttgcagtagtaagacatacaggcactgtgacgagctcttggggttgactatgcctctcactccatgtcctaccacaagactcttttctcctgtgggcttaacccctgcattgggtaccaccagagggcagtagctccgccaggatctgggtggggctatgtaaaaaagttctggaggctctgaggt

SEQ ID NO: 27792 - DNA, 1962 bp, Homo sapiens
aagaagcagctcccctgtacagagacagagggaggaggctccaaggctgagagagggaacccctgatattttctattccatttgaattcattttaaacagacattgataatgtcacccactaaattgatttcactgagttgcaaccaacagtacttgaaaagtggtctttggcctctagcttccctatccccattccattggccttctcagtacaaatggggtcagtacacaaacagacacacacacacgcacacacatgcactcactccttaatgttctccattgttctcagaataaaatacaagttttggccgggcccagtggctcacggttgtaatcccagcactttgggaggctgaggtgggcagatcacctgaggttaggagttcaagaccagcttggccaacatggtgaaaccctgtctctaataaaaatacaaaaaaattatccaggcatggtggcgggcacctgtagtcccagctactcaggaggctaaagcatgagaatcgcttgaacctgggaagctgaggttgctgtgagccgagatggcgccacgcactccggcctagacgacagagcgagacttcatctcggaaaataaaataaaataaaagtttcatatcatggcattcacatctgatcaaatgtgacctatggtgcctttactagtctcatttgttgctattttaggcactattaccatcactactcccttctctgcaagaaaaagcaaaactatgtagtagaaatatcaagtcttctgcacaaagtttcttctgcctagaaggcccttcccccgcctctccacttgacaaattcctgtttttccttcagtatccaattcaggtattatctctgctttgaaaccttcccttctgggcagggagatttatgtagttggaatttgtgttggcattgtaagtgttaacagatttgtagagactccccttttcaaattgtcatggagcactagtaccttctcagtgcagaaattaattttacaaaatggaatggaacaaataaaattggaacatacctatgatggaggtacgatggagagggagtaaaatgtagtctgtttttaaagattattttaaagtcaggtatttcataaatacaattactactaggtgttttatgtatattatcatttatttatttacatacattatttcacacatgctcacaactactttattctcattttacatatgagggatcaggggcttagagaagtcagagaactttcccaaagaagtagttagaatgtggtggagaggaaattcaggtgctggtctggctaactgaaagcattaagttgctttcctctttagtaattataactactaaagtaactaattaaatacttaaattaatgttaattaatactaaagtacctacttaaacatagattcataaaattatggcatttattctcttgattgaaggtactgtgtacagcagacaaatttatttcgtgccctcttaaggcttaggtgagaagagagacattaaacaaatcactaataaaatacaactgtgataggtgcaatgagaggatgtgacaaggctatgtgggagaagctgggaacctcatttagtttaggggtgggtcagtcagggaaggcttcactgaagaggacatttacattgacacctaaagggtgagtagaagttagcaagtgaaagagtggatgaaaaagccttccaggtagagggatctagtggttttcaaactttttatcagcagagtcctttttaaaaatgaaatcttatgctcagccaccatatatgataaatatgatgaaaggaggtgggaatgacctgcttgcttcacatcttcacaacatgtccactgaaaaaagactgttaagtagttccatggaaactcagaatgtagtttaaaaactacagatctagtccaattctctcattttgcaaatggggagacagttttggca

SEQ ID NO: 27793 - DNA, 1030 bp, Homo sapiens
ggaccccacctccacagaaaatttaaaaaattgacttggcgtgatggcgtgcacctgtaatcccagctacttgggaggctgaggcaggaggatcacttgagcccagaagtttgaggctgcagtgagctatgattgtgccacttcactttagcctgggtgaggggaggagaccctgactgtatttaaaaaaaaaatgctctcagacctgatgaggaacaaagcattctattaaaaattttttgcaactaattttagtttttttctttttggttaatcagctttctactaccaaagattccccacagcctgttgaggagaaggttggtgctttcacaaagataatagaagccatgggattcacgggacctttgaaatacagtaaatgggtaaagtcctttaagttcttctcatttttccttttgggcattgtgctttctgctcctaatagattttttaaagcttctgctttgctttcatggaattcatacattattttggatgtgaggacgatctagctgcgacatctgtcaccccattgatcaccagggttgattcggctgatctggctgggtaggcgggtgtccccttcctccttgaccactctatgtgcgacctttttgaagctgtgttcttggttgaagaggatgaccttctccaatagaggaggaccattctttgatcaagggtatatgagtagctgcactcccctgccagaacctcccaagtaagctctcaaggtccatacattattctgataacttcttcaaaatatctttgcccacgtgccacaacctcttgctgcttccagtcagatctatacaacatgtggggctgaactagtccctccacctgattccttagaagcatctcatagtagcaggcatggcaacaagactgggctttccaggcccttgctgcatggtatgccatatagatgacttctgaggggtcagatgggccaaatgttctgattggcaacattcttaaggaagcattactttctgatggacccatattttataagggattt

SEQ ID NO: 27794 - DNA, 1053 bp, Homo sapiens
taaagcctaagtgtccttgggactgaccagaagaatcctgactaattttttaatatcctcgtttggaaagaaaagtaaatagtaacattccacaattagaaattctattttttcttcgttagggttaaagaaaaaaaatcattttcattccatgtgttccatttcttcttggaataaaccagaattgaagagtcagccctcttcctgctccctctcacccttttttattgtaaaggtaatatagcattagtgagagtttggaaactagatttttttttttttgccagaattattttggctatagattcttaaatttatccataattctaacttaacaaaataactctttggtttcttgtgtgttctttctaaacttgcccatatgcagtctacgcagtcatgttttacctataattttatacatattataagcatttaacatttttcatgttgttaacaataataataatctctgagtaaaccgtgcagtctgagtgatgatgatgtgtcagtgtaggtttgttctttgtatcaaatgcaccactctggtatgggatgttgatggcgggggaggctgtgcatgtgggggaaggggtatgtgggaactctgccctttccaggaagttttgctatgagcctaaaactgctgttaaaaaaaaaaaaaaaagtctatttaaaaaaaaaaaaatcccagccaggcacccaggctcatgcctgtagtcccattttgggagttcaaggcattttgggagttcaaggcaggaagatcactcacttgagcccaggagtttgaggccagcctgggcaacatatggagacactgtctctacaaaaatacaaaaatcagcagggtgtgatgacagatgcctgtagtcccagcaactcaggaggctgaggcaggagaattgcttgagccggggaggtggaggttgcagtcagctgagattgcaccactgcactccagcctgggccatagagccagaccttgtctcaaaaaacaaaaacaaaacaacaacaacaaaaacaaaacaaaaaaccctcaatggatacctg

SEQ ID NO: 27795 - DNA, 1035 bp, Homo sapiens
ccaggaggtggaggttgtagtgagccgagatcatgccaccgcattccagcctgggcacagcgagactccgtctcaaaaaaaaaaaaaataggaaaatatactttataagattgttgtgagataacataagtaaaacaccaagcatgtaggtaggtactagacatacaggagatcttcagtaagttgcaattgctatttttgttgctatttatgttcctgttgcttgggaaagttttctcctcactgtatgaaatgaaacttaaaaaaaaaaaaaaaagttgtcctaaaattacctttaccaaattgcaacctctccctttgtcttagtttcctcatctgtgaagtgaaaaggttggaccagaatatctctgagatttcttccagctcaagtgttgttattctgagttactctttagttcttcagttgccttttctccaagctaaacagcctaaattccttttgacctttccactaggaccttttattcatccctttgatcattcctgtggttctttttttggacgttctccaaagttgtcctctttgaaaaaaaaaaaaaatccacctagtttttattgagtaatgacttcatgcccagaatggtgttgagtattgggacagaaaatgacagacatataagatgggctgtgccctggagcttatagttgctaaaaggagcagacacacacgcccatggtattcaagaatcgcttgagtttgtcccagcaccccctttctacttctctgcctctgtcattcttgtttttttattttttatttttattttttgagacagagccttgctctgtcacccaggctggagtgcagtggcatgatcttggctcactgtaacctccgccttctgggttcaaacgattctcctgcctcagcctcctgagtagctgggattacaggcacacaccaccatgcctggctaatttttgtttttttttggaggggggtagagatggtggtttgccatgttgcccaggctggtctctaactcctggactcaggcaaccctcccgcctcgg

SEQ ID NO: 27796 - DNA, 1050 bp, Homo sapiens
ccactacgttcagctaattttttgtatttttagtagaaatggggtttcaccattttagccaggctgatcttgaattcctgacctcaggtgatctgcccgccttggcctcccaaagtgctgggattacaggcatgagccactgtgcttggccacctttgaaactttttaagtgtacagttctgtggtattgagtgcatttacattgttgtgccatctttaccacccttatccacagaattattttcattttataaaactgaaactctgaacctattaataactctctatagtcttttctccccagcccctggcagccaccattctactttctgtctccgtgagtttaactactttgtgtacctcatataagtggaatcatacagtatttgaccttttgtgactggcttatttcatttagcgtaatgtcctcaagattcatccatgttgtagcatgtgtcagaattttctctttttttttttttggagatagggtctcgctctgtcatgcgtgctgaagtgtagtggctcaatcatagctcactgcagccttgacctcctgggctcaagtgatcctcccacttcagcctcctgagtagctgggaccacaggcatgtgccaccacgcctggctacttttttttttcttttttgtagagatggggtctccttatgttgcccaggctggccttgaactcctgggctcaagcaatccattgtctcggtctcccaaagtgctgggactacaggcgtgagccactatgtccagcctgtttaatttgttgaggaattgtcctactgttttccacagcagatacactgttttacattctcactagcagtgcacaagggttccagtttcaccacatccttgccaacacttgttattttctggtttttgtttgtttgtttttgagacaaggtcttgctgtgtcatgcaggctggagtgcagtggcccaatgacagcttactgcagcctccacttctgggctcaagtaatcctctcatcttagcctcccgagtagctgggactacaggtgtgtgccaacacac

SEQ ID NO: 27797 - DNA, 1031 bp, Homo sapiens
tcctgcctcagcctcccgagtagctgggactacaggcgcccaccaccacgcccggctagttttttttttgtatttttagtagagacggggtttcactgtgttagctgggatggtctcaatctcctgaccttgtgatccgcccgcctcagcctcccaaagtgctgggattacaggcctgagccactgcgcccggccttagtttttttattttttaagtgacgggggtctcactatgttgcctaagctggccttgaacccctgggctcaagcagtcctcccacctcagcctcgtgagtagctgggactacaggcacatgccactgtgcctggctatactctctagttttaacatccattgatgatccttgcctgaatcagtcatttctgtgattgtcaaatgattgtgtaattcttccttttacatttattaggagctttcccttctccctcagtaattaatccatagtacggatccttattgtatcaaatggatcattattaaataggttataatctgatgctcaaactctcctggatttgtccaggagaatccctctcatctgggtgctaattcaagctgtgatttagggcaagtcccctcctctctttgaaccttagtttcctcatgtgtaggagacagttaagtaccctggtttacaagggtgaatgaatgaaatgcacccaggttccgagatctcctgggctgggatggggtgatttcaggactggtgtagtcctgagaggtccaggattttacggtatttcttgctctcctctgcaggcatccagggcattgtggatgcctaccgccaagccctgccccaagttcgcctctatggccctaccaactttgcacccatcatcaaccatgtggccaggtttgcagcccaggctgcacatcaggggactgcctcggtgagagtcgtgggtggcagtggcagtggtggcaatcaagggcttccttgagggttatggaacaaaggacttttttttttttttttttttttgagatggactcttgctctgtcacc

SEQ ID NO: 27798 - DNA, 1750 bp, Homo sapiens
tgggttcgagcaattcttctgcctcagcctcccaagtagctgggactacagtcgcttgccaccgtgcctggctaatttttgtatgtttagtagagacggggttttgccatgttggccagggtggtctcgaattcctgacctcaggtgattgacctgccttggcctcccaaagtgctgggattacaggtattgagccacagcgcctgacccagagggtggattttagagctaggcctctggaatcaaatcgtcatgccaggccaggagtggtggctcacgcccgtaatcctagcactcagttgcgaggccaaggtgggtggatcgcttgagcccaggaatttgagactagcttgggaaacatggcaaaaccccatctctactaaaattacaaaaattagccgagcatgatggcaggcgcctgtagttctagctactcaggaggctgaggtgggaggatcacctgagcccaggaggttgaggttgtggtgagccatgatcatgatcatgccactatactccagcctgggtgatagagtgagaacctatctcaaaaaaaaaaaaaaatgatgccacatgacttggggcaggttgcttaatctctgtgtgctttggtttcataagactaaacataggaaattgagtactcaaggagaggatacaagtaaagcagtaagcctggtacttactaagtgttctccgaaaaatggtatctgttatattatcgttattatctttgcctagaagctaacaggtacttacttgagcatcagtggaagccttgtttgcctccttgcagggtgcattttgccagagtccaccaagcccttttgtttagggccaaaccttttgactccccagtacccccaagggggcacaagctgaagtggaaaatctgacctgacctgatctgatctgggttttaaaattttaattttgtatttcaacataagttcagacttagagaaaagttgcaagaatagtcataggagctcagtcccttggaactcaggggtcagggcctgagttcacaggggctcttcacctttatcccaattaccctaacataacattttaccacatttgttttctcttttctcatacatgtatacagtgtgtatgtgtgtgtatatgtgtgtgtgtgtgtacacatgtatacatatacacacacattcacacatttcaagggaaaaaagattaaaaatatgtgtttatgtatgtacacacatgtatacgtgtgttggagaatgctgtagtgaatagccctgcctcaggtttgcttctatggccctaccagctttgtacccatcattatccacctggctttttacctctgagtacttcagtatctcctaaaatcaaagactctttcttacattatcacagaccaatcctcaaaatcaggaaatgaacatctatgctattatccagcctatagcatttattcagatgttgccaattgtcctaatgtcttttacagcaaaagaaaatctcagatcacacattgcgttcagttagcacatatctttttatatggaagacttcttgcctttcatgacattcacatttcatgatataaacagtataggccagatattttctagaatgtccctcagtttgggtttacctgataaatcctcaggattagattcaggttgtacatttttggcaggaataccaccaaagtgatgctgtatattctcagtgcatcatattcagaggaacatgatgttgatttgtcctattaccagtc

SEQ ID NO: 27799 - DNA, 1023 bp, Homo sapiens
gagtccttgactgatgctctgagaatttcctaccctaatttttctgtcctcaccaggctgagtttgaatgcatccaccctgagaagcagcagaaaaagaaaagctacaagaactctggaactatccgtgtcaagatttgtcgggtgagacaaaagcccatgtaaccaaggctctgattcctgagctccatgacaccaactgctatcaccccaggcatgaccctggtttcatttgcaggtagaaacagagtactcctttctggactatgtgatgggaggctgtcagatcaacttcactgtaagttactttaccaagggcaagagaacaggtctggggctcagggtggcctttagctgccttcctcacctcctcccaggtgggcgtggacttcactggctccaatggagacccctcctcacctgactccctacactacctgagtccaacaggggtcaatgagtacctgatggcactgtggagtgtgggcagcgtggttcaggactatgactcgtgagtacctgcttctctgggctatacccgctccctgcagatgcttcagcctctgagcttacagtcccctcactgccttttgcccaatacactgtcctcccacagagacaagctgttccctgcatttggatttggggcccaggttccccctgactggcaggtgagctccctctctttctgccactcctgttttcagtttcagggtcctgattttgggggatgtggtaaatttacttgctacttggcactcagctttaagaggagatgcagggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgccttgaatttcaaccccagtaacccctactgtgcaggtaagtttccccatccaccctgaggcaggtctgtccacacaaagaggggca

SEQ ID NO: 27800 - DNA, 1033 bp, Homo sapiens
cagagaagcttggtgctgcctgattacaagggcgagacatcagttagtttggagctggctgggcagggagctggggctggagatgaactttcagatttcattctgcaaatatgtattgtctaggtgcttgggatagagcaataaacagaacagctaaatattcctttctcacagaatttatattctagtgggggaaacagtatatacatgtatataatgttagacattgagaaaaagcaaaaaaggggtatgcaatgccaggggcagtggggttgaaattttagaggggctaaaagggagagcctttatatatatatgtatatataaaacagggaagattattttgagtaaagacttgtggggaaagggagcagtgagccatgtggatataatgcagagaaagaacacattccaggtactgcaaagtgtttggggtagaaacaaacttggctggctgggtgtggtggcacacactatcatgccaggactttgggaggctgaggtgggtggattgcttgatccgaggagttgcccagcagcctgggcaacatagtgagaccctgtctctacaaaaaaaaaaaaaaaaaaatagctgggtgtggtgatgcacacctgtagtcccagctacttgggaggctgaggtgggagggatcgcttgaacccaaggggcagaggttgtggtgagctgagatctcaccactgcacttcagcctgggtgacagtgagactctgtctcacgaaagaaggaacaaacaaacttggcttatttgaggagtgacaaagtggctgaaatggagtgagcaagagagacactccgagatcaggttaaagaaatctggaccttccaggaccttataggccatggtatagtttggactttttttcttttcttttctttttggaaatggagtctagctttgttgcccaggctggagtacggtggcgcgatctcggcttacttcaacctccacccgccaggttcaagcgattctcctgcctcagcctcccaaagtgctaggattacaggcgccca

SEQ ID NO: 27801 - DNA, 1050 bp, Homo sapiens
ggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattg

SEQ ID NO: 27802 - DNA, 1022 bp, Homo sapiens
aaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtgg

SEQ ID NO: 27803 - DNA, 1030 bp, Homo sapiens
ttttaaatactaacttctatatattctttgcatgttttttccctatagattgttaaactttgtttcctgatttgacttagacatttcttttaaatcttactgaatgattagtggtctgaatgatgtatatgtattttactgtcctacagttgttttttcttgaactttttgagtcttgggactgaactgtttccaaaattaatgccttctggaagttgaaattgtctacgttttacattgtaaatggcacgtaatgttcagtttttagaatatctaaattaaagacattgcctgtgatagcttgagggaatatttgagggcctaatatggtagctggtcattcttgtagctaaaaacttggtgtgataaacaggagtctgacctggccgttgccttttctcatctgcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgcc

SEQ ID NO: 27804 - DNA, 1048 bp, Homo sapiens
gttgacttttcaggtggggcgcagtggctcacgcctgtaatcccagcactttggaagactgaggagggtggatcacctgaggtcaggtgaaatcccatctctcctaaatacaaacacttagccaggcatggtggcgcatgcctgtaatcccagctacttgggaggctgaggcaggagaattacttgaacctgggaggtggaggttgccgtgaaccgagatcgtgccgttgcactgcagcctgggctacaagagtgaaactctgtctcaaaataaataaataaataaaagttgacttttcagatgggttggaaaacaccctatgttattgaccaccttaatttcaaagtagtatgtttcccaggcccaataattcggtttgtgtcactttccaaagggctgcccttgaatttgctcttagaagcctttggaactgaaatactgaaatttgaggggaacatttcttttttgattatgtcaaaacaggcatgatctaaggagatcacagagatcctgtaggagttgtgtaggtccaagactgtaacaaccactgagtaattcacactctggttctaaaacaaaaacaaaaaatatttttattgtcagccctctcctaggggaaaataatactttaaaaaattttattaaatagaggatttggttatgagtcattggacctgagttttaattaaaatagtcacagtgaatgggactataaccaggttctacttttgggggtaatgaatcaaggtaactcagattttagctgtcctattcagtagttcttttggcttcttagtatgtcttaaccttgtttataataaataattccatatgtagttttttgtaatgtacaaggcagattgaaaagttttaggatgaataaaataatggaaccagttctcatttaagacttgaatctacttttagtcttaagtattatttacaattcattagtattctagttttttgcttctgttggatggattttgagactgagctctataaaatcacactcttgataattctatgaaattatcaagtatatag

SEQ ID NO: 27805 - DNA, 1048 bp, Homo sapiens; identical to SEQ ID NO: 27804

SEQ ID NO: 27806 - DNA, 1050 bp, Homo sapiens
ctcaggtctaagatccaaggaattcttttggattagacccagggatattggaagcacaggccaactctggggagatgaaacgggcaagaactgggtaagggtacagcataccaagatgatgtagggttaagttccacccctaactgggaactagaacaaaaccaagaaacaaatgctgaaaagcgggtaatatgtggtgggctgaaacgagctgcttatacatgtcatatgaagagaggcttaaactagatgtttatacaagtctcaagggtcttggttcctccaagggaaaccatggccatagcctcttaccagtgggatgaaagcttcaagaatatgaccatgtttggtgtccattggctcagggccccactgcaattgagcctgaggaacctagttattcctgttagcagttggggagagctctcaggagagctgacaaggacttacagggagctggagagctcaggataccttaaccacctgtgttagggtctaccagggcaagaggcagaggacagacagggacagaaggaggcaagccattgctcagagccttggggccaatgttgtcgacttcctatctaagccctcactcatttaatgcctcttctctttggcagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacattt

SEQ ID NO: 27807 - DNA, 1020 bp, Homo sapiens
ttgtaagtgcctctctttttttggttggctgggtagctgggtacagactgaagtttaccaccctaggaagacttcctggggtagaattttgtgccttttatcgtcccaggggatgtatgtgtctgttgtgggttacactagcagttctgttacaggcctctagaattgaagatgctccaaaggccactaagtgtttggctgcccttcaggctggtgcagatggtgcattacgtcctggggaagtgagcacatggtcctctgctgcgtcttcttgtcaaacccatgtggtatcatgctctgtcacactttgccagcgtccttgcttaaggaagtcatccaccatgggggccagaggagctaggttcacacatcctaggatgtgcaggggagcatcaggtcctttagttctgccagattagaaggtctcttgttttctccagggtatgactccagggccctgggggatgggaacaagactgagggtttgtgactaaaagtagacgttgatgatgaactgaacaaggttcgtgtctctctcctcagtgcctgcacctctgcatccctggagccctcttatgtgcttagagcaattggcactgatgaggatttagcgcactcttctatcaggtcagtgagttgagctgcaacatttatgaaaggcatcctcttatatttttcatctcctgttacagtttttttctttttccaccctgaagtttttctcagtcgagttctccttatctcttctcataaccttgtgaaagtttctagagcagtggttctcagacttcattgagtatcacctgggaagtttgtgaaatatgatatctgagtcccacattcagatattctgattcactaggtccggaggaggagtagaaaacatctcaggtgattttaatgttggtggtccgtagatcatgttcttttttttttttctgagacagagtcttactctgtcgcccaggctggagtgcagtggcatgatctcagctcactgaagcctctgacttgcaggtt

SEQ ID NO: 27808 - DNA, 1029 bp, Homo sapiens
tttttcctaggttatgattgtagagcgaggattattataatattagaataaagagtaatcactacaaactaatgattaatgatattcatatataatcatatctaagatctatatctagtataactattcttattttatatattttattatactggaacagctcgtgcccttggtctcttgcctcggcacctgggtggcttgctgcccacacctttagcaacaaccttccagtgtgtcctgcacatcctcatcagactttatttctaaagtacttatttggccttttctcactttactcaaaaatcttgagagatttcccatttcctttgacatgaattataacttcattttgcctgatattcagagttctttacatggtgcctttttaagcacttagaaatttctgatgtaattcacataccataacattcatcttttgaaattatacaattcactggcttttaatgtattcacagtttccaacaatcatcactgtcatattccaggacattttcatcacttcataaaagaaagctatgtatttttcttttgtcatttgcacttttttttttttttttttttgagatggagtttcgctcttattgcccaggctggagtgcaatggcatgctctctgctcaccacaacctccgcctcccgggttcaagcgattttcctgcctcagccttctgagtagctgtaatcccagcactttgggaggcggatcacctgaggtcgggagttggaggccgaggtgaccagttcatctgaggtcagaagttcaagaccagcctggccaacatggtgaaaccccgtctctactaaaaaatacaaaaattagccgggtgtggttgagggcgcctgtaatcccagctacttgggagggtgaggcagcagaattgcttgaacccaggaggcggaggttgcagtgagccgagatcgtgccattgcactctagcctgggtgacaaaagcaagactccatctcaaaaaaaaaataaagaaagaattcattttgaaatccaaggtca

SEQ ID NO: 27809 - DNA, 1841 bp, Homo sapiens
aaacaccttacctcaagtgatctgcccaccttggcctctcaaagtgctgggcttacagatgtgagccactgcgttcggccctcatttcttaattacctgtaacttttacattgacccaaatctgggagataggataggatctaattttgaaatgtcaaagacgtgcttttagaacatcataagaagaaccttttgttattttgttggtgggggatggagtctcactctgtggctcaacctcttcctcctgggttcaaggaattctggtgcctcagcctcccacatagctgggatcacagacatttcccaccacacccagctaatttttgtatttttagtagagacctgcctgccttgacctcccaaaatcctgggttacaggcatgagccccctcacctggctggtcctttgaccttatatatatatacgaagtgagactgtaactgagaagatagattttagaccctggtagtaccacatctgaaagtacgaagaggtcctgtggttgcttcatgattttcttctaaattgaaagctcaatattcaattaaagtagaagacgacttttgtttttacatttattttttcactgttttgccttcttagtggttgttcttaagtgtgtgagtacctttagaaaacctgcatttggtttcatttcctttctataaattgtatgacttattttgaaatttgacaagcagttactccctagaatttctgacagcgaagccagtttatacttacaagaatcagaaccagtaaggcatttgtgtatttaacagtcatttgatccctcctcaagttatctttattccattggattaacacataatttattttgagcttatagtgttagctattcgatcctttacagtgagtaattgtcgattgctacttgctctaattgatagtaaactcattacctagagtttattattacagtttgaaaggtttttttttaaccagaaaactgtttacctgtattgcttctcattgttcataatgttctttgacaactaagaaaatttttagttcatgttctaggtattccactaaagggtggtgaaagatttcttcctgccttcagggaattgatacagtgacaaaggggtcatttatagacaattttcttacaccctggatgctgtatcagatacgttgatttgctcttaatgtcttcagttaactgaagattatccactgttaaatatcagttctaccgttagcctttatttcttttattatggatgaatgtacctcttgggttctttctcatcgtgtagtatatattaagattgtttgaatgtagccagctaaaatcctaaagctccatatggattcctgacaatagtgtccctaccctttatctatgtatctagttacattcccttttttagtgctggtggtggtagagatgattttaaagatcattctgttttattagccttgctataaatttcttctgcattaataacactcatgttttaggtgaatatctgtgtaactggatatttttctccagatggtggtcattaaaatattacatataacttgctgaaataaaattgttgagtgtttactgtgtttgaggtgcttgtcccctaagtcttttaaagctattgggtgaaactagggatgggtcatcactatatccacattattttattctgccagtttgataggccctttctaaaataggttagagtccttatctttatgaaaaccatgctttatttttcactttgtcacaaatgatatgacaaatcatttttgaaattatgattgggttggtagacaaaatagcatggatttctgatatctatacattttttcccat

SEQ ID NO: 27810 - DNA, 1048 bp, Homo sapiens
atcaagttatgtatttatttgcttgtgtatgaagtatttatgttttatatatgaggattatattgactattttgtccctgggcacatttttgttagaaaagtactaaattctacctcaggtggtctgcctgcctcggcctctccaagtgttgagattacaggtgtgagccactgcacccagccagttttcacattttctaaccacaatccccatgttctcaaatataaagctgtcattacttgtaatatcttttatttaaactaccacatcaacaagcctaatttgcgttagctagcgtcgtcatcatgtatgttgtgtttgctacttacagcttgcagtttctaccttagtattcagaagtaattattgaatatgctaaaaatataaatatatttttaagtatagtttgtattttaaaaattaaagcactgtctcctgtccttgcctcccctatcatgtagttttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtaagtgtttcttgctattacgaatgatttactgtgggtattgtagtggaaaagaaaggtagccatgtaaactaagaaagggaaaaagattttatcttattttgtagttggcgttatccttggtcacactgcatattattttatagatgatgtgccttgtattaatgtatggaaatctatattatgtgttttgaatgccacagtataagttgcaagatttcttttcctttatgtagtgtttatatgtcatacttaggaataaatttagttgcagctattataatgttacaagtttttctttttgtaatttcttattttttgatgcagggtctggctctgttgcccaatttggagtgcagttgtgcgatcctggctcaccgc

SEQ ID NO: 27811 - DNA, 1067 bp, Homo sapiens
atgttggttgtgtctaacaattccaggaagcatttttctctgtatttagtatttgtggtatcagaatgcatcttaagattgttgtcaagaatgtaggttcatgattcattttaggtgtgaaatgtagcctgcttacttttttttttttttttctcttgagacggagtctcgctctgtcgcccaggctgtagtgcagtggggcgatcttggctcactgcaagctccgtctcctgggttcacgccattctcctgcctgagtctctcaagtagctgagactacaggtgcctgccaccacgcccggctaatttttttgtatttttagtagagacggggtttcactgtgttaaccaggatggtcttgatctcctgacctcgtgatccgtccgcctcggcctcccaaagtgctaggattacaggcgtgagacactgcacccggccagcctgcttactttatatgtgactggcatgtgctctgaaaacattctaaaataagcagggtatgatgtggggtgtgctgtagtccctggcagtctctagtggatgagaaggaaggatgatcacttaagtttaggagttcaagaccagcttgggcaacatagtgtgagactgtctcaaaaaaaaaaaaaaaaaagcctctaaataaactttttatttttatttttttttttatttttattttttttgagactgagtctcactctgtcacccaggctggagtgcagtggtgtgatctcgtctcactgcaagctctgcctcctgggttcatgccattctcctgcctcagcctcctgagtagctgggactacaggtgcccaccaccgcacccggctaattttttctatatttggtagagatggtgtttcactgtgttagccagtatggtcttgatctcttgatgtcgtgatctggctgctttagcctactaaagtgctgggattacaggtgtgagccatcgtgcccagccaaaaactgtactcttgaagctgtaactccctaatttcctgcaggcccttggtaaaatgttatctacctcctctttctgaattttgcatattctagatgcctc

SEQ ID NO: 27812 - DNA, 1035 bp, Homo sapiens
cccacccaggttagcctcccgagtagctgggactataggtgcagccaccatgccctgctaatttttctattttttttttgtagagacaaggttttgccatgttgctcagttggtctgaaaatccagggccaagcaatctgcacgctactcccggccttaaaagcttttgtgcctggcgtggtggctcatgcctgtaacaataaggtcaggatatcgagaccagcctgaccaacatggtgaaaccccatctctactaataaagtacaaaaattagccggatgtagtggcgcgtgcgtgtaatcccagttactcgggaagagaggcaggagaattgcttgaacccgtgagatggaggttgtgatgagccaagatcacaccactgcactccagcctgggtgacagctagactgcgtttccaaaaagaaaaaaaagcttttgtgacaaatcttacaggtggagcgaccaccccaacccccgtacatcctgagagtgtccaaaaaatggaaaagatcgtgtttaggcttacatcttaaaggatgacttacaaccttaattgatattttgtaacagagatgatgttaatagacactgtatctaaatttgtaaagtagaatttgtagaatcatttggggtttcacttcaagtttgccatttgtgattgtcaaacttaatttgactttacaattacatggttttgttgtaaagaatcatccattacactgattttggatcagtctggcatttgtgattggtctggtgatatgttttatgactatgattaaactgtcaggcttctggttgacccttgttttagaaaaattaccctttttgggccaggcgtggtggctgacgcctacaatccgagtacttttggaggccgaggcgggtggatcacgagatcaggagatcaagaccatcctggctaacacagtggaatcccatgtctactaaaaatacagaaaattagccaggcatggtggcacacacctgtagtcccagctactcgggaggctgaggcagaagaattgcttgaac

SEQ ID NO: 27813 - DNA, 1048 bp, Homo sapiens
gctgttttcagctgaaatgtcaggccagttgtgaatttgttgtgtatgctcattgataaagatccttttttgggctcatctgtatttaaggtttgttaataataataaaaggtattccaaactaaaagtgttttgaagattagatcactagaaatttggatgtggatatttaaagttggaaacaaatatattatggttattaaataactatattaaccacctacaattctaaggattgcatctagcaatctttaatgctttatgaggttaattcctcttaataaacacagtgctgtaaactctgggatatattaaaaataacccttctaacttctaagatttgaatggttaaggatggaattcaaagacaaacagacccgaatcacttgggcaagatacttaatcccctaagctaagcatttgttttctaaccttttaaggagataataagtttcagataagctattaatgagtaatgaatgagaagaaaatgtaaagtgctcagaggacttaatggattcatgaaatgttttggcattacatgaattccgattctggctcttttatctttaaaataaaaagaattaaactccgtgatgctggtttcctccaagctgcttatttcattaactttttaatagctgaaaatgggaccacaatgctattttaatttcgaatgctgtacaacattaggaacttctctgcttttgtcccatttatcaagattctgagcatttttaaaatgggattatgttaaatctttttaccaggatgaactaaataaggggaaaggaattagcttaattcctttgagtgatggatactttgtttgctgggatcatggcttaactttaataaaaaattacttagttcttaatgttgggtttgaggctgtaactcagaatattttataattaaaggggaaagaaaatagcttataactaattacttgagaactgtaatacatccagtaaatgattctcagtcatcagcattagtctgaattgcaaagggtcaagttaatataaagtgttttatttggaaatac

SEQ ID NO: 27814 - DNA, 1034 bp, Homo sapiens
tgaatgtgaaaatattctattgtaagtttgttttattaatttattttgtggattacagtaatgcttttgttggcctgttgtatgacaaactatttaaaggttcacattttgatttgtatttgccaacaagcccttttgcttgttaaagctatagctaactctcaggagataattgcagttctactcttagaggatggtgtctttcaaataatgtcttgtctgctgattttcagtaatgttaatataaggcaaaagggatattgtttactatacgtagcaatttttttagacagagtcttactctgtcgcccaggctggagtaccagtggcgggatcttggctcactgcaacctccgcttcccgggtttgagcaattctcctgccttagcctcccgagtagctgggactacaggcgcacggtactatgcccggctaatttttgtatttttattagggacggggtttcactacattggccagactggtcttgaactcctgaccttgtgatctgcctgcctcggcctaccaaagtgctgagattacaggatttttttttttttttaagtatgattatgtaccattgtatcatagtaaaactagccaaagaaatttatgaaaggatgaaaaaatgattctggccataaaaggtagtatattttggtgggttcttaagccagcatgataatggcgagtttttttcttctcaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttagtatgtaactatagttatgattttggtttgagggttattctctgggtattcagatggcagtttaacttgagtgatttgaattgtgaatttttatttttttaatgattggttaaaaagtattgaattaaggat

SEQ ID NO: 27815 - DNA, 1028 bp, Homo sapiens
gttttctctgggcttttatgcaaaagattgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggttgcctctcttgctatagcccatctagagcagaacaaaaactttgtttttgagggggatggagttactttttaccttgttccctaattgaatatatttaggacttttggttttagaaatctcagagttctatagttggaatagtgtcacagagatagtgttaggtttcttaggcaacaaaattggagtgttacctattgcccatctgggcatggctttgatgagttctatataaataatgagtgtagcctaattttctgtcatgtgctacctagcatatacatttctgacagtcaggtggattatcttgaaattttagacaaactttctgcctccttggaaagctctacatctccttgtgattggagtgtgggtttcaagattccagaaggtgggtgtcttcattttctattttcaatgcactctaaagatgacctgcttacaggttctctgaggcagacctcagttgctcttgtgatatgtaactttgctttgataaggaataaacaattacatatccagataatgatacagaattgtcaaaatgtttaatcattaagccactacaaatagacattttcgtggaataaactgattttgaaatgtctttcaatttatattgaaatatctgaaggcacctctaaaatttgggtgatgacacagaggtatagattataagatttaattatgaatgggtggtatactgtgaagactacggaagtgagcagaaagatatgtttggcttttttggtttttagttagagattttaaaaaggtctgtgaaggtcaagttgatcattggttttgattgcatccc

SEQ ID NO: 27816 - DNA, 1024 bp, Homo sapiens
tgtcagtctttctcactacaactgtgttaggtaggttgataaaatttcataaaacagatgagaaaatatataatgttattcagggcttgttaagccactattttttttttttgtagttcccctaaaataatgtggtaatggattaaaaatgatataatttgtagaaaatgtgctccttttttctggtataagcttggatgggagtcatttatagttcctcaccaatcacaagaaattgtggggatcaggttgggtttagtcttgatgtgggatctgatgcaaccaaccagaggtatggtttatgtcatctggttttagactttctgccacagtaatggtttcctaatgtttttgttttgcaattctctaatcaaaagaaaacccaggaaggtgtatccatataaattgacataaattatccaatttaggtgtcaggccgagtggctaaagatttcgcttcaagtgccagaaggataagaacgtacacttttgggtacagaccttcgttactgtaccattgtctcatgtcgctttttgccactaaggtcatctccggtgtctacttgtttttatcctgtgtataagctgattaaggctacaagcttttacaaggaagctgagcatcaagttctccatgtgtgatattcggtggcctttgtctaatgtagagaaccacaggactaaataggagaatggacaattttctttaaccatgagattgtctaagggaagatcctttcaaaacactttggtaatcttaaaatactttccagtcagacttctcgtcaattataggtgataaataaatgattcccttgttcaatcaggactcttgattttctgaaggaactttatgtttcaaattaattttaaagttacctggaagaaaatttttgtatttaggaatagatataaaacatacagaacactctgctttaaacctttagtactaaattaaatttcttaaccaaaggaaagtgccgtgttgcatttttcattctaaaacttcattgtcttaaaagcc

SEQ ID NO: 27817 - DNA, 1614 bp, Homo sapiens
aatgtagtggtttgggaaaaagcaggggtccaagaataacaaagcatgaccagtctgtggcaagttaaatcttctaacagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaactttaaaataaacatttcactaaaccttttaaaaataatacatttgttttggattgtatagcacgaccatgtggtaccaatttggatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagtgagttttaagaaggggcttgggggagggtggtgagcttttttgtggttttagaccttaagttgtgttcctgtggctaaagtatacaaaattctcttctgaagcttttctttgctgcttttagaaaattggttctttgccttttgagacaa

SEQ ID NO: 27818 - DNA, 1034 bp, Homo sapiens
gagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggt

SEQ ID NO: 27819 - DNA, 1049 bp, Homo sapiens
acaaagataaatgcttatagaagattgttctttgcagaactgttcattcgggaaaattgcaaacaactaaatacccctcaccaggagctggcccattatagcaactctgagacctctctaccgcaggctcttaaaatggggtaagttggtgcgcgctaatgtaggggcatgaccaaggtatatttattgacagcttacagtgtcccaacaaggagggactttggacatagttggtgagaactttagtgggaaaactttttccaagtgataagttattgtcatttttctctcccctactttcttttttctttttttttttttttttgagacagagtctcgttctgtcgcccaggctggagtgcagtgatgcgatctcagctcactgcaacctccacctcccagctgcaagcgattctcctgcctcagcctcctgagtagctgggactaaaggcgcccacgcccaccaccgtgcccagctaatttttgtgtttttagtagagacttgagttttgccatgttggccaggctgatcttgaactcctgacctcaagtgatccaccgcctcaacctcccaaagtgttaagattacaggtgtgagcctagctttctcctcctctttctaaattaaaaagaaatattgtgataagaagctcctcctaccttttttccccatgtttgaagaaactgggttgctaagggaagaaaagacttgcctaataggagtttggggtcctgacccctggaagggagctggggatagactaggagaggaaggagaggtggaaaggcatccaagcccagaccagcctggctgcccaggtcatctaagtcagttccctgcctccgtaccagaaaaacccaaaccggaggctcttggatgtgaggctccaggttcatcctgccagtttctagtgaacttggtgatcacataggtttaaatgaataaatccacttttgttaaaaaaaaaaaaaagtgagccgcttcctttttttttttgagacagagtttcgctcttgttgcccaggctagagtgcagtggcgagatctc

SEQ ID NO: 27820 - DNA, 1031 bp, Homo sapiens
ggctgaggcaggagaattgcttgaacccgggaggtggaggttgcagtgagctgagactgcgccattgctcagcctgggtgactgaacaagactccatcttataaaaaaagaaaagaaatgttacattccatttgttttacactttatggtttatatgtttatataacttttcttacttaatctttaaaacagccttgtcagatagctggttattgtcttcattttacaatatctctgtttttgtgaagaatggcagaacattaaaaaaacatacaaagaaatcagggttcagagtgacgaggtgacctaagttccacagctagtacttgaatccataataggtcttttgctgccctcatctgacacagaatatagcactgaaccagtctgatgcaaataatcagtcattcagcctaccagtacatcagtagtccccaggctctgccccagttcccatcatgagccgcacgatttggcttgtggtaatgaaaatgcaaaccaaacaagatggacttattctggagctcagaagcttacccatgtcttctttcaattgttctaggaagagttacaggccaacctggacctgatccaaacctacagaatgcatattgcccaagacatcaaccaagacaacctgcagctcttcttgaattcctacaatgggtatagttttttcctgtttcttcacttaaatgtaaacaggttctaaaaagaggagggtgggagaaggagagaggactgtatctaatcttgggaccagcttctccgaggtgaaaatgtgagccccttctggctttctagaaacatggacaaagattgaggaaatggatcagctgtaacttacccaaaattatacagccagtaaggagtaaagccagattttgaaccttgtctctttagctctttcctctgtataacagagcctccctatttttagttgaaatcagaaagattaagccctgtgctaaactcagttacaaggaaaacacccctcccccctcctcaaagtgtaagtcattctcttaagg

SEQ ID NO: 27821 - DNA, 1073 bp, Homo sapiens
gtcggacgctctctttaacttggatttgcctgtagtgtcactccatatggcagacactttctccttctctccctttttcttgctgcctccccccgctttattctttatatctctcaagaaacaaaacatgagagatattgaaacctcctttagttctctttaataatttatccattcccagaaggaaacaaagttctaaagttagtgtaccttgtttctcctccaagtttttatactttagttataggctggctgtgctggctcatgcctgtagtagcgctttgggtggctgatttgggacaatcacttgaggccaggaattcaagaccagcctgggcaaatatggagaccccgtctctccaagaaatctaaaaaataaaaattagccaggtgtagcagtatgcgcctgtagtcctagctacttgggaggctgaggtgagaggattgcttgagcccaggagttctatgctgcagtgagctatgatcacatcactgcactctagcctgggcactagaatgagatcctgtctctaaatatatatgtgtacgtatatgtatgtatacatatatataaataaacagaatctatagtgttgctttttaaaatattggcataagtggtatatttttaatatatatccttttgcatcttgctcttttacatttttttgaagattttctgtgtgtattaatgctaataattctagttcatttttatctgtatgtcattatatgaataaatcgtaattcatttattaatttccccattgatgaatatttgggctgtttccagtttttttgacattatagagaaggttgtgatgtttacacccttgaccaacacaggtttgaactgtataggttcacttatacatggcttttttttcaatacataaattggatttttttttttttaagaaagggtcttgctctgtcacccaggctggagtgcagtggcaagaacatggcttactgtagctcaagtgattttcctacctcagcctccaagtaactgggaccacaggcatgcaccaccaggcctggctattttttaaaaattttttgtagagaca

SEQ ID NO: 27822 - DNA, 1062 bp, Homo sapiens
aagtcagatcgtgtcattccagtgacaacacatttattgaagtcagagggctcaagaaaaaagtgaaagttggttattaaataatggtaatatcttaaactcttacattcttaaaaggcttttttttttttttttttaaagatgcagggtctcagctgggcacagtggctcacgcctgtaatcccagcactttaggaggccgaggcaggtggatcacctgaggtcaggagttcgaaaccagcctggccaacatggagtaaccctgtctctattaaaaaatacaaaattagccaggcatggtggcgcatgcctgtaatcccagctcctcagtaggctgaggcaggaaaattgcttgaacccaggaggcggaggttgtggtgggctgagatcgcaccattgcactccagcctgggcaaaaagagcaaaacgccatctcaaaaaaaaaaaaaaaaaaaagatacagggtcttactttgtcacccaggctggggtgcagtgacgtgattatagctcacagtaacctcgaactcctgggctgaagcaatcttcccgcttcagcctcctgagtagctgggactacaggcacatgccaccgtgcctggctaattagaaaatatatatattttttgtagagatggggtcttgctctgttgctcagactggtcttgaactcctggcctcaagtgatactctcaccttggcttcccagaatgctaggattacagacctgagccatcctgcctgaccttaaaaagaccttgtgtttaagactacagctttcattaggtgggagagacagtccagaatagagaagtatgtcaaggacctttatgatttcatgttgttttataaacatggagaataaagggattatgttcaagaagtgcatagccttggaggtaataaataatcagtaagtactgggagagccggggaatggtggctcatgcctatattcccagcactttgggaggctgtggcaggaagatcacttgagcccaggagtttgagatcagcttgggcaatatagggagaccccatctctgcaaaaaatttaaaaatt

SEQ ID NO: 27823 - DNA, 1026 bp, Homo sapiens
atctggagtatctctggaggggcagcttttgggaagctgttaggaaccttctagaagtcattgtagagacagaataaatagttgtgataaatcagtttctacataatgggagacttttttcaggaagggggttacactttgtgaaaaatcaagtagaagttttcttttattcccaaatacatcacttgttacctttttttttttcctttttttgaaatggagtctcactctgttgcccaggctggagcacagtggtgcgatctcagctcactgcaacctccgccttccagtttcaagcaattctcctgcctcggcctcccaagtagctgggattacaggtgcacaccacaacacccggctaatttttgtatttttagtagagacggggtttcaccatgttggccaggctgcccacaaactcctgacctcaggtgatctgcctgcctcagcctcccaaaatactgggattacaggtgtgagccaccacactcggccccttttttatactcttatgacttgcaattctggcatctggaatgctggaaaaatgcttctgagttattgccattgatttttttttcctcaatcagtcattattataatataatccctttttagaagcttggtgaattctccatcgattttttgactgtgtttgactttttaaatgattcaatgacttgtcctttttccctatcagcgatttcataggatgcaacagataggccagtgtattaagaaccttgttttgtctttctttccctccttcagtaacactgcctttcttctctgttagatttcaaggctttcatttctgatccatccatatctttgtcctcttcctgatcctttatttaattcctggttctgcacctgttctccttcacctttctcagctttggtctccaactcctttcctcccaggtacttcccttgtgtgttcaaggtgtgcttccagactgtggtccatgttttaccctcttcctgcaaattctcaccgctctccttaggtaggaaggcaagaag

SEQ ID NO: 27824 - DNA, 1039 bp, Homo sapiens
taattaatggctttccttgatttttttcctcttcaaattattctgttgttttaattttttccttgaatccctttctgctgcttaagtctgcttagtgtaagaatttctctgaatatggaattaatggcatcttcaaaatggacagaaaaaaagaaagcacccatagcctgaaatttctagaagttttgttagagtggaaccatatactgtgaacatcagagacaaacaaactgaggcaggaggattgcttgagcccagaggtcaaggctgcactgagctatgatcatgccactgcaactccagcctgggtgacaaagcaagactctgtctcagaaggaaaaagaaacagggcaggtgcagtggctcacgcctgtaatctcaacactttgggaggccaaggtgggcagattgcttgagcccagaagttggagaccaccctgggcaacatggtgaaaccctgtccctattaaaactacaaaaatgagccagttatggtggcgtgtgcctgtaatcccagctactctggaggctgtggcaggagaatcgatggaacttggcaggcggaggttgcagtgaatggagattatgccgctgcactccagcctgggcagcagatcaagactccgtctcaaaaaaaaaaaaaaaaaaaaaaaaaatatatatatatatatatatatatatatagccgggcatggtggcacatgccagtagtcccagctactcaagtggctgaagcaggaggatcgtttgagcctgggaggtcaatgctgcagtgagttgtgatcatgcgactgcattccaggctggctgacagagcgagaccctatctcaggaaaaaaaaaaaaaaaaagaaaaagaaaaagaaacaagtctctagggaagggccccagaaggtactcagccttttagaatgcccccaatgagcagtactgaacttttaatgagtacagagaataaataatatggcctcagttaatcacagttgagtgaaggaccagctaatgatccccattcagaaactctggagccagttactgtc

SEQ ID NO: 27825 - DNA, 1095 bp, Homo sapiens
caacctccgcctcctgggttcaaatgattctcgtgcctcagcctgctggagtagctggaattacaggcgtgtgccaccacacccagctaatctttgtacttttagtagaaatggggtttcaccatgttgaccaggctggtctcgaactcctgacctcaggtgatccatccatctccgcctcccaaagtgctgggattacaggtgcgagccaccgggcccggccggaaaacgcttttaaattgccatttaaaataactgataaatagtaaagttcaaataaaaagtagccacagtttgtagtgttattaataaacaaacatggagtagattccagttaggccaatattttaagagttaagtggggactgtgaaaaagagaatgtagatgctggctgaaactcactgtttaagagtcaagccacctcacccccttttgaaatgtgactggtataaaaacaaaaaaagattcaacttctgggcattaagtagctcaatcaagtatatgggtgcctgcgatctgacaaaagaaccactgtcctatagggaggttaaacatcatcaaatttgtggtctctaggtggttcacacttttggaatattcacagttagcatgtggggttcatagcctgaggagtgttctcaatagacatcctctgagtcccttgaataaatgataagagggcttttttgttagtctgttctaacataggcatagctgggagcaggatttatttcagtgtgttggcaaataatagctaaaaggtagcctggaacacataccctctccataggtaattaaatcaaaatcatgtcattctatctctagaaggtaaacagaaaagtggattaatatagtacactaggccgggcgcagtggctcacgcctgtgatcctaacactttgggaggctgaggtgtgtggatcacttgaaggcaggagttcaagaccagccgggctaacatggtgaaaccctgtctctactaaaaatacaaaaattagctgggcatggtagcaggtgcccatagtcccagcttctcgggagactgaggcacgagaatcgcttgagcccaggaggcggaggttccagtgaaccac

SEQ ID NO: 27826 - DNA, 1048 bp, Homo sapiens
ctaatgattgaactttctaggaagtacctattctgctaatagtgtaaatatacacttatccagggtcagaaatactcaagtttacccacttaaaagatctagaaaatacatgaacttgggcttacttgccagttaaaattgtttatctcagaattgtaccatcaccttaattaaagtagatatgctaggattatcctgataactaattaacatagcctttccccttagtgttcttcacctgaatgtagtagtggactcttcaagtctagcagaggcctgtttttaaccttacgcccataatttttttttttttttgagacaggatctcgctctgttgcccaggctggagtacactggcatgatcacagttaactgtagccttgatctcctaggctcaagcatttctccttcctcagcctcccaagtagctggaactataggcatgtgccaccacacccagctaactttctaaaaaaaatttttttgtagacatggggtcttgctgtgttgctcaggctggtcttgaactcctgggctcaagtgaaactctcacctcagcatcccaaagttctgggattatagcagtgaggcactatgcctggcctttttggttttctgtctttcttttttttttttttttttttttttttgagacagagttttgctctgttgccaggctggagtgcagtggtgcaatctcggctcactgcaacctccgcctcccaggttcaagtgattctcctgcctcagcctcctgagtagctgggacaacaggcatgcgcaaccacgcccagctaatttttgtatttttagtagagatggggtttcaccatgttggccaggatggtgttgatctcttgacctcgtgatctgcccgccttggcctcccaaagtgctgggattataggcatgagccactgcgcccagcctggttttctttttttctaataaagagatggggtttcactatgttgctcaagctgtgctgggctcaagcaatcctcctaagtagctggaactacaagcactatgcccggctatgcccata

SEQ ID NO: 27827 - DNA, 1031 bp, Homo sapiens
aagtggaataacgatgcaagtaaagcgcttacatagcacaggtcctagcacagaataagcgtttaacagttgacagttgttgcttttctaagcctggatctgtgtgatacagtcgttattatccaagcctggatttgtgtgatattgtcataaggaccgtgggggattcagatccttgaccgagccctccttgttatcttttcctttttgtccctctgcatatattcatatctttttacttagcaccccccacagacagatttctgctgggagggaggggacgatgaagagatgcctaggtgacatccctgccttccaggcagttgttcctgacagtcactaggaatacaaatacagcctggctggggagacagacatgtaaacagattttatagccaatgctacgaaggccaaggggcataaccaccaactctgccaaagataagtgatgtgaaagcttcatatttgagccaggttgggaaggatgaataagtttaacaggtagaaggacagatatgtgcaaagattcagaagtagtacagggaataggactgggaggagagagcaggaatgggtaaattgggactagtttacctgaggtgttgactacactttggaaaagtcccggcaactgtctgaagaatagactgggccgggtgtggtggctcaggcctgtaatcccagcactttgggaggctgaggccgggcggatcacctgaggtcaagagttcgagaccagcctggccaatatggggaaaccccatcgctactaaaaatacaaaaattagccaggtgtggtggcaggcacctgtaatcccagctactcaggaagctgaggcaggagaattgcttgaacctgggaggtgaaagttgcagtgagccgagactgcgccactgcactccagccttggcgacagagtgagattccacctcaaaaaaaaacaaaaacaaagaatagactggagacgggccgttggaggtagaaaaactagtggagagactattaagatagtgggagggaccagaaatta

SEQ ID NO: 27828 - DNA, 1023 bp, Homo sapiens
agagacttgccggccctctagctccagcctcttgtgtctctgacattcttctgcctcctgcactttaaaccaaatcccccaaagcagcattcttctttacactggactgacgattaagccagactggtgaaagcaacagagtggctggtgggaaagagcttctgaccaggagtccccagtccttacctggctccaccaggtacaaccccagtcaagtcacctctgatctctgggcctcatctgtaaaataaggatgaccattcttgaccttctcatcttgcaaggcagctatggaaataaagtgagatagccagaagattcaaagtgcttcttaagcccacccctgtctggggcttggtttgattctatggtcttcatctctcattgctgtttgctgatgttagtgttatttccctccttcccttccctcccttcctccctcccttcttctttcttcgtttctttcttttcttattttgagacaaggtcttgctctgtcacctaggctggagtgcagtggcaccatctcagctcactgcaacctccgcctcccaggctcaagtgatcctcccacctcaacctctcgtgcagctgggagcacactctaccatgcctggctaacttttatttatttatttatttatttatttatttatttatttatttttgagatggagtttcactcttgttgcccagactagagtgcaatggcgcgatcttggctcaccgcaacctctgcctcccgcgttcaaacgattctcctgcctcagcctcctgagcagctgggattacaggcttataccaccacgcctgtctaattttttgtatttttagtagagacagggtttctccatgttggtcaggctggtctcgaactcccaacctcaggtgatccacctgccttggcctcccaaagtgctgggattacaggtgtgagccaccgtgcccggcaacttttgtatttttttgtagagatggggtttcgccgtgttgcccaggctgatcttaaactgctaggctcaa

SEQ ID NO: 27829 - DNA, 1034 bp, Homo sapiens
tgactggcctcttttacttagcatcaggttttcaaggtttatccatccatgttgaagaatgtagcaggacctcattcctctttatggctgagtaatcatccattgtgtgggtatatgaccacattagatttgtccatttatctgggttgttttggctactatgaataatgctgctgggaacattcatgtgcacgtttctgagattctgtgttagttctcttgtgtagatcccagggagtagaactgcaggatgtagacgtgactggggaaagacaaagatgggattcaaacccaggactccacatctctcaaacccgcactgactcttctggtgttgcccctatgctccttgccccacccttgctctcctaggaccctgttgtgtcttcagaaacctggaagaggctgcccactcctgtgactgcttccttccctggcacagccttctcatccggaattcctacctggtgggctaggaaggggctgatagttcaaagcccggttctgccttttttccagacttggcacttacttgcaagtgactgtaaccttgcggaaatgatataactgctctagcgcttagtttatttattttattattatttttgggggagacaagagtcttgctgtgtcactcaggctagagtgtagtggcacgatcatggttcattgcagcctcaaacttccgggctcaagagatcctcctgcctcagcatcccaagttgttgggactataggcgcacgccaccacacctggctaatttcgtatttttgaaagagatggggtctctcactatgttgcccaggctggtctcaaactcctgggctcaagctatctgcccttctcagcttcccaaagtgctgggattacaggcatgagccatcgtacccagcctagtttgtttataaaattggaatattatccctacttctcagaggtgtttgtgaaaattaaacaagacaagcaagtaaagtgcttaacacagactaaggacttattattttcattagtgtcacaaccaccgtgagggctg

SEQ ID NO: 27830 - DNA, 1035 bp, Homo sapiens
tcttttgttattattattttctggtttactgtgtatcttcctggtgaagcttggggctccatacagagtatatagaaggggctggacccaccccattgtccctccctgcccctgcgcttagcacagggcctacctaggacgtacatagttgatgctcatccatgtttctttttttttgagacggagtctcgctctgtcgcccaggctggggtgcagtggtgcgatctcggctcactgcaagctccgcctcctgggttcacgccattctcctgcctcagcctcccgagtagctgggactacaggcacccgccaccatgcccagctaattttttgtatttttaatagagacggattttcaccatgttagccaggatggtcttgatccaacctcgtgatccgcccatctcagcctcccaaagttctgggattacaggcatgagccaccgtgcccaacctcatccatgtttcttaaatggcctctcctgcttccccagtgtgttcctgttgcttctgtaacaaatcactacaaatttagtggcttaaaagaacaccaggccaagggcacggtggctcatgcctgtaatcccagcaatttgggaggccgaggcaggctgattacgaggtcaggagatggagaccatcctggctaacacggtgaaaccccgtctctactaaaaataaaaaaaaaaaattagccaggcgtggtggcgggtgcctgtagtcccagctactcaggaggctgaggcgggagaatggcgtgaacccaggagggggagtttgcagtgagccgagatagcgccactgcactccagcctgggcgacagagcgagactccgtctcaaaaaaaaaaaaaaaacaccaggctgggcagggtggctcatacctgttcccagcactttgggaggccaaggcgggcagatcgcttgaggtcaggagttcaagaccaacctggccaacatggtgaaaccccgtctccactaaaaatataaaaaatcagctgggtgtggtggtgggcacctgtaatcccaactactt

SEQ ID NO: 27831 - DNA, 1034 bp, Homo sapiens
cagcctctcccgcccacgtccctgcagacccagcctggggccacaagcctgcctttgtcagctcaccctctcacgtggggccgtgccagcaggggctaacgggcattctgcctgcagctgggactagccccctgagaggcctaggcccccctggagagatggaactggcgtgaatgcaacatcttgggctgtcacaaattgactgtggtgaagggcaggccttggggagacagctgctcatgtgagaactatcattcattcattcacttattcaaaggatgcttgctgagatcctgctctgtgtcaggccctggcatggggacttgtgctcagagacctgactcttgcccttttagggggggaaataactagaaggaaacgcccttcatcagaatcccttggggggctcaccctaggagtttctgattcagcaagtctgggttgggacatgagaatttctcacaaattcaccagtgatgctgatgttactggtccaggaactgcactttgagagccactgtaattcaggtattgtaattatgcatggattatgttttctttttcttttcttcttcttcttcttcttttttttttttttttgagacagaatcttgctctgtcacccagggtggagtgcagtggtgtgatctcagctcactgcaatgtccatctcctgggttcaagcaattctcctgccttagtagctggtattacaggcacctgccaccatgcctggctaattttatatttttagtaaagacagggtttcaccaagttgcccaggctggtctcgaactcctgacctcaaatggtccgcccgcctcggtctccccatagtgctgggattacaggcgtgagccactgcacctggcctgttttctctattttcaaaactgtctctatgatcatgttttacttttagagacaggttcttgctctgttacccaggctggagtgcagtggtgcaatcatagttcaacagaaccccaacctcctgggctcaaacaatcctcccaccccagcctcccaagtag

SEQ ID NO: 27832 - DNA, 1111 bp, Homo sapiens
atgggaggaaactgtcaggcgcttcctgacacgaatgccccagaggccgtagggcctgtggatatctccctgctctgccaggtaaggccttgaatgggagagtgacaacagtgacaagccagatgtggccttggtgggcagtggtctcttaccaacaacaaccaccacacacacacacacacacacacacacacacacacacacacccctccctgatagagcatctgtagtgtctcttgtgcagaactgtaccagacggatctgggaggctcactcctgactggctgcgtagaccttatcttcctgggcctccgtttgcttgtctgtgaaatggggataaaataataatagtgcctgcctctaaggatcatcactgagcaagagataatggcttttctgtctcagtccggtgtctggaacgcattaaacgcttgtcaatgttagctattgttatcgtcaccattgttcattataagactgtctagtccagcttataggagctccaactggacctgaatcctggctgtgccacttagtgtgtgaccctgggcaacatacttgacctctgtgaggttcctctcccatcggggattgctcgggctgcagtgagagaatgtgcactccctggcggggatcaggggtgcacagggagcatctcatttcttggcattggagaggcgggtccaggccccagtcttccctcattattcccaaccagaggagcaggacgtggtgagtctccagggccaggcagcctctgtgttgtctggagtggggacatcatgtggcacggtgatgccaggctgcgtgtcctggccttctttccccgggacctttttttttttttttttggagacgaagtctcactctgtcgcccaagctggagtgcagtggcgtgatcttggctcactgcaacctccgtctcctgggttcaagtgattctcctgcctcagcctcccgagtagctgggactacaggcatgtgccatcatgcctggctaatttttgtatttttagtagagacggggtttcatcatgttggccaggctggtctcgaactcctgacctcaggtgatccacccgcctcagcctcccaaagtgctgggattaca

SEQ ID NO: 27833 - DNA, 1046 bp, Homo sapiens
caaggaagtctgaaggttattaactactgaggtgccaggattctaagatgcagctttagctgccgagcagacacgtcacctgagaccttcaaagacccggtgatctgaggtcttccagcctttcatcaccactaaccattaagcacgtaccatgtggccagaacatgtaggaacccactgggtgtggatggaggaatctgagagttggagtctgaagacctgactttgaaacctgactctcccgtttactgtgtggccatgggcaagttacctggcttctctgagctgctttttttctcatctgtataataaaggtgatggggcctggcgcagtgactcacgcctgtaatcccagcactttgggaggccaaggcgggcggatcacctaaggtcaggagttcgaaaccagtctggccaacgtggcgaaaccccatctctactaaaaatacaaaaattacccaggcgtggtcgtgggcgcctgtaatcccagctactcaggaggctgaggcaggagaatcacttgaccctgggaggcagaagttgcagtgatccgagatggcgccactgcactctagcctgggcaacagagtgaaactcttgtctcaaaaaaaaataagtaaaggtgatggaacctgcctggacaacctcatacgatggtcatcaggaatcagggaagtgtgaatagacaagaaaacattttgcaagcagtgaacccaagtcgcctgaggaattgttattattcatagccaataggcagacaggatgtctgtgtcttcattcttggaggaactgggagaatgcaggagggtggatttccttagttttagaatgttaatacatcagtagctgccccagggagaacggaaaggtgtgatcaccttccctgccgtgtgtgtgtgtgtgtgtgtgtgtgtgtgtgtgtgtgtgtgtgtgtgtgtgtgtgtgtgttttccctccttggtgattctagatgtgagtgaagtgcagccagtgtgtgtgtgtgtgtgtgtgtgtgtgttttccctccttggtgattctagatgtga

SEQ ID NO: 27834 - DNA, 1030 bp, Homo sapiens
gccccgaatgtcttctgctctgatgctccccggactaagcctccctggcacactgggagtgaggggcagcctgagcaagtaggggaactcagaccacaggccagcagatttcccagcagtccatcactggccaccgtgtagccagattctgttccgtccacactggggtgaagagtacttggaatgtctgccatcctgtatgatcaccccaccccctgtccatccatcagtagataataagggttggttacaattcataagagaatagttaaaacacttctcctctcatgcctaccatggtgctgtatcaaggggatttgttcacatatgggctcagcaacgcacaagtgaggtcagccatggcactaggtcattcccattttagccaaggtgcctctataggggtcagacatcatgtgcccagacctaaggtcaggaatgtcatatttttctgttaaaatcattttatttctgtgtatcttacctttaaatcattgtggtttactctgagattctgtagtcctaatattgtatcattgtgctgtctgcaaaacaacttgaatctattttgtttgcatcttttgttacatgtaacgcagctgtactttatgttctttgcaactgtttccattatgagaacgctgtgctatttacaaggttacatttttcttggccaggcgaggtggtcatgcctgtaatcccagcactttgggaggccaaggtgggcggatcacttgaggtaaagagttgagaccagcctggctagcatggcgaaacccagtctctactaaaaatacaaaaattagccgggtgaaattagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacaaaaagaaagaaaggaaggaaggaaggagggaaggaaggaaggaaagagagaaagaaaag

SEQ ID NO: 27835 - DNA, 1032 bp, Homo sapiens
ctaaaaatacaaaaatgagccaggcgtggtggcacgcacctgtaatctcagctactcaggaggctgaggcaggagaatcgcttgaacccaggaggcagaggttgcggtgagcagagatcgcaccactgcgctccagcctaggcaacagagcaagattctgtctcaaaaatgaataaataaaaataaataaataaataaaaataaaattggaaagcaatcacatagcttacagaatccgtggaaaggctggaggctctgaaaatggagaaaaacaacagaagccaagtgacctaagacacagcctaatcactctaccgtagcttcctgccgagagtgctgccgttctaccacagctggattctatttgctgcacactgacagaatgaaacctaaactagctcctcctaaactgtgtttgaagaaccagtttttaaaattaccaaccccttgcagattgatatttctgtaaagtatgataaaaatgaattactagaaaaatgaaatggggggaaaaggcatgtaaaatacaagcccaaatttttattattcaacttgacagacttcacattacacctttcagtaaattcaatcaaaagataaataataggccagacaaggtggctcgtgcctataatcccagcactctgggaaaccaaggcagttggatcgcttgagcccaggagtttgagaccagcctgggcaacatggtgaaaccctgtttctaaaaaatttaaaaattagccctggtggtgcgtgcctgtagtcccagctactcaggatgctgaggttggggggatcactggagcccaggaggccggggttgcagtgagccaagattgcaccactgaagtccagcctgggtaacagagcgagaccctgtatcaaataataataataatgatagagaaaaaatttaaaaattaaattacaagaactatatacattgttctttaaaaatatacatgtaaggctaggcagggtggctcacgcctataatcccaacaccttgggaggctgaggcaggtggatcac

SEQ ID NO: 27836 - DNA, 1066 bp, Homo sapiens
ggcaagaccctttctcagaaaaggaaaaaaagaaattctggacatgtttttatcagttttcaggacttggtatcaatgtacatagaatggctaataaaaattggaattgagattattgaaaaaaaactcttttctgtatgactggaagcagttgcacagccatctgaaatctgtctgttttaatatctatgtctctaaaattccttagaataacttaaaagttaatgttcctgtggtttccagggtctagggggaaaatgaaaaataactgcttaatggatacagagttttttggggggggagtgatgaaactattttggaacttgatagaggtggtgtagttgcataacattgtgaatttactaaatgccactgtattggacatttaaaaatggttaattttgtgttatgtagatttcaccttaaatttttttttaagtcttgatttcaccttaaatttttttttaagtcttagatactatattagtccattttcatactgctgataaagaaatatccaaccgagactgggaagaaaaagaggtttaatggacttacagttccacgtggctgggaggcctcacaaccatggcaaaaggcaaggaggagcaagtcatatcttacatggatggtggcaggcaaagagagcttgtgcagggaaactcctgttttttgtttgtttgtttgtttatttgtttgtttttgagacagagtcttgcactgtcaccaggctggagtgcagtggtgggatcttggctcactgcaacctctgcctcccgggttcaagtgattctcctgcctcagcctcccaggtagctgggactacaggcgtgtgccaccacgcccagctaatttttgtatttttgtagagatggagtttcaccatgttggccaggatggtctcgatctcttgacctcatgatccacctgcctcagcttcctaaagtgctgggattacaggcatgagccaccatgcccagcggaaactcccgtttttaaaagaatcagatctcatgagacacattcactatcaggagaagagcccaggaaagacctgacccgataa

SEQ ID NO: 27837 - DNA, 1061 bp, Homo sapiens
gaaagtgcatttggtagatggcacccaggataggaagatgtctgaaaacacaagcctcctcttacgtacatagacaactctgtgatcatctccatccttatccttgttcagtggtgaagatgtggtatggacatgattgctgttttcagagacttcatggactatcaagcagatatgttcagtatgtctccagaagtcagaatcagtataaactggaagaaattgtagtggggcagattgtaactctgtccaaatacagtggctccttcttattactttcctattcagttatacagataactacagagttcctactatacttgacaaagttggctaagataatatacctgactggacacagtgactcaagcctgtaatcctagcactttgggaggccaaggcgggcagattgcctgagctcaggagttcaagaccagcctgggcaacatggtgaaaccccgtctttactaaaaatacaaaaaattagccaggcatggtggtgcgcacctataatctcagctactctgctgtggaggctgaggcaggagaatcacttgaacccggcaggcggaggttgcagtgagccgagatcacccctttgcactccagcctgggcgacagaacgagactctgtctcaaaaaaaaaaaatgttgaaaatcattactctaaggaagaagatctcaaactgtagggagctttaaaatcattgggagggcttgttaaaacagattagggccgggcacggtggctcatgcctgtaatcccagcactttgggaggccgaggcaggcagatcacgagatcaggagttcaagaccagcctggccaacatggtgaaaccccgtctctaaaaatacaaaaattagccgggcatggtggtgggcacctgtaatcccagctacttgggaggctgaggcaggagaatcgcttgaacccaggaggcagaggttgcagtgagccgagatcgtgccattgcactccagcctgggcgacaagagcaagacttagtctcaaaaaaaaaaaaaaaaaaaaaaaacagataaggctaggcacggtggctc

SEQ ID NO: 27838 - DNA, 1107 bp, Homo sapiens
gtatctgagctacaagagcagtgaagttccagagagtagaagtaagcaaaagataatagacgatgtcgttttctgttttgttttctttttgataagtatctgccaaagaaacttgggtgactgagagtttgccacttcctgtatatataggtttcagatcaaattctgctacacaatttctttctttctttcttttttttttttttttttttgagatacagtctcactcttgttgcccaggctggagtgcaatggtgcgatctcggctcactgcaacctccgcctcccaggttcaagtgattctcctgcctcagcctcccgagtagctgggattacaggcacctgccaccaggcccagctaatttttgtatttttagtagagatggggttttgctatgttggccaggctggtcttgaactcctgatctcaggtattccacccgccttggcctcccaaagtgctgggattacaggcgtcagccactgcacctgaccttttgtttgtttgttttgagaccatgtcttgctctgtcacccaggctggagtacagtggcacagtcacagctcactgcagccttgacctcccaggcccgagtgattctcgactcagccacgtcctggctaatttttatattttttgtagagatggggtttcaccatgttgccaaggccagtcttgaactcctgggttcaagtgatccatctgccttggcctcccaaagtgctgggattacaggcgtgagtcaccgcacactgccttacatacggttattaactagatatatttattagcaagtaagcaaacaaccattgttacagatcctgtacagtggtggtggcacagggcagggagaatatccagtgataatgaactcaggaattctggcactcaaaaagagagaacacagtggcttacatctacaatcccagcactttgggaggccaagccaggagggtggcttgaacccaggagttcaagaccattgtgggtaacatagtgacagcctattgctacaaaaaattttttaaaatagccacacatggtggtgggcttctgtagtccaagctactcaggaggctgaattgggaggttggcttgagcccag

SEQ ID NO: 27839 - DNA, 1096 bp, Homo sapiens
agggacatggtgaaacacctaaacagcattgaagaacagattttggagagtttagcatggagtcacgattctgcactgtgggaggctctccaggtttctgcaaacaaagttcctacctgtgaagaagtgagtctgggcaaggctgataatcgtatcattaaaaaaaaaaaaaaaaaaaccagctttattgagagataattcctataccatagagttcacccattttaagtgtacaattcagtggttttagtatataaatagatatgtgcagccataaccacaattttagaatatagtcatcacttcaaaaagaaacctacatcctttagctatcacttccctacccccgaatcttctccctagctgtaagtaaccactaatctactttctgtctccataaatttgcctattctagacatttcatataaatggaatcataaaaatgtagtcccttttgactgggcatctgtcacttagcataatgtttttaaggttcatccatgttgtagaatgtatcggtatttcatttcctctctttttttaaggcggggtttcactcttgcccgggctggtgtgcagtggacaaagatggtgcactgactacaccctcaacttcctcggcccaaactgtccttctgcctctcaagtagctgagaccacaggcacataccaccacacccacacccggctaatttttttttctttctgtttttctttttttgagatggagtcttgctctgtcacccaggctggagagcagtggcacagtctcggctcactgcaacgtctgcctcccagttcaagcaattctctgtctcagcctcccgtgtagctgggattataggcacccaccaccacacccggctaattttttttgtactttttttagtagagacggggtttcaccatcttgtccaggctgttcttgaactcctgacctcatgctccacctgcctcagcctcccaaagtgctgggattagaggctagaggcttgagccaccgcgcctggccacacccggctaattgtgtgtgtgtgtgtgtgtgtgtgcacgcgcgcatgtgtgtgtagagacaggatcttgccatgttgcacag

SEQ ID NO: 27840 - DNA, 1049 bp, Homo sapiens
aggttcaagtgatcctcctgccccagtttcccaagtacctgggactacaggtgcatgctgctgcacctcgcttttctgtttgttttgacctatgtttttcaggtaagaggttttcctcaaatgtcagataattcttagtggtccacttaaatttgaatgagacactaaaaacgtgttcaaagctctgtgaatgaggcagtaaaagtttgttttaaagctcttttatttcaagagtggaagtaaaaaatccattgacctcaggtgatcacatagtattagagacttatctgctggtatccgtaagacttttctggaatatctcagtttctccagagacatatctgtaaatctcttgcctggctgttggtgttgtggatcagaagaaggaagggaaacttggtcttatggttcagtctgcagagtttcacctaaaaccctagtcttttctgtgcctaatgttctctacctctgagtctccagttcaatttctctagagaataatcctgtagattcctgtggagacagaatagaggtctgtcatctgatcccatagagtgggggttgtgtggggacctgaggatcctaagactttcagatcacccacccaatgcttcacccccacttcccattctgcctgtgtcctcagttgctatgtattttagatcagattcttttgttttaagtgtctcactgcaggtccttatgcttgatcatcgtcccttctgctgagtaatttgtcatccttcatatattgtggtttacagttacaaatgactgctagttttactgatgatggagtttctgttttttatcctcccttgatttggggcgatacttgttttttgtttgtttgttttagttttttgttttttctgagactgagtctcgctgtgtcgcccagtatggagtgtggtggcgtgatcttggctcattgcaacctctgcctcacaggtttaagtgattccactgcctcagcctccggagtaactgggatcacaggcacgcgccaccacacccagctaatttttgtatttttagtagagacgggg

SEQ ID NO: 27841 - DNA, 1274 bp, Homo sapiens
gcaaaaacaacatacaatgaaaccaattttaccataggctaactgatataaacaggagtttaagttcttttggcatatgtctagtcacaaaaacctcaccaaacttctaaataaagacaaaacacttataatgttaaacattgaaataaataagagaaagtaataaaaataaggaagattattacttatccagttattcctgttcagggtcatgagagcctacctcagcagctcacgatgaaaggcgggccccaaccctagtcaggacaccatttcatcataggacacacacacacccacacttacactgtcacaatttagatatgccagttaagctaatgtacatatctttggaatgtaagaagaaaccagagtacccagagagaactcatgcagacgtaggagaatgtgtaaatttcatacagtggccccagctgggaatccattatttttcattgttacaacaaactggtgttgagcgaaatggtgttattcaaggatctgctgtattctgctattgttggatggagtgttctgtaaatgtcagttttatcttgttggttgatgttgttattttatattcttgctgatttccagtctagttgttatatcagttgttgacagaggatgttgaagtgtccatgtatgattgtagatttgtctatttctttcaagtctgtcagcttttctccacgtattttgaagctctgctgtttgatgcttacacatttaggattgctgtctgccttcttgatgaattgactctgtaatcattataaaatgttcctccctggccaggcgcagtggctcatgcctgtaatcccagcactttgggagactgaggcaggtggatcacctgaggtcaggagttcaagaccagcctggccaacatggtgaaacactgtctctactgaaaatataaaaggctgggcatggtagctcacatctctaatcctagcactttaggagactgaggcaagtggatcacctgaggtcaggagttcgagaccagcctgaccaacatggcaaaatcccgtctcaactaaaaatacaaaaattagccaggcgtggtggcgcatgcccgtagtcccagctactcaggagtctgagacaggagaatcgcttgaacccaggaggtggcagttgcagtgagccaagatcgcaccactgcactccaccctgtgcaacagagtgagactccatctcaaaaaaataaatatatgaaaatacaaaaattagccgggtatggtggcaggcgcctgcaatcccagcta

SEQ ID NO: 27842 - DNA, 1050 bp, Homo sapiens
tgaaaccccatctctactaaaactacaaaaattagccaggtgtggtagtgcgcgcctataatcccagctacttgggaggttgagacaggagaatcgcttgaaccctggaggaagaggttgcagtgaactgagatcgcaccactgcactccagcctgggttacagagcgagactccgtctcaaaaaaaaaaaaaaaaaaaaagaagaagaaggcatgttagtattctggtgtggagtcttttttgtttgtttgtttttgtttggtttggtaattggttcctcttgtattttgtagatcttgtgtgcgtaatcctgtggaaaacattatgaaaatactaaaaggaataggagagactttctgtcaacactatactcaatcaacagatgaacagccaggatctcacataggtaagaaaagaaaactacagttggcatagcattgaaaataagtaatccccccaaaattagaaattcacggtttttcctctcccgttattcttatttcttttttttttttgagaccgagttgcccaggctggagtgcaatggcatgatctcgactcactgcaacctcctcctcccaggttcaaacgattctcctgcctcagcctcccaagtagctgctattacagggacccaccaccacaccggctaattttgtatgtttagtagagatggagtttcaccatgttggttaggctggtctcagactccggacctcaggtgatctgcttgcctaggcctcccaaagtgctaggattacaggcgtgagccaccattcccggcctgccctgctattcttaatgtatcagatttaagtttatatataatttttgcttttcagtccttaacaactaaaattcattaacacatgttttctctgtatttccctgatagactttgctgtaaacagactaaagctggcagaaattttgtattataaaatactagagactgtaatggttcaggaaacacgaagacttcatggaatggacatgtcagtaagtaaatccactctctgagctactggcaaggtccaaaagtcagcctg

SEQ ID NO: 27843 - DNA, 1089 bp, Homo sapiens
gcaggtgatgagaaagagaattttcattatacatgctttagtaacttttagaattttgtgcttgtgcatattacttattaaaaaacaacaccttcacacaaagtatcatgatatgcatctttgtatttttgcctgtattttttactttcttcttaggttagagtctttaaaaagtaatttctggatgaaaggacttgagcatttttaaggctttttattcatgttgccaaattgcctctagaaaagtgaacaaattaggccggtgcagtggctcacacctgtaatcccagcactttgggaggccgaggtgggtggatcacctgaggtcaggagtttgagaccaccctggccaacatggcaaaaccccatctctaccaaaaatacaaaaattagtcaggtgtggtggcatgtgcctataatcccagctactcaggaggctgagggaggagaatcacttgaacccaggaggtggaggttgcagtgagccaagatcgcgccactgcactctagcctgggagacagactgagactccatctcaacaaaaaaaaaagtgaacaaattaatatttctaacatatttacatgtatttactgtaacctctttggagtagtgttgtggggaggtattttttaatagcctattgagatattatgacataccatataattcatcctttaaactgtacagttccatggttttttgtattttcacagagttgtgtaccaccaccacaatccattttaggacatttccatcaccccaaaaagaaacccctgttagcattcacttcgtattccaacccccacacccagctcttggcagccactgatccaacttctgtctctatagagttttctattctggacatttcatataaatggaatcgtataatatgtggtcttctgtgttggcttctttaggataatggtgtcaaggttcatccatgatgtagcatgtatcagcagttctttttatggttgaataatattccattgcatagatataccacattttgtttatccatttatcagttaatgagttatttctaccttttggctattgattagtgttgctatgaacatttgtat

SEQ ID NO: 27844 - DNA, 1028 bp, Homo sapiens
caagacccactctcaaaaaaaaaaaaaaatccattaaaaataattacaaacttatgaaaaaaaagaaaactaagtctttttaaaatgtagattgatattctcaaagtccctttcccccaaaatgtttatttttttttgagctagaatcttgctctgttgcccaggctggagtgcaatgcacggtctctgctcactgcagcctcctcctcctgggttcaagtgattctcctgcctcagcctccccagtagctggggctacaggtgcatgccaccacacccacctgtattttttttttttttttttttttttgtatttttagtagagacggggtttcgctattttggccaggctgatcttgaactcctaaccttgtgatccatccacctcggcctcccaaagtgctaggattacaggtgtgagccaccgcgcccagcctgtttttatcttttttattttttgtttgtgttttttgagacagggtctcaccttgtcacccaggctggagtgcattgtcgcgatctctgctcacttgcaacctccgccttctgggctcaagtgatcctcccaccacgccctcctgagtagctgggactacaggtgcatttcatcacgctcaggtaatttttgtatttttagttgagacaggatttcaccatgttggccaggctggtctcaaactcttggcctcaagtgatccacccgcctcagcctcccaaagtgctaagattacaggcatgagccaccgcgcccagccttccgcaaaacgtttttaagtgtcaaatttttaatgctaaaagagcagttacccagcatcaatgtgttcattcagagaaataaacaaaaatttcaaatgattttgtttgctttgacttataataatttgggctgttttcaaaatttcaacttaaatataatttttttaacttttattattatttgagtcagggtcttactctgttgcccaggctagagtacagtaacatgatctcagctcactgcaacctctgcctcccagattcaagcaatc

SEQ ID NO: 27845 - DNA, 1029 bp, Homo sapiens
tgtgggactctggtgaagcaccatatttggatgagaagagttgtctgttgagtcagttgagcatgaggtgcctttgggacttgtggcttctggagtccataggagaacttgggctggaattggacattgcagaggctttgggtccaagccggggtggaggcggtgttgaagcagctcagagatgggtgagattaaggaacagagtgcagaggaatgagcagatgacagaggctgagcccaggcgagcactcgggttcaggtggctgggtaagggaagaggacaccaagaaggaaggaccagagaggaaagcagcaggggggactccctggggcccatggaagagagtttccaaaaggacacagtggcagtggcagggagctcaggggaggtaaaagttgattggtgaccctggacttggccttcagggccgtttgtcagtttttcggggatgcggaggggtgggtcaggagcaaggttgatacagggtctatctgtcaagagaggagagtcaacaaaggggggcagaattttttgcttcattttggttttaataaaagggcaacatttgcatattaattttcccaaaggaaggtacctgtgggatatgagttactgtggagcagaggcaattagctaaatgaggcctccaaggaaatgaggccacatggacgagagggatccaccctggcggtaacacacatccaacctcctgggacagcgctcgattggccttttactgagtaatctgcgtcccactttctgtctgggaacttgtatatgacctttgtgttttaactgtgtctccctttggcaggaatttcatcccactccatggccaggaccctgtctcattcgttttggaatcctccccagtctggagcagccaactggggctgttgaacaaatattttctgatttgaaataaaatgtctgaaatgggaggtcaaaaatttttagccaaaaagagtttgtgattatcgaaacaaacaaattccgtgtgtttgcttaattttgcacggcagagtgaa

SEQ ID NO: 27846 - DNA, 1027 bp, Homo sapiens
ctccctcggaaagcagctttctgttttaggtcaagcccgcttaagagtcacaaacaggcctccctctgaaagatttgtggccctttccagcagggagcctgcagcccaccccttcccaaagtgactgccaaatcagcattctgtcaccccacagtgcttcctaccttgccaggcaaccaccccctcttcctgaactgccttttaggaaaatgaaaagtagataccttttctggaaaagagtaggggcagcaggccttagaaaaacacacaattacattggtcactgtggctcagtgtgaaacggttgcccacatggtacctagtgaccacaagacaccataaggcctaggtctgggcttctttaggaactggttcttaccctgctgtgggccccagtttccagagaggtaaaatgtggtctttggagcagacagtttttctagtcctaatatcctgggagttctttctcccaagatctagggtcttcctggacccatttgaggatgttagctgggctctgagtaggtggcagtgcactttcaggatggcatgggctttatgctttagtcagtgtaccatgtgagcccaggtatttcctctgtcaggaagcttccctggatttcttctccctggggatctacttgactggagcgtttcactcagccttctgttgagtgctactgctagtgttacgcagacttccccttctgtagcgactgagttcatgggctcctcttgtctcccaagggggcctgcattgtcagtcatttggctggtatttggcagaatcccatgcaggaataggccttgagactacagggtggacagttcctgccattagggagccctccaggctaatgggaaagggcacaacattgagcagataatgccagcgatacacaaccgtggactgtgtcagctgctagaagagaaggtctaagaggggacccaatgtaggcctggaaggattgactttcaggtggagacctgaagaacaaatataaaggtttgagcagtgaagtaatga

SEQ ID NO: 27847 - DNA, 1049 bp, Homo sapiens
ttagctgggcgtggtggcacatgtctgtaatcccagctacttgggagcctgaggcaggagaatcacttgaacccaggaggtggaggttgtggtgagccaagatcacgccattgcactcccgcctgggaaacaagagtgaaactcagtctcaaaaaaaaaaaaaaaaaaaagaaaggaagaaaagaaaattacaaagaacaggggagggagggagggatggactagttaaatgatctccagtacatttatataacaaaatactgtgcaacattttaaaagaataaaacaggatgtaagggcgatctggctgcaatatccatcaccccattgattgccagggttcattcggctgatctggctggctgggcagttgtccccttcctccctctccactccatgtgtgtccctcctgaagctgcacactctgtcgaagaggacgaccatccccaatagaggaagactggtcttcagtcaagggtatataagtagctgagcccccctgctagaacctccaaacaagctctcaaggtccatttgtaggagaacgtagggctccaagcttccaaggctccagacacattcaaatgaggcactacctgtggtagtctgcctttgaaagaataaaaaataaaatagcaatagctatcagaattttaaatgcacataccctttgactcagcaatcctgcttttaggaatttacttgccatgatcaaagatgatgaataaagtgtttgttgatgcattgtttgcattaatgaaagaatggaaacaacctaaaagtccatcaagagagtactggctaaataagtgcctcataaacatgggtagtgtaccacatagcctttcaaaataatgaggtagttctttgtatagctccaagatacattattaaagaaaaagacaagcagcggccgggctctgtggctcatacctgtaatcccagcactttgggaggccgaggtgggtggatcacccaaggtcaggagtttgagaccagcctgaccaacatggcaaaaccccatctctactaaaaatacaaaaattatc

SEQ ID NO: 27848 - DNA, 1840 bp, Homo sapiens
cagtattacttgggaacttgtaagaagtgcaagttcttagccctgtcccaacctactacatcagaagttttggatctggagccagcaatctggcttaacatggtctccaggtgattcgtattcatgctaaagtttgggaaatcaaaccatgttagaaatctttgggaatcagaagcagctgctgcaattctaggctgcaaatctggtcactgacttgtttccaggtctcttagtttgggcccttcctaagctgctgtcagtgcctcccctctcaactcactcactgccctattttgtccctgtattcgaaagtgatcgtgggctgcctttgccctggtcattgatagtgcagggagaggaatcaatgaaagcgcttccccgtgtttgaagggtccactcctatcccttccaaactctggagctttcgtacatgcctttattctcaccagtgatgttacctcctggtacctggttgtcgtgccagacccctgtttacctcattagggatggcaccaggttcaacaggccggagaagagacctggagccagtgaaggaaacagggtttatctggggaacttgagggcagtcagcagtctagtggtggggggctggatgggggcacctcatccacttgtaaaatgcatgcagattatatagcaccttcccccagtaacctccacatggcaaccctcgtttcctaagaagctattgttacatgcatctaccatacactggtgctgtatggttcattgagtgtcccttgtgcctagcatgggactcagaggctcctgtcaaaggacagtgaagcagggacctgccacactgagtttatgtctctgagctagttttggagccacagtagtggttaccccttcctagagctccccccagaagctctctctgcctccccatcacactccttcccacctctcagcactggtcacactgtctgggaattgttggtttgcttctcctgcccactgtgctgtgagcttcctcagggcagtgcctctgtcttgtttcacatggtgcctggtaactgacatgtagcacctggacaaacagtaaatgagaagacacattgttgtaaggtgacaaggcttatcccattgagcagtgctggggttaaaaatgtcctagaacaagccagctgttacagtccaccttcagtcctggctgtgaggagcgtccatggtctaccagaggtggattttccttctggccttagattaaggtggcaagggctagagtagtaatcgggggagacaatatgctataggtatagtcagatgtatgaatgcagctcttacacactagatggtaggtgcggggctctcccaccccacctgttcattacccatcccaggtctgtgctgatcactgccaggcatggcctgctccaaaagccttcttgccttggcatcctttttttctttttttttttaatttttttttttttgagacccagtcttgctctgttgcccaggctggagtgcagtggtgcaaacacggctcactgcagcctctgcctcctgggttcagtgattctcatgcctcagcctccgagtagctgggattaaagatgtgcatcaccacgcccagctaatttttgtatttttagtagagatggggtttcaccatgttggccaggctggtctcgaagtcctggccttatgtgatacaaataattgggacagcctcccaaagtgctgggattacaagcgtgagccaccacacccaacctgtttttaaaatgtttattgtctatatttgagtttacaacatgatgttatagaataatgggacagatatagatagcacagtggttactatggtgaa

SEQ ID NO: 27849 - DNA, 1032 bp, Homo sapiens
caggttgcccctggaggaatgggtggagttgtaagatcaggaataaagctagagagggaggaccaaggggaagtcactgatgcagccgccgtctagcccatcccaccccgattgagaggtcgctttttcctgttgaacatgttggatagtggaatgtgttataagaagtgatatgtgtggcttcttgtcattgcaggattgtcagctgacctctgtcctgtgtgcccagtggccccaggtgacgtgtcttcaagaagaggctgagctgcggtgcttgtaaggtatgaatcctgggtgcttctctagagaatgcactggtgttcaggctgcaaggacgaaggctttgaggtcactagaggggaggcagaggctgcttcccattgcttgctcttccactgaggcccacagggacatgtgacaccctcttttcctcgaactctgcgactccactgtgtgaatcacggtggggcttacagagctccccttgggctctgagtcatcctagtgtggattggcatagtttgttgaagtgggaggagtactgcattttggaggcaggcagttagctagtggttttctctggacttggtggcgatccttgttatgaagtgatttatggatttttttttttttttttttgaggcagggtctcattctgtcacccaggctggagtgcagtggtgcaatgatggctcactgcagcctcgacctgggctcaagtgatcctccacctcagcttcctgagtagctgggaccacaggtacgtgctgctgcacccagctaatttttagaaattttttgtagaggcggagtctcaccatgttgcttgggctcgttttgaattcctgggctcaagcaatccttccaccttggcttcccaaagtgctgggattatggatagtaagtccaggcctggccgacgtgtggatagtatcacacaatccctgacttcctaatccagtgaattctcaacatttcacccagagttgatcttccatctcattctcttatgagggaagcatttgagtagtg

SEQ ID NO: 27850 - DNA, 3549 bp, Homo sapiens
tctggcaatccacccgccttggcctcccaaagtgctgtgattacaggtgtgagccactgtgcccggcctatttttttatttttatttttattttcttttgagacggagtctctgttgcccaggctggagtgcaatggcgtgatcctgactcactgcaacctccgcttcccgggttcaaatgattctcctgcctcatcctcccgagtagctgggattacaggtgcctgccaccatgcctggctaatgtttttttgtatctttagtagagatggggtttcaccatgttggacaggctggtctcaagctcctgacctcagatgatccacctgcctcagcctcccaaagtgctgggattacaggcgtgagccactgcacccggccagcccagtctttgagaagagccccaggattctcaatatttctgcccatgtttgccttcctttctgcttctggcagggagtggtaagtgatctctgggagtcagaagcagcatctgtaatcttaggctgtaagtctgctcattgccctgtcagctgttctgttccaggtgagaccattgcccggaatgccagcattggcctcctttctgggcttgccctctgccctttctgcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcaggggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggtagggcataattgatttttacagacgtgaccccatgatcctgctctctagtccccagatttttccagggcttttgtcagaggtgtttcccctttgattccccttggtggttaggttttatgggattttacaggacagatggcagctgcaggagtcttgtactgtccctgacttgggtcatcccacaggccctggcaccatcctcctgcccttcctggctctcctgtctgtttctgctcctgcatccgaaagtgatcataggctgcctgtgcctaggtcattgatagtgcagggagaggaacgctgaaagaggttgtccccgtgtttggagggtccaccctatcccatccgaaccctgaagctttcacacaactcctgttgctctcctgccagcccttgaggagtccggcgcttgcttggctgccacatgaaagtcagtgcggggggacatcatgcttaagtctttctcagcttgacctctctttgcagaaaccaggctctgtgttctgaggggtagatcaggaagggaatgtgatatgtaatgagtcatggtgtgtcgcagtggatagcacagtttcgaataagtgcaatattggcatataaacatgagggagactttgaggttggggtgagcagggctgaccccgtgtgtgtgtgtgtgtgtgtgtgtgtgtgtgtgtgtgtatgtgtaacttggggacaggatagggtagcatctttacatctttacatgtcattggcctggaatagggggtcctgaagggtttgtcgtaagaaagagaaagtgctcattgctgcaaggggagcacagcc

SEQ ID NO: 27851 - DNA, 1079 bp, Homo sapiens
gtgccgctgcttctgcgcaccttggggaaggacccttctgtgggacgcagtagaggggacagtcaatgagctcagccagttctgagttctgagaactgtctggcaaagcgggtgcagagcaaagcgtgacttaggagacgggctgcgcttggggtcacatgctagctaagttccttcattcccctgaggttgactttctgtaaagtagggaaactgcaaaggctctctgagggcagaggccttggctgtttttcttgattttgaacccacggtgcctgtccacgtgtagatactcagaactggtgggctgaatgtacagccgaggcatttttaccagaagtctgttttcctgtggactctgggtggggacagatggaatctgcctgtgaagtgatgatggctctcagggtcctgggtacccttctcttccctggggggtgagcctccctctggagatctggcagctaacacgctgacgtgggctcacctgcccttttttgcacctgtattcgaaagtgatcgtgggctgcctgtgccctggtcattgatagtgcagggaaagaaatcgcggaaagtgcttccccgtgtttggagggtccgctcctgtccctttcaaactctggagctttctcacacctccttctcaccatctttcaaatgcctcctggcacttggtgtcttattagtgagtgctccctgtgcaaggctcagtgcagggttccatgaggcgttcaccagggtctatgaggggtgagtccctgcctcaggattggtggtgaaaccacagctgcagcccccactagtcacaccctgtggcaattactggcttgattgtctttgcctctctctattgtgaccttgaggacagtgtcttgagttttgtttaatattttattgtatttttttagagacaggatctcactctgttgtccaggctgaggtgcagtgtgcagtggcgtgatcatagcttgaactcctgtactcaagtgatcctcgcacctcagcctcccaaatagctgggacagacagggtctcgctatgttgcccaggctggtcctgaactcctggcttcaagtgat

SEQ ID NO: 27852 - DNA, 1033 bp, Homo sapiens
atggaaagacatcccaagcttatggattggaaaaattaatattaaaatggccacactgtccaaagcaatctacagattcaatgcaattgctatcaaaataccaatgtgattttttcacaggagtagaaaaaaaccctaaaatttgtacagaaccacgaaagagctaaaatagtcaaagcaatcctaagcaaaaagaacaaagctgtaggcatcacattacctgacttcaaaatatatcacaaggctatagtaaccaaaacaacatggtattggtataaaaatagacccacagaccaaaggaaaagaaaatagaacccagaaataaagccacatatttacagccagctgattttcaacaaaggtgccaagaacatgcaatgaggaaaggacaccctcttcaataaatgatgctgggaaaattagatatccataagcaaaagaataaaactggacctgtatctctcaccatatacaaaagttaagacagattaaagatttaaatataagaccttgaattatgaaactactagaagaaaacagtgcagaacacttcaggacattggtctgagcaacgattttatggctaagacctcaaaaacacaactaaaacaaaaatagacaaagggaactatattaaaaatcttctgcatagcaaaggaaataatcagcacagagacaatatgttgagtgggagaaaatatttgcaaaactattcatccaacaaaggactaatatctagaatatataaggaattcaacaaaaaatcatattaaaaagtgggcaaaaggtggggcacagaggctaacacctataatcccaacactttgggaggccgaggtaggtggatcacttgagcccaggagtttgagaccagcctgggcaacatggtgaaaccccatctctacaaaaattagtcgggtgtagtggcacatacctgtagtcccagctactcaggaggctgaagtggggggatcagttgagcccaggaggttgagactgcagtgagccgtggttgtgccactgcattccagag

SEQ ID NO: 27853 - DNA, 1032 bp, Homo sapiens
atttatttttatatatttatttatatatattatatatatatatacccctaacagagctccaaaacatatgaaacagaaatgacagaattaaagggagaaagacaaaaatagttggagactttaatattccatgtccgataatggatatagaaaccagacagaagatcaatcaggaaatagaggatttcaacaacactctaagcaaattagaccaaatagacataagcagaataccacccaacaacagcagaatacacagtcttctcaaattcacatggaatactctccaggataaaccgtatgttaagccatgaaacaagtgttaatacatttttaaaaactgagattatacagagtacattccagttacagtggaatgaaactagacattgaaaataaaaaagtggaaatacacaaataggtggaaattaacacactatttaaaaactaatgggtcaaagaaatcataagggaaagtaaaaaataccttgagacaaatgaaaacacagcataccagaacttatgacacatagtgaaagcaatcctaagaggtaaatctgtagctgtaaatgcatacattaaaagagaacttacgctgggcgcagtggcttatgcctgtaatccccacactttgggaggctaaggtgggtggatcacctgaggtcaggagttcgagaccagcctggccaacatagtgaaaccctgtctctactaaaaatacaaaaattaggtggacatggtggcaggcacctgtaatcccagctacttgggaggctgaggcaggagaataatttgaacccaggaggcagaggttgcagtgaactgagaccgcaccattgcactccagcctgggcaacaagagcgaaactccttctcaaaaaataaaaaatctcagtcgagcatggtggcttgcatctataatcccagtgctttgggaggccaaggcaggaggatcacttgaggccaggagtttgagacctgcctgggtaacaaagtgggatcctgtctctacaaaaaagtaaaaaataagcc

SEQ ID NO: 27854 - DNA, 1039 bp, Homo sapiens
gcggaagttaactcttccccagtactctcctgagtgtatcactggtgagtgtgggttcatgcacactcactcacatattgcaggaggaaggctgagatgcgaatagggagatatatgtacttcattcctgataaatagttgttggagttttatattttgcaccatcacagccactctcattttcaggatttatgattgactttattgcgttttagattagagaaggctcaggtactgagcactattcctctcctttccttttgcttcaccttgatgctctaaggtttctcaaagacagaacaagtatcttcagaagcctcccaatgcatcttccatttggctgtcaacatctctgttctgctgccccccaccccaggacaataatgtgaaaatgaagagctctgggaaaatacagaactttattgagcaaatccagttggtcccattagttgggcagcataagattggaaggggatttgcagagaaatatcctggctgtaatgataaggctgatcaacccagtgaataggacttaatcttacctgtcaagggaaactgatacttcctgatgaaatattaacagcattcaaaacagtactcataaaggaaacattttagaaactgtcctgggccgactaaggtagagccatagccctctattgttccagggggcttagaccctgagtacctgcagcttcattctgctcagacctggggcagtacccttctctggatgaggaacctagagttcttccaacagaaagggataggaaaggtataatagcttccttcccttttggacaagtaaaataaattttaaatttgacctgttgaattcacttgaaaatagaggaaccaggaggttatcagaaaggactagggagtgagcttgagaggaagataatttgatgacaggatcaaaaaaggtaaagacgaattgatgactcctgtgatttctgctgctctgccagcatcataggattgtggagagcttaaacaagaaaaagtgtatacccaaaagaataaaaaataagatccc

SEQ ID NO: 27855 - DNA, 1125 bp, Homo sapiens
gaggagctttcagatgatcatctaatcccatgacgttagctgttgctctccacactgcccggtggctccagtctgaagcatctaggcagtgctgtccaacagaaatacaatgagagccaatacgtgataagtgtcctatgggccacattgaaacagtaaaaaaaaaaaatctaagaatatatttaacccaatatatgcaaaatattatttcaacatctatttaatattaaaaattgttaatgaaggcatatagaccaatggagtagaatggagagaccagaaacaaatcctcacacataaggtcaaatgattttttacaaggatgccaagacctttcaatgggaataggacagtcttttcaacaaatggtgctgagaaaactggctatctaatggaaaataatagagttggatccttaccttacaccatatatataaaagttaactcaaaatgaatcgaagacctaaacaaaagatctaaaactataaaatgcttagaagaagacagaggagaaaagcttcatgacacttgcaaaccatatatctaataaaggggtaatatctagaacatatagagaatttctacaacccaacaaaaacagcaaaaaaccccagacaacctgattaaaatggtcaaaggacttgaatagacatttattcaaagaagatacacaaatgaataagcacattaaaaatactcaacgttaatataattaggcaatacaaatcaaaaccacagtgagatacagcctcacacccattaggatggcaactctgaagaaaaaaaaagaaaataacagatattgccatgaatgtggagaactcttgggaactcagtgcactgttggtgggaatgtaaaatggtgcagctgttatggaaaacagtatggcaattcctcaagaaattaaaaatagaatcaccatgtgattaagcaattccacttctgggtagttacccagaagagttgatagtagggactcaaagagattgtatgtccatgttcatagcaacattattcataataggcaaaaggtagaagcaacccaagtgttcattgatagatggataaaatgttgtatatacatacagggggatattattcagcctttaaaaggaagtaaatcc

SEQ ID NO: 27856 - DNA, 1050 bp, Homo sapiens
aaacaatgaaaatgtggtttttttttaataagcagaagaaaagtaaaattcactgaacaaacaaaagtaatcagagttgcttgtgtggcagaaatagttaggggaaatcatatcaactaatctcttggaaattttaagcagagtgagcaggtttgtgaatgagggagccagtagtccttcaggaaagctttgaaagaatttgcatcatctcaaactacctcaacgtgttaattaactataaagaaagaggtcataaattggtagtggaaaaacccagcagaaaccaccttaaccaagaggtcaagaccaacaccaccagcaataagacatatcaacatcatgagccccatgatatgatgtattaagaacacaacatcatttctgtggtatttttgccaagaatgcataacctcagagtaatcatgagaaaacatcaggcaaacccgaatcaagggacagtcaacaaaataactgtttaatactcttaaaagttgtcaagaacgtgaatgataaggaaagaacaaggaactgtcacaggctgcaggagactaaggataaataacaactaaatacagcggggattctgaataggattctggaacagtaaagggacatcggtagaaaaaaccggtacgacttgaataaggtctttggtttagttaatagtattaatattaaagttctggttctggtaaatatacaatggttatgtaagatgctaacactggggaagctggggccaggatatatggaaactctgtacgatttttgcaacttttctgtaactctaaaattagctcaaaatgattttttaaaagaaatcttggctaggtgcagtggctcactcctgtaatcccagcactttgggaggccgaggcgggtggatcacctgaggtcaggagtttgagaccagcctggccaacttggtgaaacctcatctctactaaaaatacaaaaattatctgggcatggtggcgggtgcctgtaaacccagctactcaggtggctgagacaggagaatcacttgaacctgggaggtggaggttgcag

SEQ ID NO: 27857 - DNA, 1034 bp, Homo sapiens
aaaatcctcagccgggagtggtggctcatgcctgtaatcctagaactttgggaggctgagacaggcagattgcctgagctcaggagttcgtgaccagcctcagcaacatggtgaaaccccgtctctagtaaaatacaaaacaaaaattagccgggcatggtggcatacacgtgtagtcccagctactctggaggctgaggcaggagaattgcttgaacccgggaggcagaggttgcagtgagccgagatcacgccactgcactgcagcctgggcaacagagcgagactccatctcaaaaaaaaaaaaaaaaattcctctaatgcttctgtttgtttctcaagattattagttgtgtatttagtttttatttttatttttcggtagcacagaaagcaatactgctctctattcttttttcgtggtctataatttcttatgtaatgattttgttacattttccaacttcattatcattatttcatagcctatcttgcaaacagaatgttgtcggattttgtctgtttaacttatctttgaaggttctatatcttatatgggaatttatactctttaatttattattgctattgtattatgttttctgtatattgtatgtttctttgtttttgtatttgttgtttcttctccattatgtcttctgtattacagaacattctttgctttctttagcttttaaacaaattttaaaggtgaacaatctttcaaatctcttagtgctaaacatatttttctgaatttatttactaaaatcaaagcaaaagcaagaacttgccttttcttccatataaggaaatttaatttgccccttttttggcatcttctcttcctattccttatctaccctatctctccaatttttttttcaccccttaatgtttgttctgtgaagtgtcttaattcttctgagcctcagcctggtactcataagtattttgctattttttgattcagttagttaacaaccactgaggtctcactctgagccaacagatcctgagctgggtgcaggaga

SEQ ID NO: 27858 - DNA, 1034 bp, Homo sapiens
gtcacctcttcttcaggtttaagatccttcagttcagccattcttttcgatagaatttccagatccctttccctccttgtttctcaccaaactgtgtgaccacagttcactgtcagtcacttagaatgtgtgaccagacttatagctagttctctagaagtggtctgatttgtagcagtatactcaagtgtgccttacttttttttttctttagcaaatctctggttgtttatattcttttacgtgatcagctgtcaagcctggtctcttccaagaggtgcttttgcaattgtttccttctagtttagtgttacttgggatttgatgagggttcttcaatatccttatgtgactcatcagtaaaaatgaggaacaggaggggcccaaggaagagttttgtggaaacctccttccaaactgacaataatcctctaaatccatgcttttcaaactgtgatgtgcatacaaattacctgggaatttggttaaaatgcagattctgattcagaaagtctgggtgaggcagagcttctgcctttgtaacaagttttctctaagcttgtgctgatgttgtgggtctccctgatcatcttttgagtagcagggcacagttcttggggaaagttgttcatgaaagcaaatcctttggtatttgggtagctgtgctgtacccatcagagcccccagcagatactatctgatgccggtatttgacaccctataatcaaacgtgcgtctcccatctcactaggtagatgaagaaaacaacagcagggctgtcttgccagcttccaaatggtggcacacctctgtgtatgttcaattggaccttttattctagccagacaagctgttacccaacatacttagtatcttttcaagtttcttgtcatctggacatctgataaagtggttgtgtatactgtttttttgagttattaatctgagatactctcacataccagaaagttacagaaaagagacagtcaacagttttttaagcattggctagaaagtacagtgttactgataaa

SEQ ID NO: 27859 - DNA, 1023 bp, Homo sapiens
aggctgaggcgggtggatcacgaggtcagaagttcgagaccagcctggtcaacatggtgaaaccctgtctctactaaaaatataaaaaattagccaggtgtggtggcatgcgcctgtactcccagctactcaggaggctgaggcagaggttgcagtgagccaagatcgagccaccacactccagcctgggcgacagagctagacttcatctcaaaaaaaaaaaaaaaaaaaaaaattcatgttctgctgttccagtccttagtttatattattgcttttgtctggaatttgggatgcgttttccctgtagaaacaactcaagtaccaaagaaatgaacataataccttattctcatatggaacttgactcttttcaaaccagttactccatttatttaagttgatcctcacctcaccctgtcttcatttgagggctgaggaaactttaggccctccctgaaagttaaaggacttgaccaaattctcacaaccactagatcacagagctaagacttgtaattctctagatattccggtattctttgttgtagtcaagtattcttttcgtagtccagacaatagagagtaattcaggtgtgggtttatgccccttcctcccagcagtagctcatatgaagaggccagcctctgaaagccactgacattaaactggacatgcttagctaatcaattaggaggacactggagggccatggcagaatcaataaaaataacttaagcgctcttatatattagagttaaactctggaattacttttgtattcatttacaaaattaacacatttatgatttgctcttcatatccttaaaacctggggtatagaatatcattaaaagcagttgaaatggggagtggatttccccagattctgaggtggacagattataaacggattcacctttacttctagtctgcatgctaaaaccacacacacatagagggatggccggcatctgagccaggcctgctgcccaccctgcttcacgcttgctccctacctc

SEQ ID NO: 27860 - DNA, 1034 bp, Homo sapiens
tcaaacagcactgcaacaagtgagtgtccctcctccccataccctggtggcagcccggctcagactgcttcgattcctgggaaccccacagggagagcacttcatgctcttgtgctacttctgtgcaaggtctagaaagacaggatgtgttatctgtggtctaagctggctcagaattcatgttacagctcctataactcctttaacagtacctctgctctcccgcagaacctggcccctctgccactgcattgtatatacccctgaggatttttctattttgactctcaaaaaccagtcaggtcatcctctgcccctgaggtcacattaacaagggcagaacattgtggccttggtcgctgccactctcagccacctcttccagtttgctgttgccattcatggccttcagttatttgataggcatgcatttgagatagtatgctttgtatctgtaggctaacagctggggtcgggtgggatggagacagcaaaaaaaaaaaaaactgattgaaaaacaaaactttgttcatatttagtttagtcttggggacttggggcattcagcgacaaaacaatggcaagtttgcatgtggatatttgcaccactgtgcaatgtatctgacccttggaaatgatctaattcatgtcaaggtcatgcaagagttatcttcccagcattcctggtaggcagtgtgagggcctccggtcgcacacctctggtaatcaagagtttattactttataggttaagagcttttgcttgggttttcccgtctccctataacatcttcttaatgattttgtagttgttgggttgtggggtgttttgttttgttttttttcttttacagataaagtataatcctttcccttgatcacctcaaatatttgaagataagtctcatgcccaatactgtaataaaaactaatgtacacaaaagtacaagctcttcagagacagcagtaagcactcaaagtgttgttattattagtactatattattttaggcatgaaattgtcatcaaaagaa

SEQ ID NO: 27861 - DNA, 1097 bp, Homo sapiens
atgcatatgttgctaagtataatacttcaagttagtcatgcagagagtcatggaattccctcttgtgattgatataaagagaaccagattcttaattagaaccagaaaagggtgtttgggaccccatttcctgttttttttgagaagatcacatttatcatgggatcattttttttttagttgagaaatgacctcatttacaatactaatatacatatttatttaataatgaataaatcattgttcttctgcttgtttggtacatctggaggtttttaaagatacaagctctaactaaaatataaagatgtcaaaagtaccatcttcaatgatgcatagttatagtggcttgtgacatctgataataaccaacatcctgaagaatgttagggaccttggatcatgtgctgagctttatttcagagctgcctatagaggactgtctgcctgccctccccagagtatcgcatctgggatttcactagctgaagtttgttgcccacgtcctttgttctaacatgtagttcatggaggaactatgcactgaatcacaaaaaccagatttgaggctgtttttctcctatacattttccactttgtgagtagcctttggtgacctgtccaggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggtacagggccttctctccagagctgttgggggtgggagagaaaaaaaaatgtttattctctgaaacccattagcagggcttctgtttctctgaatgcaaatcctagaaattggctgcacatttagtctgcgtgactatctaaagatatagatccttagaggaaggaagtctgaatagggagtcagggactataccaagaaaataccactcctcacctttgagagctgatctttaacagacagaataaacactcctattctcagttggctctgtttgcaaggactgctctgaa

SEQ ID NO: 27862 - DNA, 1067 bp, Homo sapiens
ccagtacttactgggcttcttagtgtttgggccgctttagtactaagtataggaattctggtgtcattttcagccatgaggttaggggaagaatgtgggcagggcatgggtgggggcttccatatccagggattctggcactgggtgagtcccttatgggcaaacataggattcctgcttagacttacccctttctctgggcccagtaacttcaaatccaactcaaacagcctggcctctgacacaggggacccattgcttgcaattctggactccaggatcaagatcacggggcaggagcagaagtccaaggctccagacttgctctgccactaactcacagaggagcaagggccacatgtcttactgctctgggccaagataaggaaggacctggggtgtccagtgatacctgcagggctcactcacatggcatggccacctcttcctctcagtgtcagtaatcacccctctgcttgcttactcagggagaaaaaacattcccgctaaaagagactaggacttctggaaacaaaatggctgaagccaggtctggacaggaaatgtacaagaggagtgtggaatatgttgaaagcaagggaactattgaaagactaccagtctttgatataacatacaaacataaatgtacacatatccatacctatttctatatctgtgtgagtatgtgtatgtatatgtgtgtatatatacatatacacctaaccatgagttcatactgataccttcagtccattcaaatactgcagagttgattctcgtcttccttttttccacatttgactaggtcatgttgaaggaactcaggagccaacttagagaggctcccatgagccaaatgtgaacagcaataagaataataactgcagtgcagtaaaacatggcagatatatttaagtgcatgccttcattgtatcccataaagaagtaataaaaaaaatttcattggtcactttttgggatgttattttggaaactgattaaataaagagaatcaaatatttagcttgtccctcctatatgaactgtacattagggtagcccct

SEQ ID NO: 27863 - DNA, 1049 bp, Homo sapiens
gttctccattgaagtcatgattaacgcctgggctttcgttcatttgggtcccctcagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggtaaccactaggatgattgctgtttaccttagctgccctggatcccagaacatcatgatagggcctggcttggctacagagcatccgtgatgctctatgctatggtgtcagctggatgacaggcttagggccttggtcagggggtgaaactgaatgaaaagtaaatgtcgacccttccaactaattagagagtgtggttctttccgttaaatcaaatgatgtttcacagtggtagcctccagatatagactagaactactaattattattattatcagaaataaagatactaatcttgactaatgctctaattcttgatatgtagacgattcgggcattttcactcagtttgttggttaagatggtcatgtgtcatgtacagtaaacgagttaacccagaggggtgggaaagttccatggtgtggcaggggcaacagtggcagcctcactagttcctttgttctccacacagtgcaacacattagagtttatatgtgtccagttaagtggctttatggattctattttctggttttagccaaactaaataaccggtggctttaaaagattactgcaaagattggagttgatatattttttgaaagctaacataaacaagcaagaaaatggcagggtccagtttggagttcttcatcaaccctgtttcaaagtaaaaacaatggcattctaactatatgggacgcgaagtcagccaaaaagattctaacttgtcaataagacaatatggaatatagatttacagccattatcattaatgaagaacttcatcttaagt

SEQ ID NO: 27864 - DNA, 1033 bp, Homo sapiens
gccaaaggtaacctccaaaaaatcactttgaagatttcccaagtagagtatcttcttctttacctgcaaataagggagcacgtttctgccggtattttcctattttactgacaaatatttgagaaagtatttccaggctacctaacccccagcttctgtctgggaaaatctagtagcgcctcaggcttgacttggaaagtgcttcaccatgattcccccctcctttcaacatttaacatgttgctcaaaatgcacacaagtctcctagtgaagtgtcatattttgaggaagttctattccttagttatgatttgggcttggtttagctttgagtatgatgttccacagtgaagcacatgattctagcatgtgggcacgcgcgcacgcacacacacatatacacacaataaatatttaaaatgaaggttaaacatatacagacagtgttctaatataatgaagttacgtttagtaagtagatgaaattgatttcaaatgctggaaagaaagatttaagattgtacagaagattcagaggccactgagcatgtgattattagggtgacttttgggatattgtaagctttctttaaatttgtgtcaaagaaacctttttctaagagagctataaaaaactatcaacatctatgaatttgtgaattttatatatttgggtcattggaatgttgctgattttttaaaccattattttgagattcaaataacattaaaggatatttgaagtttttacatttactaaaagggagactgggattttagaaaaaaagaggcaaaatacatgacttggtatgaaaaagtaataccctgtgactcagctgacctgagcgtaagcctctgccctgctgctgactttggggcatttgctgcttttaaatctcagttttcctcatctggaatatggggattatttgtcctggctccctcatgggattgggatgagacatggaattcataagtactttgtagaatgtaatttgctatgcagttttcttaatgaggagccacataacat

SEQ ID NO: 27865 - DNA, 1034 bp, Homo sapiens
tcactcttagaggctggtgaccataatactaaaaataacactgtcctagagaatatttatagttttttcactccctcttcataagtacagactgtgccttatctaggaaataccacttattttgggactctagagttgggcatataaattgtaaggcatgtccagtagtagtcgtgtttcaagtcacttcaacagacattttcatgcttctaaagagccctgccatgtacttcgtgctagaatggcaaatgtgatctcaggggaaataaacatgaccaatatttaaattgaagtgaaccaaagtaatagaacagtaaaaggaacatagaaggagggtgaggaggttaggaagaacttcccagaagagttaacatctgagttgggatttgaaggatgaataggagtttgtcaggcaggtaacagtcacagaaagattaagtgaaaattcctggaaaggtgggcagaggttttcttctgattttattgccagtgtgtctagatttttgatgtgatagagccttcagttgtaaaattccacttttttctcctagtgacttgaaatgccattgggatcctatgcctcaacagtggggctgggtatgtttccagccagtcatagggaggggcaaatgctacccatgcagcacctgtaggcacactgcaactctggacagaagcaagtttcttgtttgtgtgaggtgatggtggtggttagcttagctccagcccaaaactttgactgcaattgcttgactagatttttcttcccttatatgaaaatagtgtagttgattgttgttatttagaaagtatttaggcgttcagtcacaaatgtttattgagcattgatgtttggatgggggttgaggcagatgagggccatatatagaacttgggtttttgaaatacaagataaatttcagtaaatggtactaatctcaagtatactgcttgattattcttttagatatgtatatacctgtgtaactgccaccctcagatcaacatagagactgttccaacactccataagg

SEQ ID NO: 27866 - DNA, 1033 bp, Homo sapiens
tgcccaggctggagtacagtggcgtgatctcagctcactgcaagctctgcctcccagattcacgccattctcctgcctcagcctcccaagtatctgggactacaggcgcccaccaccacgcccggctaattttttgtatttttagtagagacggggtttcaccgctttagccaggatggtctcaatctcctgacctcgtgatccacctgcctcggcctcccaaagtgctgggattacaggcgtgagccaccgcgcctggctatttaaatattttataaatagttatcttacatagtgtgtccagtaattcccagtatctgaaaacctcaggggttgtaaatattgttagttttttggttttgattgattggctgttaccaatgatagaaatgaatcagaaatctatttaatagtaatggcataatggtcatttgtaacgttagcctcacagtggttctgaagctgctatattcaggtttagggcacaatatttaggcttcacaggatcggtttcagttgtatgtttgaggtgcttccctcagacccactggtcaaaggctcccaagcttagagttggaacagggcaggtgttctgtcccaaatgtttggcccaggtgattcagttaaaaaataccattatctcacctcgttctatagcttgctaataagatgatgttgaagttgttgagacacaaagacttaggcagcatgaaaatggaggaaggtgcatctcttgcaggaaatttatgagcttagactcataaagctgagggaaggtaaatttcctactgtcataaagaatctgtttaggacagctccatatcccaacatcttcttgtatattttttttcctctttaggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctggg

SEQ ID NO: 27867 - DNA, 1070 bp, Homo sapiens
tcctggctggtggacacattctgtcttcagttgctgagacagtcgcaggatagagtgactagcctgaaaggagaaccttgtggaatgggtgggtagcaggtagtgccagggtcagttctactttctgtcccagtgaggctcagatctcagcatgctcttttctcctccagagatcccagcattggttggagtcttgaactgagattctgcctctcaatgatcagcagttgccaacagtagagacccaacatgtagatgttagctagtgcgggcgctggacagtggtgcagcttgtctactggccaggaaggcgggcagggagaatagggacaggggaggatcccctagcctggtctgtggctcacagtgctagcccactggagcagtgtccacaagctgtacaaaaacaggcagggagccagatctgacccacaggctgtaatttgctggcccctgttacaaataattcagatttattttcccgtcagtcattctttctttagctgtgtgtacaagtcccctcttatccataggggatatgttccaagaaccccagtggacgcctgaaactgcagacaatatcaaacccatttgccatcagtcagagcacgtttttgttcatgtcttccacccacacatttaatgccttttccatcttaactaaggacttacatgcactgtggctgtaactttcacatttgaagtgcaacagcaagtctatcacaaatttgtttttccttcttcacaatttttcacataggagattcgttcttaccgtagatcttagcaacctcagtatacgatttatttttttcctttccttattaagtcaagaactttcacctttttacttaaagaaagctgtcttagttcattttctgttgctgtaactgaatacctgagactgggtaatttttaaagagacttatttcttacatttcgggaggctgggaagtgtaagagcatggcaccagcatctagtgagtgtatcattgctgcatcataacatggggaaggatatcacgtggcaagggggctcgtgagaagtagccaaaccggcttttataaca

SEQ ID NO: 27868 - DNA, 1554 bp, Homo sapiens
atcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataat

SEQ ID NO: 27869 - DNA, 1048 bp, Homo sapiens
cagtccctgtgccactgttttccttttgattccataggaacaccagcctcgctccggcctcttgcagtcctccctcatcaccctctacactatgtacctcacctggtcagccatgtccaatgaacctggtaagggaatgtcaataacacattcatttgataaaaagaaagtaggaaatcagcctttacatagttggtacaaaaactagagctagagcaaatgtgaaacaagcaaacaaaacttaaacgtacagtgttcactgtaggtttgtaggtatttacctttcacattttagtccccacatctattgatagctatttataactgacagtctaaagggtcagagtcctttagatggtctaggctttacctaacctaggctgagtcaaactagttaagagctgtggtcaagggctttggccctttgttgtgactgaattttagtttgatgtcacaggctgtagaagaaacagctgtaggaaatctccttttgtagttattataggattgtttctcagtaggatattctatgggcttcttttaaaggaaaacaatgcagaccccccttccaccaatgataacttatattttgttcttaagtaactatgtaaaaaccaaaatagagataaacttctgtgcttaaaaccttgacacttaaagaattaaaaagatttgtcaaactacaaaaccaataaaatcaataatgatgtttatgaaatttgacagattctgttgttgttttctttttttttcctaattctgtcattgattgtgaccaaacgtgttactactgactgctaagtttcagattttttaagtaaagcattcccatgtttcacatcatgactgaatgatatgtagggaactcctcaagttctttcttggaacaagatgagctgtaaccaaggataatacaaattttctcattttcagatcgttcctgcaatcccaacctgatgagctttattacacgcataactgcaccaaccctggctcctggaaattcaactgctgtggtccctacccctactccaccatcaaagagtgg

SEQ ID NO: 27870 - DNA, 1147 bp, Homo sapiens
gtctcaatccctatatgacctgcagaaaacagagccctcctgtcaagacttattgcagtttgatgtgagaaagaaccaagcatttataatgcaaagccactgaggttttggagttatttgttacagcagtcaacatggctaaacccaaggcatagaaggacggagctcagggagacagctgccttcctcacatgctggggctaagaggggtgcgagcagggaggagaagggcttctgtagatgtccaaatctgacccaggccagcttccaccactgtctagctgtgtgactctgggcaagtgcatgaccctttctgagcctccttaaatagttacgtgaggcagtgggactggaggctctcaccctaagtgcccatatgattatgacattcactgactccttcctcacagcagccagtggccaaagagaaagggtgtggctcccctaggggctccgggtcagggtcactgctctgtctggaatctgggctctgctgcccagaacggccctcctgatgtctggaattccaccatgagtgactcatgcctttgggaagccactgccctgaccccactgagtaataacaataacagcccctcgtggctttttctttgctgagagtttcatagtccatggtctaatctggtccccagcacacggctgtgagtaggcagtgaaggtggagagagttagaattgccatacacgatgcaggaagcaatgtgcccacagctacacagcaagttagtggccaagcctagagtcctggacagtggctttttccccaaaaaccctttgcttgaaaaggctgcctctgatattcgtgtgtccatgttcatagcagattattcacaatagccaaaaggtgaaaggcactcaagtgtccattgatagattagtggataagcaaaatatagtgtatccacacaatggaagattttcagccttaaaaaaggaaggcaattctgatacatgctacaacagggatgaagcttgaggacattatgctaagtgaaataaatcagtcacagaaagatgcatactgtgtgattccatttataggaggtatctgtcaaaagtagtccaattcatagagacagaaagtggaattgccaggggctggggagggggaaatgagaagtttcctt

SEQ ID NO: 27871 - DNA, 1049 bp, Homo sapiens
gagggaaaacaggtggaagttcaggaataccaggcaaggtcccttgctcagaccaagagtgagggacactttctgatggaggtgccatttcagaaagccaagaaaagagagggtgagagagggcagaatgttccaggccaagggaacagtacgtaccaacgcctagatgtcggacatagcatgatagcctgcttattctgggagccaaagcgcctggtatgagtggagccttctgtgcaacgggaaatggtgatgtctgtgaagggtgagacacacaagttcacatcaccaagatttggggacatctactatgtgccagccatgggggcgggggacagaaagacatgggctttgtttgtagaatttggcaaagataaaagaggtgatgtcaagggctgtctggggcccccattacctccaccagtagttgtccaaacctcaaagtgatctagctggatagcagaggttccagaatgggcgattggtgaggaagaagtgtgacttgatatagtggcaagacggggattgtgagcatggaggagattccccacgggtgctgtcccatcggaagaggcaatggaaacggaaggtgaagatgaaagtgtgggatttgattatttatggcaggaagaggtggccagggtggagatgggggtctggaaacttggaggaaaagaaacagaagggatcttttaaattttgttttattttttgggattcttgtggaaatgctaatgttttagtcagaagcatgcctagaataatttacatccacagtggatcatttttaacacccctcttccttcatagtacaaaattattttcagtaataatcatgaaacaaaacaaatatttttcatgtatgaattaaaatttgcacttaccaaacaaaatcattaccattcacagttcacactgttttactcttttaaaaactgtaaatacaaatcaaaactccaagtagtttcgtaaaatgacaaaattgaaatacccttatcgtcatctttcccatcattctgcgttcatagttgatttcactctactgttta

SEQ ID NO: 27872 - DNA, 1058 bp, Homo sapiens
tttgttccaacatgattcaagtattagggaacaatttgagcataacataaattttgcatttgttcaggtgcaatttcatccacgaggagcactgggtgaatgaagaaaactgcacccacataagaatacacaaaacacatgcgcctcagacatccacggcaccctcagtttactattataagccacacctgtccacacctggtggtacaactttccattgacttcagtttttccctcaccacctcacaatcactcacaggctgcacctcttccgacacccacttccacaagcaaactgcaggtcattttcaaggtcaaatgccatttttattgtagtatttgtgcatttctaaagcatttaacatatttaaaaccatgctttcatttttactgcattcttgcctttttctgtttttgatgtgacactgaccccattttcccataagctgtgtgatttttatagcaagattttgcgttgcacagtaatttttagaaatgtatatttcatgttacagcagaattgattgcattgtaggcttggtgagtttgtgggaggatggatggatggatgaatggatggacggatggatggatgggtggatggatggatggatggataaatggatggatggatggatggatggatggatggatggataaatggatgcataaatggatggatggatggatggataaatggatggacggatggatgggtggatggatggatggatggatggataaatggatggatggatggataaatggatggatggatggataaatggatggatggataaatggatggatggatgaagtgataggtggatggatggatggataaatggatggatggatggataggtgagcatgtagtgaatggatggacagggaacccgtaaactcctaaacctttgagaatcacataacctataatcaccacaagggctgtgcaaccttttaatttctgatgctgttgagacgagtgatccatctggaaaagagaatggagtcaaacccctgcgtgagccagttacttctttcaccatcaagaacac

SEQ ID NO: 27873 - DNA, 1129 bp, Homo sapiens
ggagcagggaggttagcaattaggagaccagaatttatttttcctgaaacaggttctctgtcacccaggctgtagtgcagcaatgtgatcatagctcactgcagcctcaaactcctgggctccagcaatcctcccaccacagcctcctgagtagctgggactacagtgtgggctagtaattttcaaattttttatagaggcagggtctcactatgttgcccaggctggtcttgaactcctgggctcaagcagtcctcccatcttggcctcccaaagtgttgggattacagccatgagccactgtacccagcctgaattctaataccaacatggcctttaactcctgcccctctttgggcttcagttgccctctgtacaataaaggcattgatctggatgatccctaagttccctccagatgaaaccatctcttattttaaggtagggcagattcctatagctccagggagaagggaaaggttagggccctcacagaagtaatcagggttgtgcttcctccacccatccttggagacacagccagaggcaacatcagtgctctggaggcctgagtatctgcagatggctctcagcccttgattttcagatggacttcaagacctggacaagggaggcatgtgaggcccaagtcactgggaataactaggccagggagaggctgaccatggaggaagaagaggcagcagtctccagggtatttatctcagagatacaggaagagtagtggctgtgggaaggggaagcagtgagccaggggccttggtgcctttcgcatcctggtttaaaataacccagtcacccagagctcttgtgtctgggggaacttcacaggcttctctatggacttggagtggacactcacactgaccaggatgtggttagtggttttagagcctggggacctggaacaggtcatggagcctctcttggcttgaggcttttcatctggaagtcaaagctgataatgcccatcttcaataaaatgtcaaagtggggactggttgagttctctccttctccctccccccaacacatccctgaggtctcgtggttaagagtatatgatgatctgttttcacacagacctggtttcaagcctagctctgtc

SEQ ID NO: 27874 - DNA, 1023 bp, Homo sapiens
cagttctcatttggggtctctcatgcagggtcagcaagatggtagctggggctggaatcctctaaagccttcttcctcgaatgtctggcagctgggctgcctgactcaaatggctgggtgatggaactgctagagcaagctggcacctctttccactttcttagcagccttttcatgtgtgctgctgtgagcttcctgagagcgtggtggcctcagagtagttggcttcttccctgtcagttcaaggctccaagagcgagtgtttccagagaccaaggtggaagctgcaaggcctattatgacctaaccttggaagtcacatcgtgtcccttcctctgtcctctgttggtcagagcagtcacagagcctgcccgaattcaaagagagagagcagatacacctccgcctctcagtggaggattgccaaagaatttgtgcctgtcttttaagttgttacaagaagatttttctctccgttaatttatgaattccatgcaatcacaaaggactagtagaattttcttctttaaattcatgataagtcagaaaaaaatgagaacaacgacatgagagaatctggtgtataataaagtctggggcaaagagagattatttaataagaggtgttgggttggccaggttagagttaaacttgaatcctaccttgcttcttattttaaagtaagttctgagtggatcacagtttggaatgtaaaaagcgaaaccattaagttctagaagaacacatggattaactatcttgcagtggggaaggtattcttatgtgaagggaaaaaaatgttacagaagtcgttaaaggaaaagttagagaagtttgatttcaaaagattaaaaacccttattaaagatgttcagctttacccacaactaagcagctaaggcagtgagatagtgttttattccatattggcatacatgaaaatttaagacccaaagttggtacagttgtaggaaaataggctctgtcaataactattcagcttttttggaaagcattttggc

SEQ ID NO: 27875 - DNA, 1050 bp, Homo sapiens
tattttctgttgtgcgtcagctttgtctttggcaagcttccctcctagtagcaaaatagctatagcagttcccggcctcacatccataccccatgcctcatgacccagagaaagaaagtctttctctgatagctcactaggaaaagataggatttttttcccccaaaaaactctagctcacatattttctcaatcattttctcaatctattctggtcttcatggtcacaggccattccctgaagtacacaccataaccggcggatgagattttgtgattaggtcaccctgaggcacctgccccacctccagaactagagggtgatgcttcccaggagcatgtacactgtgtgaatccctggagaagcatgaagaagagaaaggagatccaagcagccaaaaacaggagattcctcacctcaactgtatgaaatgaagaggccatttgtcaggcactaggaagctcttttaatgctccaggggaatggtcccagcccagcaagctagggattcaggctagaggtgcagaagggatcagagatggagccctgccatgtgtaagtgacctataggtgttaggggaggacaagagttactcaccttctacaggagaatgcctctctggtcatgggtagcattcactctggtttgtgggagcctggtaagtgttccccactcttctctaggatgaaaatgtgcggtgctaatgaacctgatggcatcagtgccattgatttcattctttcaatcagtgcacctaccattgatttcattctttaaatcagtgcacctaccattgatttcattctttcagggtcactgagccatgtgttccaagccatgtgtatgctaagcagtgtgacacagaggacagtcttggccctcagggaactctccctcagttgagggactgagacatgtaaacagtgtcttaaaacacaaggaggaggaacatgtgctttagagtcttagtgtttgaggacttcaggatagaaactgacttaagtgcatgagggagtcggggaaagactcagaaggggtggcaatggag

SEQ ID NO: 27876 - DNA, 1084 bp, Homo sapiens
ttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctg

SEQ ID NO: 27877 - DNA, 1041 bp, Homo sapiens
gaggggccctttgctggcctccttggtgaagagtctaaacaaatcccagtctcagaagagaagttggggtggcggggggacattcagctcctgccatccccagctcctagaaacagagggcttttccaaggacttggagtgctgagcctgcctgaatgaggagctggggaagccaggctgggctcccagccccatctccctgttgggagaagttggctcctagctgtccttcaacctcccggactggacaggcgagtgtgatttccaaatgaatgcttaaaattggggtaaggggctggaccgagcgctgtgagtcactgcatgctagcgtagcctgcctgagtcacccatttcctttcaaactcttggctaataggacagctctgtggtgggggtgttggaatgagctcagagttttaccttgtcctttgggagtcactgtttcagtgtccggggctcgaggggacatacaggacatgtttgtactaggtcccgcactttcacagccccttgcctgcatgtagactttgacattgtacattgtgcagccagtcctcaaaattgggctttagacctctgcagagcaggtagtacttttttcctctttaaggcaaaactgaggctgcaactggcctgcattttttcagagagcaaaagctggtactgttcaggtttggtgtgaccccaggattttctgatgtttgtgaggactcctctttgcttcctggggctggccagagggcattgaaacattggcttggtgttacacagacttaactccagacgtgcgaagtccacctcttactggctacatgaattcagtcatgctactccacctctgagccccagcctcctggtctgttaagaagatcatgataccggtgtggcgaagcttaaaggagacgacagggctgtaaataaaggcacctagtaccatgcctggtagggaggaggtgttacttagtgacagttcccttccttgcccaggccaccttcatgccagggggtcctatctctgaagattctgagcccaggtctcct

SEQ ID NO: 27878 - DNA, 1021 bp, Homo sapiens
ggtaatagaaatgtgaaatggatagaactcaaacacggaggagaggaaaaatttaccaggaaatagtcttgctcctgatcttaaaggaaaactttttaatttctcccattaagtatgatgttatctcgggatttttcataaatgtgcttttttaggttgaggaagttctattcttaatttgaggagtgtttttatcataaaaggttgacagatttttgtcaatttttttttctgtgtctattgagttgattatgttggttatgccctttgctctgttaaagtggtatattacattgatttttgcatgcttgaataacctggcattcttgggacaaattccattggatttcattatggcatataatctttttttatatgtggctgaatctttttactaatattttttgagaatttttgtgcctatattcatagggactattggtctgtagttttcttttttatgatatctttgtctgtagtactggcctcatagaatgagttggaaagtattccatcctcttctatattttggaagagtttgtaaatgattagagttaattctgtaaaagtttggtagagttctccattgaaatcatctgagcttgggatttcctttgtggaatattttttgattagtgatttggtgtctactctttacagatctattcagatttcccatttattttaagtcagttttggtagttgttatctttttaagaattcgttcatttcatctaagttatctaattttttagcatacagatattcccaggattcctttataatcatttttatttctgtatgaggtagcggacgtgtttgcttccaccaagagcatgtgccttgtccagcttaagtatggctgtcggtatccctgggcagcaacccctcctggctcagtgtggagacaggaatctgctagggctctgtagccaacttgctaggcctcagtctgtccagcactagtttaagagtgggagaatctagcttcaaactgcgcctctgcttgtgatcttgcaca

SEQ ID NO: 27879 - DNA, 1025 bp, Homo sapiens
tagtagagtgcctgtcaggcgttgtgatgatgacagggcctgtggacccactgtgtccttgtgcccactgcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaaggtgagagacctggaggctccatggcagacttttcaaaatgcagctgctatctgtttgtgggtcatagaatcctttagtgggtcttgaccagcatttttaaaatacagattagaaaagaagatactggagtgaataatatgtatgtattaagggcaagaatccttttgtgaaacttgaggtttagtcatgtgtgtttctggtgtgtgtctgtactgggtcatggtataaaatgaagggcttggccgggtgcagtggcgcatacctataatcccagcactttgggaagccaaggcaggaggattgcttgagaccaggagttggatactagcctcgccaacatagcaagactccatctctaatttaaaaataaggctggggctgggtgtgggggctcatacctataataacactttgggaagcccaagtgggaggatcacctgagcccaggagttcaagaccagcctgggcaacatggtgaaaccctgtctctataaaaaatacaaaaattagccgggtgtcggggcatgtgtctgtagtcccagctacttgggaggctgaggcggggggatcacttgagcctgggaggtggaggctgcagtgagccgagatcgtgttactgtgctccagcctgggcaacaagagcaagactctgtctgaaaaaagaaaaaaagaatatatattttgttgttgtttatatatatacatgtttgtttgtttttgagatgg

SEQ ID NO: 27880 - DNA, 1025 bp, Homo sapiens
atcttgagtgtggcagggtcggctggctcctcgcacccagcttgctttcggccccctccccttcttcccatccgtccctgctgttccttgtggcgctgaggaaggggagacagctttgtaggcctgcgggtggactgaggaaggaatgaattcactggcacgtccccgcctcagtttccccctcgagcacacacgcaggagccggatgttcgcggtgggcggtgcgcggcggggttggactgagcgtgcgcactggggggcgtgggggctgtcttagaacctgcgggggtctcgggttctgccgccggcccaggggaggcatcgtggtgacgtaggctccggacgtagcaaggacctgggtcctggcacccgcgcggctctgcctcttccagccagtctctttccctctctgggcctttgtgctgcgtggtgtccaaatgttaagaagccctgccccatgcccgggctacatatacatcgaacccaagctgtaaatgctcttgagtagaagcaacttaaactagccttcgggggcaagtaatagagatggctttcggcagagttgggaaatcaactaaatgcattgtagggcctttccaacattgacatctgtggccattagttgcagttcaaagcctcactgagccctcaaaccagctacagcgggtagcctggcagggaactggcagctgtgaggtgctcctcatccggctccctgcaggattctttttggtaggagcctgcaggcgtccgagtggtagctccacccatctccggtctccccagcaagcatcccttccagtgctagcttgagaagaggaaaagcttgccacctgctgtcagaccggcgcttgtgtggagccaggggctgtaggtaccccggctgagtagcctctcagatgtccatggtcctggctgcacgccagcgtgggggcaggcaggcggacgctcaagaaaaacggaggcaccgatatgagtagtaattgagaacgagggttcatgatcctcatctgatttcaatccct

SEQ ID NO: 27881 - DNA, 1075 bp, Homo sapiens
ttattttgagacagagtttcactcttgcccgggctggagtgcagcgtcatgatctcggctcactgcaacccctgtctcccaggttcgagcaattctcgtgcctcagccttctgagtaactgggatcacaggcgcccaccaccacaccgacttaatttttttagtagagacagggtttcaccatattggccaggctggtctcaaactcctgacctcaggtgatctgcccacctcagcctcccaaagtgctgggattacaggcgtgagccaccgcacttggcctattgtattctttagtctctatttcaaaaaggcctttttaccgaggcacatatgtatggaaagttacacatattctgcccaggtcaatgagttttcacaaggtgcacacacctgtgtaaccaagcacctgtataacccagtcaagaagcagaacattacctgcattgtctgtattgttaatttgtctagtacatatttaatatttaaatactgtcaatgtttttgaagaggtaacagatttagattgtccaaatggtttgcaagcatggaagtcacatctccctccttccctcccatcagccctccagctgcctgacctccctggggaatgccagtgttaaagcactcctattgcttcccgagccttagattgttctgtgaagtcaccaaagccgccattctggcctcccttggataaatggggcaaatgagactccgggagaggaatggctttgtctgtaggtgcacagcatgtcagtgacagagccgtgcctggaacccaggtctcctgactgggaggtcccagctctcgccgttgctctaatccaggccaggtcctactgtgctgacagaatgtcggctgttgggcggtagtatccatgctgccctctaaccacaggctgtctgtgtcatgtgactcaatgcacccatcagtggtctgtgatgagtgggtgggaggatattttggctggcctctggcccacttgtccacgtctgtcctggtgtgtcagtggctggcttgtgacctggcatgtccgtggcaggtgtggaaggagagcctctagtgagttccc

SEQ ID NO: 27882 - DNA, 1031 bp, Homo sapiens
tggtggcagctgttttggatagggcagccgtagagtttgtggacttcaatgtttatttaaacttttttctaactggctgtacagtgtctggaggaagggttgccttttccctattcacatgaaggtgctttatgagctagtggtaggtgccaggaagggtagagaaagaacttcaggggctcagggcaggaacgccaagtcagccagaggagatcaggagggctttctggaggaggcatcgctgtgggcttggaggaggagtatgcaggggtagggaagtgagctgggcaaggggtcagggctgaaagggcaggtcccgccactcactgttcaccaactttactgtcccccacagaggatagcgactataatccagctgaggatgagccccgaggccggcagcttcggctccagcgccccacccccagtaccccaaggccccgaaggagacctggccggccccggaagctgccccgcctggagatctcagacctcccagatggtgaggcttggtcttgggaggggctcgtgtgggtgggtcaggagtggcctctctccctgcttgtctctgtggagttctggggactgagtgtgccctgcagggcagctgtctcaaaccgggtcacctgcaggcctccagggaaaggggaaagccctcaaagactcaagctcaagaaaccctgactcaggaaactctctcagctttatggaaatgcctttcaccacaatttgtcatagcaaaagagaaatttgggactttatcactgaatgcgtaagataagttttaaatattactgaaatgagaagagaggaataagtctgaggcctgggactatcagaggagccctggttcggagcattactggctggggacagaaaggacccagccgtggtgtgagcaccagctctgccgcctgcagtctgtgtgacttggagcttaaatctccagtccctttatttatgcatggaggttatagcagcatgccttttaggattgcttaagggttaaatacacacaaaagagtacagtg

SEQ ID NO: 27883 - DNA, 1112 bp, Homo sapiens
gcagattagaataataataatattcttatctgtcaagttggcaagacttaaaaagaatgacagtactcactgttgactaaggtgtggagaaataggcactagatgatctacctctgtggaggtataaattagtatcagccttctcagggagcagcttggcagtaagtatcagatgcagcattaaaatggccacgtcctttaatccagcattacattttggttaatttataatagtaaaaaatattaatactggctgtttttaggagatagaccagaggattgattcagagtattatgacctttgcctacaagtagctcaggatttaaaatgagggtccagtccttatttcagtttaccctggtggtgttttgcagagcgtttgaaacgtgaggaacggcgtagagaagagctttatcgtcaatattttgaggaaatccagagacgctttgatgccgaaaggcccgttgattgttctgtgattgtggtcaacaaacagacaaagtaagaacccttagatatttctccccagtaaggagaagagtcagagaaattcaggctcctgtttagcacctctatccactgaatctgagctgtgtattcttgcattgctgtgcgctgttagccagggttctttcagttataggtgacagaaaactcaattcaaattgaggccaaaagggacatttttcatttaagcaaaaattaactgggaaattgaggcacagccacatccaggatcaaaccatgtcatcaaaattggtctctgtgttagtctctaagcactgttttcctcagatttgcctttgttctcaggcaggttttgtgcttgaagaggcagaatggcactggccctgaacgtgtgtcttcttagcttagcaagccaagtggaaagagaacttctctttcccagtgtttccacctgaagttctgcagttctttttagattgacctgactcactttcccatccctgagcctgtcactttggcaggggtgctgggtgttctgattggccagggctaagtcatgttcccatcccaagagctagaggtgggattagccctgtggaaccatgcagactgagagtggaagagggtgtagccgctggtcaag

SEQ ID NO: 27884 - DNA, 1115 bp, Homo sapiens
catcattcacaggggaaaaaaaacactacctatggcaaatatttcctaaagttatacctctacatttttagcgctttctacgtttaataagaatattggtataagcatactggcaagacctttataacaccttgttttgctggacttaacgtaggtatctttgggagttttacaggattatcacctcttcagatgtttcagtaaaccacagttctgctggctttgctctctattcaataatatgactccctgatgactccagctgtcagtgtgtaattctgacaatattggcccagccaagcacagaactctgcatgaggaatctctgctctggatcacatttcagcctgaattcttatcatctaactcttgagggccacttcattgaactcctgtgagtaccttgcatagttaccatgcaagttgtcaagcatcgatactaagcattagtccttcttcaaagacaggatcatgattccagttgtgccttagatatctcagttaccatcttcagctcaacaccttgacagtccagatcttgtagcatatctttatgcagatgtggcctctaggtacaagaagtaagactgtacttctgaatgacttaaagaagaacaaatagaattaacttgtctgcatccaacgctctgcagaggatttttccccatatatttgtgaaagatgttaaacctggtatctctttggtgaaagtcattgggtatcggctcatcagaaataacctggctgtagacaagtttcttatatgacctgaaatgctttctgcttatccacagggccctaatgcttttgattattgcttgctccctggttgtgagacagcccttgctctaggtgggccacaaagaaattccaggttgtgattacctctgcagtaacacttgaagaagtcatcagttctcagcagctgccacctctaccaataagaaagttctgtttgtgctggagaaggttgtcagtgcttcctaaggaaaagcatggacatgtgtaaaatttgggtctgtgaggtgtgatatctcattgcacgtccatatcctacctccacctaatggcaatattctggacaagtctgttgtctccatttctaacagtagcat

SEQ ID NO: 27885 - DNA, 1029 bp, Homo sapiens
taatttagaccattataaactttaagagttgtaaattgtgaaagtactgcatgcagtagcaaagctatggtcagatattactggccaagtcttacatagaaaatattttcaggttttttttaaaatagaaggattatatcttgtgtctgcttaattgaaaaggtaagaatcaatttaagatatacttcactatttagctttatattattttcagttttgtcagaagccatttttctagacaaattagagacttctgatttaaaatggaattgaagattaccttcatttgatcaggaactcaaaagttggcaaaatagcagcataaaatctctaccagacctctaagtttcttgttattgctgtggtctttcatgtgataggaatctggttgggatttttaaaatacataattattattttaaagcactcgaattatgtgagtacttaataccatttgatgtcattagatacactattaattgtttaatacggaaaaaggggaacaaactctactgcagcagaaagcacttttatttcttcattcatctgaagtatgaaatttgtaatgtatttatttagctttaagtcatatgaaaactgtcaggtattattttggggcatagatttcttagtacatggtatttattattcacttcaatttttgtaaagcaggtattcttggtttttagcaaagcaggctttagctatacaaatttgcttttctttaagcttatgtgattctacttttctcccatatctagttctatacgccagccttctctaatgaaaacaacttaggaggagtgttttattacctaaccctactataccaaacgccagtccttattcttggttatctgtagatgttaacaggtcatattctttgtttattaaaaataataataataattttctttcctgcatgttattctggaagattctatccagtggaattcaacacaagacacactaacaggaggccctgcttcatgggatattggaagttttaagacaatgaaatccagctat

SEQ ID NO: 27886 - DNA, 1709 bp, Homo sapiens
actctctccattgccggcatttttaaggtacagactcgggcgtgatgccagtcctgtcttagagagggagcccccaggggtttctcaccagcagcttcagtcccagctcctgcaccccagggccctgcagagaagagaaggaagtgccccattaggtgccaggcactttgctgagtgctgtgctggcccctccttctgccttgaccacagccctgtgagagggtatgatcactcccatcccacagacagggacacagatggagagccgcccctccccaagggcacagcaggggcctcaaagccagctctgactctgctaggcctggaatgcattcacattttaccttgactgccaactctggcactgggcagtggcctggagccacaggttgaacagcccctatccagactcatcaggaaagagttccgtgattgactggcggtgtcctccaaggccatggccagggctagtgagaccctgagaaagcacccctgtggccagccttgctgtacctctgcctcgcaggcctgtccttccctctcatacctcttctcacttctccttctccctcccacacatttcaacagtcctccctgttcaggggcagggagggacttttctctttggccaggcacacaccagtgttgaagcagtgttgcctaaacccagaaatgcaggcctgtccaagggtcttctggtggccagccgcatgctgaggcatggctgtggttcttggatgaacggccttgccagtcctgtttggagtctctgtttatagagagccccgggaccagttgtgtcttcagtccggggtaacacagcattctcacacataggctcagggctctcttctgtggctgccttctggggcagccgtcctttatccttgtggataaggcgcgatctggacaccctggtccccagcctgggatctggtttgcctcttttattcctgacagaattccatgacaagcacctcctttgttgcatctcacaaaaggaggctggcgggacagcgccgcaagccggccgggtcccctgacctctctgcctgcctgggcccaggatttcagtaagatcttgatctgcccacctgagtgtacctagtgcccccaccttccaccctcctggtcaagcagccaaatctgcctgttgatcatgctccctcctgcttctctgcccccaggaagtctgcactttgctgttggcagctcatctgctgggcgatcagatcagcctcctgaactggctgggcttcgccctctgcctctcgggaatatccctccacgttgccctcaaagccctgcattccagaggtaacccagagtcccttccagaagcctctgttttctgttcttctccctgtgactcttagtgattctgatgcaggaagtgtgcccggtggctctgctgccgtcactcctctaggaagatgtgggggtcatctccagagtgggtgggtggggcctgggtgactcagcacacatgcaaatcagagcaaaccaagaaaaccacgactgggcctgtaactgtggtctctctctatcccaaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaag

SEQ ID NO: 27887 - DNA, 1023 bp, Homo sapiens
gcccagtggggccaggtcctggagagcctgtggctgagactgggaagaccagcagggccagatgaggccatgggagccgaaagaagggtgctggtctttatcagaaaagcactggaagctgctgaagggttttaagcagtggcctgacatgatcagtttgtgttttaaaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaaggtaccaggaggccttgctggggcggggtgctgggatgaaggtggccagagccatggctacggtgcccttcatgtttaacaggaaggcacaagcttcaaccagtctaactggaagccagtcacggctgggctggaacagggccctccaagcctgccgtgccagggttccccttcagtgtttggatccagggaaaccaaggagagcggggggtgtgaagggatgagctggggaaactggggctcaagcagcagctatttaccccactagagaagtatttcaa

SEQ ID NO: 27888 - DNA, 1097 bp, Homo sapiens
ccttcaggctccacttctaattctagttgtcttgctatttctatcacatctgcagttacttcctccaccgaagccttgagtctctcaaagttatccataaaagttggaatcaacttcttctaaattattattaatgttgatattttgacctcttctcctgaatcacaagcattcttgatgtaatctagaatagtaagttctttctaggaggttttcaatgtatttttcccagacctatcagaggaattactatttatggcagctatagccttacaaaatgtatttcttaaataataagacttgaaagtcaaagttactctttgatccatgggctacagaatggatactgtgttagcagggataggaacaacatttgtctccttgtacatcttcatcagagtttctgagtgacctggtgttttgtcgatgagcagtaatattttgaaaggaatcttttttattctgagcacagttctcaacagtgggcttaaaataatcagtaaaccttgctataagcagatgtgctgtcatccaggctttgttgttacatttatggagcacaggccaaagagatgtaacataattctaaagggctctaagacttgagaaatgggaaatatgcattggcttcaacttaaagtcaccaactaccttagctactaacaagagagtcagcctatcatttgaagctttgaagccaagcattgacttctctctatctgcgaaagtccttaatggcatcatctcccaatagaaggctgttttgtctacattgaagatctgttttttagtgtagccaccttcatcagtgatcttagctagatcttctggagaacttgctgcagcttctccatcagcacttgctgcttcactttgcatttttatgctatagagatggcttctttccttaaccctcataaaccaacctctgataacttcaaacttttcttctgcagcttcttcacctctctgtcttcatagaattgaagagagttaggggcttgctctggattcggtttcggtttatgggaatgttgcagctggtttgatcttctatccagaccactcaaactttctctgtatcagcaataaggctc

SEQ ID NO: 27889 - DNA, 1027 bp, Homo sapiens
attcctcttctctcagaaatctgtagatatacttacagcatagtttgcttccacggatgcagatgagaagtcaaatgacatctcattgtttctttgtaagttacttattttccctctctagaaatgagtaagcttttatattaacacttgagatttcagtcattgttttcaggacatggctaaagatgagtattattttgtgtaagttctgtttggaattcagtgggtccttcaaatctcagatcaagtctttattggaaaattttcaaggacaatttcctctattatttgtttaattattgcctgtcttccatctgctttattttacaaatttctattatcctaataataataattccaacatagaataatccaaatatgcaagtatttgattgcctgcatcatttcctcaaactgtttatttcacctcataattttcctctctttgcatttttgatttgtgttttgtttcattactccatttggcattctaggtcaggtttcaacagtgactctgcaatcctttgattcatctcttgaaatttttagtctgaaaatgagattctttagatccagaacatgtgtgtgtgtgcatgtgtgtgtgtgtgcatgtgtgtgtgtgcatgcgtgtgtgcgtgtgcatgcatgtgtgtatgtgtgcatgcatgtgtgtgcgcgtgtgtgcatgcgtgtgtgtatgcgtgcgtttatgcacactgtatttgtggttccttacgtgttgttgttatcattgtttttggttcaggctgtcctctctctcccccagaaggtttgtagctgttgttctctgcaatatgctggttctttcactttctcacttctgggtcccccaggatgggttggtattttcctttgctgacccactggggcccatgttcagctgctggggatctagagcaaggccagtctctcgagtaatggatgttgcaacagtctttgacttgctgggtccgctggcaagtggttggtcccaaaaggtctccctctgcccgctagtctcttcagc

SEQ ID NO: 27890 - DNA, 1023 bp, Homo sapiens
aaaacatgagcgaattcacacaggggaaaaaccctatgaatgtaatgaatgtagaaaaaccttcagccagaggtcagccctcaccaaacatcaaaggaaaacacacaagaagaaaactattatcaacaccctccatgtgcagaaacctgcatcttcaaggcaaatttgtcaaacatcagcaaaatcatagggcagaaacactaaggtattaatacatgtaggaaagtatttgtttgtaggttataacgaataggaattagaaaattaacataggagtgaaaccacatgaatgctttgaacatgtgaaagctttcagcaagtattcagagctgtggaggaaaaattaattttaaggtatatgaatgcaaaatgttcttgtgcataaaatgtttaggtagaagtcatctttcagatgtaatagcagagtaattaaagaaaagattagaaaatgacttgttcttaatagaatgtgaaacatgatccttttgtaaaactatgaattatttaagtcattgacacgatagcgttgaatatgtgtgaagatttcctgaagtatattgggctatatatagttacataggatacgagtgtgctgtataacataaattatgtgtatgttggatttacacatgggaacacaacaatacaatatattttataagtgaaaattgaacggtcacataacctgtggtccatcaattccaattctagatacataccataaaacaataattctcaactggacttcctaaagtgtgtttggaaatctgttgttttgattgtcacatcattgacatgctacaggctctgggtagatgggaggccagagatgctaatttccctacaatgtatcagtgaaaggacaggaaatagtcttatccagaataccagtagtttcaccacacaaaaaaattgccttacagaaactcttgcacatctgcacccacaaatttgtacaagaatgttcactgcaacattgcaatagtttttgtaaaaaaaaaatttaaagaaaatatccaaatg

SEQ ID NO: 27891 - DNA, 1021 bp, Homo sapiens
gatgaaaatgtcttctcttaacacagagctacgatgctttactgaagaatatgaagttagaaaattcaactggcattttcagggagtgttgcagatatttgcacagaaggagaaaattctcccatgggcagttgtgaactaacaagaccttccttacccaaagacgcaaggtatttacagttatccagcatcacatctttatacaggtttctctgttcaggagtcagatgatcccactcttctggtgagaagaccacggccacatctctaaatctcaccaactcctgaaataacaatttatactttatatgtatacatgcctccacgtggcctctggtagatatctttcaaattgggcattctagggaatcacacaggatataaggatacattagaatatgtgaccaaaagctataatagaaagtgcagacaataaaagtatgatttactcttgtagagtttaggaagacaaaattacttatgataaagtaacagctaaggaaacatacatttggtgttcatgcttggctgagtcagtggggtagagctaccatctgtgggattatgaccaaatacctctaagtcagaatcccacccaagcagaatgataagggaattcgtcctgcctgactgcatgggatgggacatcggttttttgctgattcagactgaaactggagcatcagctcttcttgagtcttgaacctactgggttttggaccagtattataaatcagtcaaaactaaagatttgacagagtctctcaatatgaacagtcaaaagttctttgcaagtaatactagaaccatgtcaggtctcccaagtatatacataaattcaatagtatctccatttaaaaaatccattaagattattttataaactgtgataaacagatacatgattttcacacaagggaaaaatgtgacagactagttttttacatgaaaagttaatgaaggtcttgttcttgccagggtgcagagtcaagttgtagtaattcaagtgggttaggaatgt

SEQ ID NO: 27892 - DNA, 1015 bp, Homo sapiens
attacatacaaagtgtttctctcctgtatggattttcttgtgtttattaagatttgaattattgttaaaacgctttccacattcaccacattcatagggtttctctccagtatgaatttttttatgttggttaagttcccagttaaggcgataggtctttccacattcattacatgcaaagggcctccctatagaatgagttttctgatgtttagtaaagtttgaccgatatttaaaggctttttcacaagtcgtacattggtaaggtctctctcccgtatgagttcctttatgttgtgttagatctgacagacggacaaaggtctttttacaactactgcaaataaaagacttctttccggtatggatttgttggtggcgagcaagatccgtgcgctgggcaaaggtttttttacattcattacatgaaaagggcttctctccagtatgagttttctgatgtttattaagatttgagatgcttttaaaggatttctcacaaacatcacacttgtggggtttctctcctgtatgagttctttgatgtagaataaatttggagtacggattgaattcctttttgcaataattacatgtataatatttctttctagtatgaattaatagatgttgagttttttctgagaaacggtgaaaggtttttccacaaaagttacaggaaaagggcttcctttgagtatgagttttttgatgccgagtcaggtttactctgttgccaacatgaaatctctgatgtatagagagggatgagagaaacctaaaggccttttgacatacatcacatttgtatggcttcagtccactgtgcatgctctgatgttgaataacctttgaaggtctgttaaaagtttcaccacattggttacattcaaagtgtttatatagtgtacatattctctggagcattgtaaatgatgagcgatgcctaaagccccttgtattttcaccatattcgtgggtttcccctaccttatggattttctgatgtccagta

SEQ ID NO: 27893 - DNA, 1005 bp, Homo sapiens
tctagagcattgtttcaaaatacacatttggtcacaaatctccagtccttgcttacaaataactctttatggatttccattatttataacagtgatctccaaagtggaggatagggagcaccccagcaattcactggacttctattcttgtatttcagccaaaagaatgaaaaaataattaagctttattgatattagtgtatagctggaactcacttggaaatatactacaattcctaagtaaatgtacgttagcgtatatgcaagaatgttttactgatgtgccgtactatctaaatttcaagactactaattagagaaaagagttcctctattctctgacctctgtcccgctcctcactaacctttcctgtggagagattgtagttctcgaactccccatatgtgttttgtgtctgtgtatattcttaatggctacagtcctataaaacatactgtttatatttcaggactaaaattattatgctctcaaggaaggggtaacaaaaatggagcaagctttcttcttttgtgatcacccttcatcttgtgtatatgtccagcattgctctttaaagatgtacatttctatttttgtcaccctgtcagaatgtatgctcctaaagagtaagattagtattttatgtgattagtaatccaggcaattggaatagctccaggacatggtataagctcagcacatttttaaaattcattttaaaaaatgaacacagtgacagatttttaattttctgccctcccacaattacatctctctatagctttccattagccatggcagtggtcttcttatagtttatgttaccatacatttgatatcactcaattttggtcacccaagattaaacattttctttcagataccagtttcattccaggacctgactgtgaacttcacccaagaggaatggcagcaactggaccctgctcagaggctcctgtacagggatgtgatgctggagaactacagcaacttggtctctg

SEQ ID NO: 27894 - DNA, 1071 bp, Homo sapiens
tcctgcctcagcctcccgagtagctgggactacaggcgtgagccaccacacctggctaatttttgtatttttagtagagatgggggtctcgaacttctgacctcaagtgatccgcctgcctccgcctcccaaagtgctgggattacaggcatgagccaccacacccggcctttgttttgtttgttttttagagagtgagtgtgacaaatgaagtccagtgagaaagggtggtttggaagggaggaggaagctatggcctcctcagtttagctgtggggtgttcccaggcatagtcctgcagtgggcatgagcaggggaatattccagatgagttcagttgtaccatttcctgtagcattcctcaatagtcctgaaataagtagatatagatggaaaaactggcttaatctttgaaaattaagtttacccgttaaaaaaaatccaacccaataaccacttatgtcttgatttcaggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatg

SEQ ID NO: 27895 - DNA, 1048 bp, Homo sapiens
gtggaggttgcagtgagtcgagatcgtgccactgcgctccagcctggaagacagagcgagactctctctcaaaaaaaaaaaaaaaaaaaaattgtagaaacggggttttgccatgttggccaggttggtcttgatctcttgacctcaagtgatcctcccgcctctgcctccggaagtgctgggattacaggcgtgagccactgacgattctcttgagctgaaaagcaaacatttcatttcacttctgcatattgagtgcatggaggaagaagtgatgtccattgttaggggctgggaacggtttccctaaggggctaggccttgaaagttggatgggatttgggggcacagtcagagggagtaatatgagcttgctttaggagggaggatatgaacttggcattaaatatgactgaaccacctattgaaaaagcaactccctcttcacttccccttgtaacaggctcagtttagtgctaagatgtctttagcatctctcatatttcctgattctctttttaacaaagactgagcagactctagattttagccgcatgctccccaccctagaacttttaatttaaggttttcattacattcatttttggagttgcccttgatttaacagcagattttattggttttgtgttttttgttggttaacaataaaagtttagttatttacctaagttacataagtttaaaataaaaacatgaactaagcaatatgtaagaggactatggatgtgtcgaaatggcacaagtggtgtgaggaaggtccaagttagggaaacaccgtttcagacagaggggtgctgttagggttttggagcctcaaagtggcttgattgaaatggcatctgagaagatgaatgatgccgtggtaggatgaatctggcaggagtctgttggcatcaggagggtggcatacaggaaggtagttgggagaggcatcgtattccattctgagctggaggagtattacctagaccagggtcaagaaactttttccatagagggccatttagtaagtattttaggttttgca

SEQ ID NO: 27896 - DNA, 1097 bp, Homo sapiens
ctccatgtcctttggggtttccattgtctggtggcttaaagcaagtcagggatgggccttgagaatctttctgctgtggttatggtcaacctgggctgctctggaacctcagctgtcagagtgagagaggattcctgcagttcagctaaagagaatgtctgtgagaggtacagtggaggaagagagagatacagttacataagggagggaggataggccatcaaaccatcccgacccatctgttagatttatagatggcctctgaaaaatatgagtatgttatggattgggttttgagagactgtctctgttgttgcagagaacaataggagtagcatttatttcatgaggatcgtaggaatatttgggtgcagatggcagtgctcctatgagtgacatatttatactgttctttctttctggaacagatcttttgattgattggttttgtgcccctacctcttccagaaagaatttgcaacagattgacaaggatacataaccatatgaaacaagatgaaaataaagacatccatgtaaaaggaaaatgaaggtagaatagcaagtggtctggggaaaggttttatacagaaatctgtactatttcaatcttcagagttagggaagttggctctgaaagcagaatgggaaacacagtaccttagaagatctcatactttccaaaaaaacaaaaaaccattctagttgattaaaagaagtagaacttttcctcacattgatgtctgaagggaatttctccaggaagctttagtagatggtggacaattaagctgaagatgattctaaaacacagttcagttagagcagcttcctaaggcttggggcaaaaccaattgatcttaaattcagagctgatggtggtttgggtcttgaaaaattctcgtgtcagactccgctagagagcatcttttcaatgatgtgttttcacttaagagtttagtaagtgaagggcattttggattgcgctgttgtgacctccagcttaccttccactagggatgcagcttatgggtagaatatgaatcttcagatggcaaaacagcttttatagctaataacctcagaacagaagcaaa

SEQ ID NO: 27897 - DNA, 1101 bp, Homo sapiens
ccccatctctactaaaaatacaaaaattagccgggcgtggtggtgggcgcctgtaatcccagctgcttgtgaggctgaggcaggagaatccgcttgaacccgggaggtggaggttgctgtgagctgagattgcaccattgcactgcagcctgggcaacaagagtgaaactccatctctctccccgcccccctcccccccaaaaacaaaaagaatgatccaggtgtgtttggccttgagccaccaggtgggtggccgtggcattcatgatattgggaggacaaggcaggtgcagggtgtttcacacactggggaggtaggattggtggcactaggaggtggacataggagacctgtttctcagggagatgcagaggagggttttgcagcgtgaggcttgtgggttgctagtgactctcatgtatgtccttttcctgactccatgaagctttgcagtcccagatgccttaggaggatgggccctgcccttcactggctgggtagagtgtgaaccagacccatctccatgggaaaccaatgttttcctgacacccttattcttgccatatccaagtgctatgcttaaaaccattttttaatatttagaacatacctcttaaatctcaacacttgtttatttattaacaaaggaaatagatctatcaaattaaaggcctgttctagttattaattttttagcacacatgaatgtatatacagaattataaaaataggctgggcgtgatggctcacacctgtaatcccagcactttgggaggccgaggtgggtgggtcacctgaggtcaggagttcgagatcagcctggccaacatggcaaaaccccgtctctactaaaaatacaaaaagattagttgggcatggtggcacatacctgtagccccagctactccggagactgaggcaggagaattgcttgaacctggcaggcagaggttgcagtgagctgagatcaccccactgcattccagcttgggcaacagagcaagactttgtctcaaaacaaacaaacaaacaaacaaacaaacttgacctgtcgagcaggaaaatggattcacttggctgtgttctacgtgcaacagcat

SEQ ID NO: 27898 - DNA, 1039 bp, Homo sapiens
atccggctaatttttccatttttagtagagatggggtttcaccgtgttggccagactggtctcaagctcctgacctcacgtgatcctcctgcctctgcctccccaagtgctgggattataggtgtgagtcaccatgcccagccttggacttgtttgaaagaaaagagactcttttccttccctgccaagcaatttcatggaaaatagttgggggaagggaacagtgagcgccttagataccggacagaagtgtgtgggtgaggtgggtgtggagcaggtcaggggggcgaggttatgataccaggaccaactggtgataagctcctggtggccctgcctcttgattctccagagaaggactcactctcctttttctcggtgacagagctgaggctagctcaggaagggggagtcatttgccctaggacagcactggagaccctgatgccttctcagatctgtcctgtctagtagtcctgatctgtgcccgctcactttgaacgcagaatctcaccgtgaggcaaactcttaccttgagagcatctggcttctgttctgctctgcccctcttggtggagatatggttcttcaggtctcaggagaaagacagcagtcagaatggatgagaagctggtgatttccagccctctgatagagcagatcgatatttttggggtgtttagttttagtttgtgttacgatctggtgtcaccgagacttgcaaacaatccgcctgtattgtgaattcggtcccagggatgtgctttatttctcctgggttgttttctcttagatgccaactgttgaaatgggggtaaaatgtaacataagaagtctattttgtcttcttctctttaaaatattggaaaacgtggcagtgttgggtccagattcctacatggttgctttggatagcaactgagtagatactgctttctccctttccaccagacgtgagttttctgcttctgcaaagtcccctttgctccccactgctttctaccgggcttcagtttgtggtctgtgaaatctaaaaggc

SEQ ID NO: 27899 - DNA, 1380 bp, Homo sapiens
ttctgggatctttggctctaagctacaatgttattctaggggaatgtactttcttatgagagaaaaggacaataaataagttaattgaattttcggattgtcgtcagtggagctgaaatagggcaacatggtattaattagctactctggacatagaattgagcttggcaagcagagcaggccagagtggctggaaggggttggggagcggaactgctgcaaggtgagccgagacaggtgggctggggccagatcacatgtggctttgagggaacctgtcaggtcattagacttcattgttagtttctcagcttggtactgctgacacttagggctggagaattctttgttgcagggactattgtgtacatcttagatttcagtagtcccgcatccctcctttgggctacttgtgacaatcaaaaatgcctctagacattgctatgtgatccctgtgggtggggggaatggttaaagtgctctgacagagaactactgggtataatgggaagtcactgggggcttttaagcaggggaaggacaagaacagatttatgtctataaaaggtggctctgggttgggcatggtggctcacacctgtaatcctagcagtttgggaggctgagacgggtggatcgcttgaggccaggagtttgagaccagcctggctaacatggcaaaaccctgtctctactaaaaatacaaaaattagctgggcgtggtgatgcacgcctgtaatctctgctacttgggaggctgaggcacgagaattgcttgaacgcaggaagcgaaagttgcaatgagcccagatcgggccactgcactccagcctgggcagcagagtgagactctggaggaaaaaaaaaaaatggtggctgtggctgctctgcagggaatgtctataatgggggtaaaagtggaagtgggtgacgtggggagttagctgttgcattggtccagagagaaaggacggtggcttggactgggtggaagcattgggagcgatacatagtggttggattcatctccaaggtgttccctctatgggactttaaaacatcttaaccttcaaaatcatcaagcattgattgaggtccacaagatatccacccctggggtgacacattctaatgtatttttgctttacagatgaatgaaatcgaagtatgtccagaatgttatctagctgcttgccaaaaacgagataactggttttgtgagccttgtgtaagttggatttactttgcttatttcatttactgaaccctgtgccttggatgactaccctgagacagctttttccaggtggcttattagatgaaactttggatggagttttaagataattttttgctgataaaattatggcagaaggaaag

SEQ ID NO: 27900 - DNA, 1033 bp, Homo sapiens
cagcctgttggattctcatacatgccattttctaggaaacccactctcaacaggaaccactttctgctttgtgttaggatagattaattttgcttcttgtagaatttcatataaatggagtcagagttagtgctcttgtgtgtctggctgctctcatgcagtgtaatattttgaggagtcatctgtgttatgtgttattagtggttcctttttttttgttgctgatttttttttttcattcgatcaatatgccgccattcatccatttaccttgttgatgctcatggatatttgggttgttcttagctttgggctgttaggaataagctgctgtgaacctgcttgtgcaagtctttgcatggacataggtttttctttctcttgggtaaatacctaggagtggtgttgccagctcagtgagtaggattttatttaacttactacgtttcaccaaacagtttttgcaaagtggttctatcattttacattctaccagcagggtatattagagttctcttttgctccacacactataagggttgatattgtctgccttttaaattttacctgttcttgaaggtgtaaagtattatgtcacgatgttttaatttgccttttcctaatgatcagtggtattgcgtatcttttcctgtgcttattagtgacttgtatgtcattttttgtaaacatctattcagatattttgttcattgcaaaaataggattatttatttatttatttatttagagacagagtctcactgaatcgcacaggctggactgcagtggtgtgatctcagctcactgaaacctctgcctcctgggttgaagcgattctcgttcctcagcctcccgagtagctgggattacaggcgtgtgccaccacacctggctaatttttgtatttctagtagagatggggtttcgccatattggccaggctggtctcgaactcctgacctcaagtgatttgcccaccttggcctcccaaagtgttgggattacaggcattagagaccacgccagcctgttt

SEQ ID NO: 27901 - DNA, 1022 bp, Homo sapiens
gcagactgttgctttgttgcccaggctggagcgcagtcatagcttactgcagcatcaacctcctgggctcaggcgatcctcccacctcagcctctcaagtagctggaactatagatgcacacaccgccacacccagctaacttttttattattattattttttgtaatgacagggtctcgctatgttgcccaggctggtcttgaacttctggccttaaatgatcctcctgcctcagccttccaaagtgctgggatcacaggcatgagtcacggcgcctggcccctacagatgaagagaaacttgcggacatgatgccccctacctgatttgcacaaaggcaccataggggctagtggtgaccctttgtacaactcctgagagtactgtacagaaatgtagattcttggggctaatcactgtggttttatatctttaaaaaaaaaagaagcttttgctttgagattatattctgaaattttgaagagatgataaaaaaaatttagagcatgctgattggatatccttcaattgagaacctttaacaaattggactcttttaaacaaaatctcaatcagtggaagcaaaaggtgtagccttagtttggtttgcacaatttttttgttttttttttgctatggtataatttttatgttgagtgtggcaaggaattaccttcgattttcataggctaaattatatgtgctaatgactattaacaaaaagaatgagtcatgtagatttgtcagccccatagaattaaaaaccaagaagaaaaattgaagagggcgttaatttctcaagtaaatcgttgaacgtcaaatcagtcaggggagaaagtgctgattttgttaaagcatctttttaacttacagtgcgtattgtaattgtcaatcttaatgtaagaggacaggatctgtttcttgagtgtgtattgaaaaccaagaataaaattggatcacaattgggcttataattatcaataaccaggcagaattagaaggtagaccaatttggagctcc

SEQ ID NO: 27902 - DNA, 1052 bp, Homo sapiens
gccaggctggtcttgatcttgtgacctcaggtgatccgcctgcctcggcctcccaaggtgctggggtttataggtgtgagccaccgtgcctggctgaagtgtacatgtgtttaaatgagatgctgaaagatgaaaagaaggggtgcatgaacaagagtggggctggtgagaatccacaaggatgtaatttgtattgatctttttggaggagggtctcaaacacgaggcccagaggcggtgggagcacgggaacttcccggtgggtggggtgtgttctttccacacaattacagttcatagcctattaaacacgaataaatgatgttgttttccacaaaggagaatgtatgccttcatttccttgaagtatggccttcctggtctatcttctttggtttcctgcttttgcaatcaggcatgggcatggacaagtcgtatttctttggggtaagaacaatactggtccctgtgtgatgactgttggcaggttggcctcggtctcatcagcagggacgtagtggggaagagtggcgattgcacatgtttccatctaaaagtggggtagctgttactcagctgtatctggtgctataggggcctgcaggtcctaatctgtttttttttttttttttttttcacgtcggaggcttgccctgtcccccaggctggagtgcagtgacacaatctcggctcactgaaatctccgcctcctgggttcaagcagttctcctgcctcagcctcccgagtagctgggattaaaggcatgtgccaccacaccaggctaatttttgtactcttagtagagacggtattggccaggctggtcttgaactcttgaccttgtgatctgcccactttggcctcccaaagtgctgggattacaggcatgagccaccgtgcctggccctcctaatctgtttttttaagaaaagtgaaaaatctaggttattacatgaaatttcctgatttttgtatcttggcaacaagttaagattttacaaaaatgttacataggtcaaagaaatacttgtctgactgttgaagcagacag

SEQ ID NO: 27903 - DNA, 1181 bp, Homo sapiens
gactggtgattacgaaaagggctgtagagcaggcctctgcttctgaccctgccttcacagttactgggggaaacctggcattttcagtctgattgaaatgcagaaatcctgtcctgggctgattctggtctccagtctacacaggccggtgttttccatagctttgaacttgtggaattgatttaacatgctccttccagaaagcaagctgtgtttttggagtggggggcggtagtcggggaggaggtggaagagaagcaagaaaaggaggaagagtgattggttaaaaaaaatacagttacccattagttaccattgaataggtgcttactatttgccaggtattatactaagagctttacgtgaattaactcattgacttcttcgataactttacaaggtaccacttgtaaagtggtaaactctctgaggcacagagaggttaagttgcctttttacggtcacactgcaggggagagcacagccaggttctgcatgcattttgacgccagaaagctgattccccaccactgtggcatcctgcctctctgtcgtttgcaacctggcccatgagagcatatgccttgacctatgtgtcctggtttgcccgggacccagctaagcacatggttggttgccctactcctgtggcctgtcatgcctgtctcagcctgtggaccaagcttctcttttcgttcaggccccagcaggcttgctgtcgacatcattaaggaaattaaacacccacaaaaacacaagaagctcccggcctttcagctgcggccctttcccttgagggaggagacaattccctgtaatggtgtgtcatttcctagcccctggagaacggcatgtgctgtgactcaggcaccggatgtgggggcaggagtggggtggagggcgggtacctgatgtggcctgctggggaggcctagccttgatggaggctggaaaaggggaggtgagttggccctggagcccccagcctatttcagggactgatgccactgtttggaaattgggaggtgaatgtgctttctggggactgcctttgagagaacggtgtcatcagtgaatgacacgactttccaccttttcccagttcctgaaactgtttgttggaccttctctgtccctatacttccatctgcagtttaggggaaaaaaggcaaaatgagagt

SEQ ID NO: 27904 - DNA, 1062 bp, Homo sapiens
cttattttaaaagagaagctagagcttctctttaaaggcggtggctcacgtctgtaatcccagcactttgggaggctgaggtgggcggtcgggagttggagaccagcctggccaacatggtgaaaccccatctctactaaaaatacaaaattagccaggcgtggtggtgcatgcctgtaattccagctactagggaggctgactggtttcctggccactgattgctccttttccagatcactggttcaccgcatcagctgtaagtagtgctctcttcctaataaggctgacctggttttgcgcaccacctccttaatgaccctcccgtaactccccatccccagacttcaagtttgggtacagtcacttcaaaccaggttgctatttcttgacttgggaccagatacagtagcagttgataagagccgagggactgtgttgtaagacaaatatttatcttgaaaatctagacccgtcttatgcctggtgtgatgctgacactctgagaagctcgagggaactagatggagacaggaaggagcagactgaatatctcttgactcatttccatgggatgcagggaagatgaacttgaaaaataattttttgcttttcccagtcgaagctgagcctgtctgcacatagatcagtacctgtatctgatccctgcttctcatagcaggggcagacttggagaacccagagggagactgaggatctacggaggttttggaaaaagagatcctcagactcagacgtataagaaaaagggcccagaaccaagactgaagatttggttaaatggccatctcagtggcgggtctcctagaagggaatatgttttccctggagaaagtcatgcctcttttatttttattttttgaactgctaaataattctgaaacaatagctctcctcaagaataactgggaggccgggcatggtggctcacgcctggaatcccagctctttgggaggccgaggcgggtggatcacctgaggtcaggagttcgagaccagcctgggcaacgtggtgaaaccccatctctactaaaaaataca

SEQ ID NO: 27905 - DNA, 1030 bp, Homo sapiens
cttgaacagtatcattcttgctgagatttgctgggggtatggatgtgttttcagagacaggatgctagagaatgtacaattatagcaatttgctaaccagccccagaccttaattagcacaggatccttgttctcactgttgtatgtaaattaagactttcacaaagggattgtttatgaggacggctgtgagatagagaccttctgtcatttttcaaggaaactctttcagaaaatataaccacaaacacttttaaatcacagcgcgatgcagaagtgctgagaatttttctttcaaaaaatgagcatcagtatttttaaccgtattttggctcctctctatctctgacagcccaagaagtgccatccgtgtactgtgcagtggaaagaatttatttgtgagttagatgactaccagattgttcctctcctaacaaggtctaaaatatcccagaactctgaagatgtctgattatggttttgcaaatgagaaatcttctaccttctcttggccagcatcgtctctactgtgcatctgttcatggaatcctgtcggcagtgtctgtgcaatttagctttgtggttcactcatgcaaaccttgtgtttgccccatttttgaagcatgacccacgttatatgtttgtgtgactattattattctagaagactgtgatctaaaatcgaccgtttcaagcttagtttaaaaagaaccatctcttctttttcctctctaaatgcctgtagaataagcatatcagggctgaggccttttagagatctgggtactttttattgccttattaaagtcgtcattccttcattgttctctattgatagtggatcctttaccgatgacttgaggtgatcagtttggaaagaccaggtgtcatggctgtgggggggtgagggtgagtggaatgataataagcccccttcaacttcctgtgactcccctcacctatcctgggctttcctgggaacctagagatccagcgctttatagacttaaaaaaaaaatacctttattga

SEQ ID NO: 27906 - DNA, 1051 bp, Homo sapiens
ttctagaaaaaggctggccttcctccctggacaagggccgtttctctgggggcaggtgagggtgagccgttccagcccactccaagaaactcccttcccagggacctccgggcctcaggctttcctggagcaggtcaggctggctgccctggctggcccgtgccgggaaatctagccagggtgcaggagaagtgcgtgtgggggcccctttcccaagtttttcttgctgcaaaaggcctagcttagcctgtctttttctatgcacaggatggctcttgctcacccgagcctcacaaagataatcgctcaggaagtgtttcagccaatccggggcggctttacactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagaggtaagctcgactttttaaccatcttttttccccctccctctgagacatccgaattgtgggcgagcagtgtgatttctctgtggctggccgtgccacactcacccccagagcacttatgttaacttggaactgtttagagagaatttttttgctttcttgggtcacatggctcagtagccattagccatagcttgattttgcaaactggcaagggcctggcacacctttccttccaccagggcatggtgtttctggaagagtttgaagctagatcctggtatgccaaaaaagaagcttttttttttccttctttttttttttttctttccctcttccctctctcttcccctctctctctctctgagcagttccccccctcccacccctgcactattgtcttctcttttgccacatgccctgctgggggaagaaaatggaaggtaagcaaacaggctcctctccaaggagagctcatggcagacagcagagcaggcaagtttgcctctccaaagaggttctgggaaggctggataagttttgacaagagagga

SEQ ID NO: 27907 - DNA, 1030 bp, Homo sapiens
tggggaccactgaggcctgtcacgggcctccttggtcatagagcaaagaactaaaggggtgagggacggtggcccctgatctccagggaaaggacattccaggcagagaggatggtaaagaagaaggccctgaggctgcactgtgcctgggctgtcaaggaacagcgaggagccagtgtctgccccagaggttcaggggaagggttcaggaagggccaggatttgggctggctgtaaagggggggtcgccttcactcaggaagtggggacaggaagggcaggagggggacagggtgaggctgtcagctcacggcatgagctgagacacagaaactaagggggggcgagcacagagtgggggttcagctgaatctgggccgcagaggggagctgctgaggttgaggtgccagactgcagcttccatacctgcagatgtcagcctcccacaaactgctgcccacctaccgctccccaccccccacgcgaggctgaggcaccaccacctgagtgactgagtccccgatctcctgcctcccccaggaatccccacatcgtcctcaacattgacctggcccccaccatcctggacattgcaggcctggacatacctgcggatatggacgggaaatccatcctcaagctgctggacacggagcggccggtgaatcggtgaggacggagcagggcaggtgttgagggggccgggacattgacctgcgggaactcagagcaaaaccctgtgggtctagaacgtggggtctccaagggtcgggagctggggttctcaggtcccgccatgccaaccacttacctgctgtgggagagaagcatggtcccctctccgagattctgtcttcccatctggaatgtggccaaggtgaccagttggggaccttctctgagctaaaattacccaaagcttgaaatgatagcagcagtgatggtaggagatggtgctaactgcacggcgcttgtgtgtgaggccctattctaagtactgtgcagggaaatctaggaatttgatcctca

SEQ ID NO: 27908 - DNA, 1049 bp, Homo sapiens
catgatttcaccactgcactccagtctaggcaatggagcaagaccattgctccattttttgctccatgaccaaaaaaaaattaaagagtataggcaaacctcaacttcttagctgagcttttaaagcctccagttctggccatttacttttcctccaactcttctctcctcttgcccaatatgtaagtcagttccttattttcctggagacattactgcatccccatcccttttttgtgtgtgtgctgctccttatatcatttctgcattttaccctctgacattttatcctctttccaaggagccagttgccatctgccctctcttctatttttagagcacatggcaagcacattcctgcctcagaccccgttatctctgcctggaactctttcctggatcagtgattctcaatcctgagtacccattagaatcccctggggagttttttaaaagtctgatacctgggccaaaccgcaggccaatccaaccagaatctctgggggtgggcccaggtatcagtaagctctccaggggattctggcaaaatccagtgatacatatcttcctatgcccagctccttctcatcattcaggtctcaactcaaatgtcacctcctcagagaggacctccctgactgccccagctaaaatatgcccctcacctcagctcccagttactctttgttacatctctctgttttatgatatttccttcatctgtcataacttttaactaccttggttctttatttatacatgtgtctgctcctgccccagtgtaggcaccccagggacttagggatatacccaccctgcatgacagtgtccccagagccttgaaaaaacttcagacttaggagccaagactatgtagtgctgggtccaacatttactagctgtgtgccattgggcaatttacttagcttctctgtgccttaatttcctgttctggaaaataaggattatcatcatacgtactttctatagttatgtcagaattaagcgagcaaatacaggtaaacacagaacagtccttggcacatcgt

SEQ ID NO: 27909 - DNA, 1073 bp, Homo sapiens
ctcagcaacaccagagatcaggagcaagggtcccagtgagggcagctcccctagcagtgggaagtggggttgtgtggcctaacactggggagacctgtgtcatgaggagacattcatgtggaaacccgaggcaggagcactgcaggcagaagcacggcacgtgcaagagccctgtggcaggaacaggtttcccaggacgttggaggagggcagcaggacatgggaatgaaggggaggaggatggggaagagggcggcagagagcagacaggggagacctggtggtccccagcaggccatgcagcagggtctggatttgattgcatgcccgatggaaggtccccagaatgttctgagctggtcagctatgcgtgcatgttctcagaggcacaccccggctgtaggtgaagagggtggcccagggacaagagcggaagcagggagatcaggtggtgtttgcagcagtccaggtgggagatgctggtggtacggagcaggacggggcactgcagagcgagagaggtgggtggattccggtgctgcttggaaggtcggcagggtttgctttatggatcgtgagtgggtgggtgagggaagaggaatcggggatgactcctaggtttttggctgagccgttgggcagatggcagtgccatttacagagatgggaaggcgggggcaggaggaacagattgggagaggtggggaagggggggacattaggttgctttgcaaacatcacccaccaggcctgtggctgggcagcagctctgcgtagccccttctgaaaagtggggaaaacaccctggaagccctgccccattgaataaatatcccctcccagggatggtgattgtagcattttgagttagaggaatatttctgggtggagtttctcagagaggaaatgaccaatcattgcagagcctcgtcaattacacccaagccctgccctttcccacgtgtgctctgccacctctctgctatggttgacgatgaccatagcagaattttctcccaggaacttctgcaaccagaggcagcagaaagcaacggagaaaaaattaactgcat

SEQ ID NO: 27910 - DNA, 1210 bp, Homo sapiens
gccagggttctggtggagggcgagattccctcattgattgattcactggttcactcagtgtgtgtgtgttgggcacctgctgtgcaccaggcatgtttgtagaccctggggacacaggagagacgtgtctgcacccatgtccctgcctcacattttcacatcccctggcttctgtatggagcatagactgtgcacggtgagggctgagtgtgactggtggtcagtgagtttccagagctctggaacccaggggcagttcacacctcggccctgtcccctcctccctacctgccggcaccatggctgtccccttactctggcttctggcagggcctgtaccagtggatctaccacacccatgaggatgcccaggaagcacgagccagtcaggaggcctccactgaggaccccagtggcgagcaggcccaggaggaagaccaggctgattcaggtaatagacggggcatggcatgacaggagcttccagagggactgagactccggaggggctgggtcctctcctgttgtcccctcccctcccctcctcccagccagtccacctccatgccagcaggtttgttttttttttcctttttggagacaggttctggctctgtcacccaggctggagtgtagtgttgtgaccacagctcactgcagccccaacctccctggttcaagtgatccacctcagcctccggagtagccaggatcacaagcgtgtaccaccacacctggctaattttttaaattttagagttttttttttagagatgaggtctccctatgttgcccaggctggtctcttaactcctgggctgaagcaatcttcttgcctcggcctcgcagagtgctgggattacaggtgtgcaccactgcgcacggccgcgatgcccacgatgttatgtcagtttctgatggctgctatagcaaagtgccccaaacccagcagcttaaacaacacacagttactacttaaattttggaggtcagaagtccgagtcccactgggctgaaatcatggtgtccacagggctgtggtcctccttgggctctcggggagaatctgtttccttgcccgtttcagctccctggtccaagccactatcatttcttaccaggacggtggcagtagcctgctcatggctctccctgttctgacttcctctcctccaaggggctattcccccagatgagaagagaaccttcc

SEQ ID NO: 27911 - DNA, 1395 bp, Homo sapiens
acgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatgaagtgtttggtcctgttgagcagtaactaaaataagggaagatgtgagtaaggggatggaagctcgtcgtggggggaccagggccagcccctctgggaagcgttgctgcctcagaggcatgttgggtacctggatgtagggacttgtgccccgtccagacctgacattgctacccaaagaaatgaccccaaggagctgagaggagactgccggacac

SEQ ID NO: 27912 - DNA, 1050 bp, Homo sapiens
tttgcatgggtcctgaataacagcaggagcccagccagtgaggtcccgcatgcaaagtgtctttatcattccctgattccctgcgctgccatgcgtgccaaggggagggccagcgtggggtttgatggtgtcattgcgtttttccaggctgtggatgtggattcgtgtttaccgtgtatgtccctcccaggtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggtaactgtctggcctgagctgtgatggctgtgcctcaggacagtcatcttttggcttctctcagaaaatgaactttgaactttgtacttttttcttaaatcaagttctgtccagggatgggctggggagcagtgatggaagggtaggaggtatagaagtattgtaagcatatgtggtaagagaaatatctttatcctttggtagtaagatttcaacatgcaagccaaccctaaaagcttctaaccactagcagtggttgtaaatttggatttcaaagaacagactcatcgtgctgacactttctgtctggtaggaaaggatatggcttctcccagtcttgggcttctgagcagacacctaggttcctggaaggttctgggctgacagggcaggtgttagtatggccacagtggggctgagttggaaaaaagagctggtgatcttgcttgtggggcctggagctgcagccctccagcccactcatacttgctgttccctacctagcctcagctctcttttcccccttaggttgaatacaaa

SEQ ID NO: 27913 - DNA, 1026 bp, Homo sapiens
tgtgtagatatttgtataaaatcctatttttcttaaactaaagctaccataccatatactcttttgtgggttttttttttttttttttttacttaatgtgtgcggggaatccctctttatcagtgcttaagagatttgtctcgttctcttttgtggccacatagcaaccagtatttagtaggcctagtcctggctggaggctcagagcagatactaaacttgagcatttgtactgcatttatttctggactttgctgggctagcttcctttttgccagttgcagtggaccacactaaactcaggacagcctgtgagccaggggcatgggagtaaaaaggtctccctatttcatgcctgactgtttgggactcaccagactcaagagcataaaccagtttgagaagtaagaagaaaggcgagaaagcatttgaaatgatccccgcttcctttcatttagtaggtcttgtccttggttccccttccctgtgtctgtgtgaagtgtgccagccagtgtgccttggagcttttaataagtgtctgtccgctttcactcagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaaggtgagaacttttctgaacacagaaggtgttttcattacttatagatgggtggggggtttagaaggctggtcgctgtccccaaggtgaaaggggatgagaccaacgtgccacaccccaggcctgccagaccccttagaggtgctgcaagagccacctgttaggtaagataaggacattgtgtcagttcagtagaggtacccgcagacgggcacacacatctgtgcaggagggcgctcatc

SEQ ID NO: 27914 - DNA, 1372 bp, Homo sapiens
aggtgcccgccaccacgcccagctaattttttatatttttagtagagacggggtttcactatgttggccaggctgatctcgaactcctgacctcgtgatctgcccacctcggcctcccaaagtgctgggattacaggcgtgagccaccgcgcccggccagtggtttttaattttgaggaatttcttttttctttatggtggatatcttttgtgttcaactctttgccagccttacagtcttgaggctttctcctgttataaagtctttgtaattttagtttagatcacatttaagtgatcctaggtctaatttttgttgtggtatgagttagagatcatggtttgatttttttttcttccccccaccccgctccatgcagatacctagttagttgctctggtactatttttttaagagatttttaatttgttttggtgtgtttgccaaaaatcgagtgaccttatatgtgcaggtctttttcgtgctgttctgttgatctatttatccttacacaaaaccatatcctagttgttgtgactttataggaagttttaaaatctggtagtgtaagtcttctatttttctttttgagtgtcttggctaatatcggttagatttttaagtttttttgttttttttttgtttttttttttttgctttttgagacgaggttttgctctgttgcccaggctggggtgcagttgtgtgatcatagctccctgtagccttgatctcctgggcttaagtgatcctcctgttttagcctcccacatagctaggactacatacaggggcacactaccacacctggctaattttgtttttatttttgtagagtcaaggtcttgctgtattggccaggctggtcttgaacttctgagctcaagtgatcctcccaccctggcctcccagagcgttgggattacaggcatgagccaccctgcccagcctgattttctatctgtgttattgtaatcactttcttgataatgtccatgatacacaaaagttttaaagtttgattaagtgtgacttttttttttccctcttgttgattgtgcttttagtttcatatcttaaaaaccaattgccaaacccaaagtcatgaagactcgcctgtttttgcttctgagagttgtgcatgttagcgcctctgtgtaggtctttggtccatttggagattgtaatcactttaatatgcagctaactttctgttcatgtttaattttagattctttccccatctttgttgacttagttttatttctttaatatgtaaaacagtaaatgcttccagaagtcaaaactatcattcccgtctcatcccgtctgtctaccctaatccctcacacctgttgtaggtaactaatt

SEQ ID NO: 27915 - DNA, 1009 bp, Homo sapiens
gggcggatcacgaggtcaggagatcgagaccagcctggctaacatggtgagacccatctctactaaaaatacaaaaaattagccgggcatggtggcatgcacctgtaatcccagctactcgggaggctgaggcaggagaatcgcttgaacccgggaggcggaggttgcagtgagcggagatcacgccattgcactccagcctgggcaacagagcgagactctgtctcaaaaaaaaaaaaaaaaactagacaccctgcttctcagaataggggatagggaatttggaaacaaaacaaaaactagacacccaaacttacaaaaattgttcaacatagaaaacttcttggctcaggtgaggcccctattggtaaaaggcatgggctatgttagaaggtctttggtatttgggctgctcagaggcctttttcagttcccattcatgccagtctttgaatagctgagatattagaacaactgagctctagactggaaagttgttagtataatatactatctatgaaaagaacctgagctgttaaaataccagaaaataaactagagctcatgatttatttctggaatcaatcagacaatgaacagcaattttttattgcctgttaagccatagtagcagtgagaaactgaaacaagcaaaaacacttagtgttgtaagaatgtataaaagcatctcaaggtaagaaattctgtgttactactgacaactaccatttaagttgaggaacctctagataaatcagaccgcagaatttgagaattaaactcaaattctgtaatgtaaagttcacttctaaaaatgattatgatttggacttattagagataatgtgcttttttcatattctgcaatttaatatgccactatttatgtacccaatgccttttggtaaaattttccataaaattgtatttgggtcaccaagcatatgccaacgacatttacgaataaagtggtaggtataaagggaaagaaaacacaggtttgaaaatc

SEQ ID NO: 27916 - DNA, 1057 bp, Homo sapiens
ttggaaagtagggcagataaatggcaagacggaaaactggatagaaaagatgagacagaggactgggaggtctcacatccaactcctgttctgtattctccagaaaggcagcacagagtacagaagggaggaatcatcaccgagagaatacctccccccaagcacatttggcatggaagaaggccagaagctgccacacctcctctgggaggatgaagttgagagaatacctaatgtatgtcttaggaggaaatgtcttggtgaaaggcgtggtgttgaattagaatcattgcatataaaactgagcaaacagaaaaacaagatgcataactttccacatttctcagcgacgactagtacttaacagcagcatcgtaatacaaagactgaagattgtcctaaccacagctatgatatgtgaccgatgggagactggggaatggaaggggatcgtgtggcaggggtggcagaaggaaggggataagtgggaggtcggtaggtaagactgaaaacagaaacatcacgaccagccgtagaggctgacagaggtgaatactgcatataaatgctgagatacttggccaaaagaagggcaagtggttcctttagaaaacagaaatgagaggagggcaactgctgtttttaaaattacatttaattacagttgactgtaaactgagtgctgcatataaacctataaaatcaataggaataggaacactggttaaaatctgccatttggctgacatttttattgatgggttcacatttttagctgcatcaaagcggtagtccagagtcctgtctccttctaccaagatgatagctaagagaaagacttacttggtaggcatctgataattgcacggttgatcacacataccagtctgatcgacttttttcctttacctccctagattatcctcttgacttgaaccacagtgaaaccttcctgcaaactacaacatttcttcctgaagacttcacctactttgcaaaccatacctgccctgaaagactcccttccatgagtgagtacagctctggcctgtcttcc

SEQ ID NO: 27917 - DNA, 1098 bp, Homo sapiens
ttggggttgatcaactggtaagtataatgcagatattccaaaatcctaaaaaatcagaaatctgaaacacttctggtcctaagcatttcagataaggggatactcaacctgtactgaaaagaaaatagcatttcactgaaagtgtatttaatgaaaacccatcattcttcttcatttcaaagcagttgtctacctagcacagtcagagagggtattctgggcccagcactgctgagacagccaaatgactgacacctctggcccgaccacttctgcctggagcactgttggcttaatggtggtaacctggattatgcaccatcctctgctgaaataatgctgaggcacatacccacattcaggcatctgcattaggccaagcatagctcaaaagcccagggtgacatttaagtcatgctggttttctttaagtttaaaagcaacatggtgattagtgaatgaaaacagacttttggggatggggtctgtgaacctggaaataaacctgaagtggtgaccaggagaagcttcctgttgtcactgaaagccattggtttgtgagattgtgaatctgcagagtgagtaaagtcatgctggtgtgctttgtaatctattaatggagtgggtcatcttcacctctttctcggtggttttagatgtccagtctgtagtcttcgatgtggctaccctcccagtaggtagtcatcctttaatggactaactcttgaagaatgctaattctttatatttcacagatatttgtcccagtggcatctttctagtatatataaatttccatatttttttcaagcagagaggcaagtgtttggtcttttctcaaatgggaggggaaagtggtgattcttgctggggtccattggtcagcactttcgattccttctcaactggatttggtaacacaagggagaaggcaggtttttacctcctccaggtattagggtagcaataccaagcttagctatacattggaattcccaaggacgtttccaaagtactgatgtctgtgcctgactgctagcgattcttatttaattggcctgaggtatagcctgaatgttagaattttgtttgtttgtt

SEQ ID NO: 27918 - DNA, 1033 bp, Homo sapiens
cattcttttatttctttactttcttaataaacttgctttcactttacggaaaaaaaaaagtaccatttaaatcatttgaagtatacaatttagtggcgttaagtacattctcaatattacgcaaccattactactattcgtttccagaacttgatttcttcattccaaacagaaactctgcacctattaaaaattagtccccttctcaacctctattattagtccacctattattagtccccttctccgcaacttctaataatcaccattctactttccgtgtctgtgaatttacctattctgggtacctcagataaatggaatcatataatatttgtacttttgtgttctggcatagttcacttagcatgttttcaaggttcatctatgttacagcatgtttcactgctttttaagtttaaattttttaagttttaattttgctaaacatcctaggatgcacatcagtgcttttattattattattttttaaaacaacctctaatatcgagtcttatttctgacaggaattctttgctgcagaagggtctccatagctcagccttatgttccaaaacactcatggtctctgtgtccagaacactccaagagcttgttgaaatggctcttcagcccatgcagccctcttatttgtgctactagtaaaataatgataatgctattgaatagctggattgttgaccctctggctaatatgatttgatggattttattatatggcattttaatcaaaggataagcttgtctcatttgaaatagatagaaaacctgaaaaagggacagtttaaaggtagcaatcaagtcaaaatagttttcttcttctggaatgtgataaatgtatttagtgagaggtatcttggagagcgtgattttaccacttactcatttgacaaattgctgagcttaggggccaagtcctgtaatatttccctgttgcttcaaggcaggtatactgaaaaaaatcagttattaaatatttgccatatttcctaaataacctattcattctttg

SEQ ID NO: 27919 - DNA, 1036 bp, Homo sapiens
atctgtatttttctattctccttccttctcctccagctttcagtctagatgttttctgatggcatagcttttggatcaatcattctctttttttgctctgtcttacccaatattaaaatattacaccctgttttttttttttttttttgagatggagtttcactcttgttacccaggctgaagtggaatggcacgatctcggctcactgccacctctgcctcccggacttaagcaattctcctgcctcagcctcctgagtagctgggattacaggcacgcgccaccaagcctggcaattttgtaattttagtagagatggggtttctccacgttggtcaggctggtctcgaactcctgaccttaggtgatctgcctggcttggcctcccaaagtgttgggattacaggcgtgagccactgcacccggccttgacactcattttgtcctatcttttggcatgcctgttaatttttattgaaaagtgggcattgtatataaaaaaattgtagcgaccctagatgattttctaatatctagatggcttacaccatttgctaggcaaatagaatgggggctgattccatttatcttgtctgagctgaccacagcaagggcgtggttttggtcaggctccatctctttttggtttgcctctactctttggaagtaccctgcaggagttctggctaagaactggggcccttcccccatggtgtgtcctgaactttaatctttgtcccccacggtgtgtcctgaactttaatctttgtcttcttagtacatgggattggtgaagaaacctgctgtgctattcagaggctttctgcttggtttcagccttctgacctgtgcatctttgggattttgtaaaatgtcttcagggtaaaacactcagttcttttcacaggaatcctaggcccttgtctctatttttctttcttcaggcctgagacattaccatgagctctgctggtttctctgcctgtgaatagtggctctggtcatgttcccaggctgcttttctgtttcctcagc

SEQ ID NO: 27920 - DNA, 1043 bp, Homo sapiens
tcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccacctcggcctcccaaagtgctgggattacaggcgtgagccaccgcgcccggccgcaatgttgtgtttttacatgtcagtggatccagggtatgctagtgagcacaactgtatattatttttattaaaaagttgtaggatatttaaatatcagtaaagaggtaactttttccaccccctcccaagtagtcctaaaagtatggataattgacatttaaaccttcttcttaattctactgtgttgaacaatcataagcttgggaagatggagagacagggttattttttcctcacagagctgctcattatcccattttaagttctactttcaggaaccaagcctaaattgtattcctgatcaggatgtgtgtatttgctgattggtagacttggctggtgaaggtcataaaatagtgttttcctaaatactgtgttgtgtcttgcttatgtaattgaaaaaggaaaaaaatgttttattcctgttcagaaaaatgacagaattgccaacctaaggaagtcaaaccagatagaccaaaaatgatagtagactgactttaggattcatgatatagttattttgaatctgtatttttttttttttcctgagatggagtctcactcagttgcccaggctggagtgcagtggtgcgatcagggctcactgcaacccctgcttcctgggttcgtgtgatactgctgcctcagcctcctgagtagctgggattacaggcgagcaccatgacccctggctattttttttttttttagtagaaatgcggctttgccgtgttagccaggctggtctcgaactcctgacctcaggtgatccacctgccttgggctcctaaagtgctgggattacaggcttgag

SEQ ID NO: 27921 - DNA, 1050 bp, Homo sapiens
ccccaagcatagtcttttataagaccacagggcaccagttaggacaggaagagatcagaaggaaagacagcatgaaggttaagagcggaggacacagaggtcagacttggattccaatctctgccctgtatgaccttgggcaggttactaagcctttgcatttctcctctgtaaaatgggaatgtgagtcccaatctcatacagtgttaaggatggaagtagatacatgttctttaaaagcacttaccactgtacctggtgcttgaagagttttaaaaataagtaaataaaggcagctattacatgtaacttccaggaagaagggagttaggtggaacgcttaaggaatgtgtttgcctgacttggcatcactatgaggaaacctcagtttatggtgaaaaatgatcagaagatgctgctggggtaggggcagggagagtaaattctgctagaaaaattttggattatatggattttaggaaagggttgatggtttagctgtagggaaatgccttttaggattgtagcaataactagtgccattctctgttgacctgtcaacgcagaactagctgaatagagaaatttccagatagagcaggagatcgtctcctgattattttttaagcatattttacttgtggttaatgttgatgttttgaactatcaactagatctgggaagatagaacaggcagcatcagattgccttgtttacaaagtgtcatcacgaaaagtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcctttttttctccttttgtgaaagtgacaggtacttctggtctgagtccataaatcagctatatctaaatggaaaactatatcccactgggatggtaatcacccttt

SEQ ID NO: 27922 - DNA, 1050 bp, Homo sapiens
aatcattgaatgtttgcagaacctttttgcttatcgttatggaatgtctacagagcaccctcatctgtacagacttaaggaatgttagctaaacccccttctatgtggaatcatggaatgttggctgagccttctatggcataaaatcatggaatgttaccaaatacatttcttactataaaatcttgaacatagttttctcctgatgctcagtggctcaggacctgtggtagctgctgtagtcagtagcctggtcagcctggtcagcggcctgcagcatttgcccatagcatttgcctgtggttacgatgatgagtttatgtctcaatcccagatctttcctcagtggagtaacaggaaagccaaggatggtgaaacttaagcggggaatggagtactagggctacctggtatctgtagatggctacatgaacatgcagcttgcaaatacagaagaatacatagatggagcattgtctggacatctgggtgaagttttaataaggtgtaataatgtcctttatatcagaggtgtggaagaagaggaagaagatggagaaatgattgggaggctgaggcgggtgaatcacttgaggtcaggagttcaagaccagcttggccaacaaggtgaaaccccatctctacaaaaatacaaaaattagccgggtgtggtggcacatgcctgtaattccagctactcaagaggctaaggcaggagaatcgcttgaacccaggaggcagagtttgcagtggagatcacactactgcactccagcctgggtgacagaggaagactctgtcttaaaaaaaaagaaagaaaaagaagatggggaaattagagaatagcatcttttgtgggggatttttaaaatatatatttctagacaataaagatttgtttttcaaaaaaataaaaataaatgaaatacaatattgaaacgttagctctatattccctacttacatgttggagagggcaggggatggtggctcacacctgtaattccagcactttggaaagctgagacaggcagatcgcctgaggtcagg

SEQ ID NO: 27923 - DNA, 1046 bp, Homo sapiens
gtacatacattgggccagggaaagctgtgggttcttcatcctcagtcagccctcccaagggaggagaggagaggttccaaaattatttcaggccagatatggtggcccactcctgtaatcctaacactgggaggccaaggcaggaggatcacttgagcccaggagtttgagaccagcctgagcaacatagtgagacccctgtcgctataaaaagttaaaaaattagccagtgtagccgggcgcggtggcttatgcctgtaatcacagcatgttgggaggccgaggcgggcagatcacgaggtcaggagatcgagaccatcttggctaacacggtgaaaccctgtctctactaacaatataaaagattagccgggtgtggtggcaggtgctgaggcaggagaatggcatgaacccgggaggcagagtttgcagtgagccgagattgcgccactgcactccagcctgggcgacagagcgagactgtctcaaaaaaaaaaaaaaaaaggttagtagtgcacgcctgtagtccctgctagtcaggaggctgaggtgggaggatcacttgaatctgagaggtcgaggctgcagtgagccatgatggtgccactgcatccagcctgggcgacagacggaaaccctgtctctaaaaaataaaatggccgggcgcggtggctcacacccgtaatcccagcactttgggaggctgaggctggtggatcacgaggtcaggagatcgagaccatcctggctaacacagtgaaaccccatctctactaaaaatacaaaaaattagccgggcgtggtggcgggcacctgtagtcccagctacgccggaggctgaggcaggagaatgacgtgaacccgggaggtggagcttgcagtgagccaagatcgtgccactgcactccagcctgggcgacagagtgagactccgtctcaaaaaataaataaataataaaatgctgctggaaaaccccagaacaaattcgtggttaaatctaaaggtggcctcttctgtgctgagttacccccaagaggaaaacaaa

SEQ ID NO: 27924 - DNA, 1046 bp, Homo sapiens; identical to SEQ ID NO: 27923

SEQ ID NO: 27925 - DNA, 1046 bp, Homo sapiens; identical to SEQ ID NO: 27923

SEQ ID NO: 27926 - DNA, 1038 bp, Homo sapiens
ggcctctttcagaccttcctgatttgtgagagttcccagtcttcataatgccagccaaccgttttttgaggacacatagtaaaccctcaagaaatgtctcttaactctcacaagaccccattgttaggtgcaattgcattccatttcacagatgaggagacagactcagaggagtcagatctcttgcccaaagtcacatagctggtaacccccaaaccagatctgactccagagcctgtgctcttaaccactgtgctgtggtgtctcccttttgtttacattttgagttttcatctgttaccattatagaagatactaatcaagtagtaacttgatgtaggagtcaagaaattgatttccatactgtgacacacacttcagacaagcagtaagggcctctgcctgaatgtagcaagacctgtcctgtgtctgcttgtgtttaaggatgatgacaacattcattcttttgattgtgtgcaggactctgcactagcactgtgagagcagaaagacatgtagggcgtggcccgggctggaacagggacaagtgacatgttcgttaagtgttaggacactaatgctcatttcagatggtcatcaacactcatggtgaatgattggctttgccatttaatgttgcttcttaagtcattttgtgaccctatagttttgtggagttttaaaaatatatacatttgatctgtttttactcatttctttatcctttttttcctgtgaaaaccagaattttctgcgtctgctaaataccggggaaaacccaatctagaaatcctgtttctccatggagataattttctttgctgtctctgaaggtccatcatatgctgacatcttcttcactgcatgtcttctcttcctaagaatgatttcggtttcttgaggatgagaactgtgcttccctccttacttcccagaatacctagaaatgactcagaatggggtactcagtagatttgttaatcaacttactgatttacaggttctaaaatactgagaattgaaccaatgtacaacatt

SEQ ID NO: 27927 - DNA, 1038 bp, Homo sapiens; identical to SEQ ID NO: 27926

SEQ ID NO: 27928 - DNA, 1038 bp, Homo sapiens; identical to SEQ ID NO: 27926

SEQ ID NO: 27929 - DNA, 1038 bp, Homo sapiens; identical to SEQ ID NO: 27926

SEQ ID NO: 27930 - DNA, 1038 bp, Homo sapiens; identical to SEQ ID NO: 27926

SEQ ID NO: 27931 - DNA, 1034 bp, Homo sapiens
atgttagactcccagataatggtgctgtgaatgtttctctcttgtattttcaaaaataaaccagattagaattttgtgacattgagcgttgttcattctgaaatactgttcctagctaatacctagtcattcattaattctttcaataagtatttgggtgcttactctagagggcaaaacaccctgacacattggagattcagcagtgaacaaaacagatgaagttttactctcatggagcttatgttcagatgggagacagacaagaaacaaccaataaagtgaaaatgaatatatttacaatgtcgagtggcaatgagtactatgaagaaaaataaggcaagataagggaatggacagttagacccttggttgaggacaagggaaccagtcagccattcacagctctgggacagagaattccagggtgagggactcacaaatacaaaggcgggatgtaaggatgcctcttcagaaacttagagaaggactggtgtagctggaggaggatgggggagcaaggcagagtggcacaaaatgatgttggcgaagcaggtggggctctctcggccaggtgacaagtttgggtggattgcgggtgcaacgggaggccaagagtaggcttctggtaggagagcgagggcacctagtttacctttaagaggatcgtcggccgagcacggtggctcacacctgtaatcccagcactttgggaagctgaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgattta

SEQ ID NO: 27932 - DNA, 1034 bp, Homo sapiens; identical to SEQ ID NO: 27931

SEQ ID NO: 27933 - DNA, 1034 bp, Homo sapiens; identical to SEQ ID NO: 27931

SEQ ID NO: 27934 - DNA, 1034 bp, Homo sapiens; identical to SEQ ID NO: 27931

SEQ ID NO: 27935 - DNA, 1034 bp, Homo sapiens; identical to SEQ ID NO: 27931

SEQ ID NO: 27936 - DNA, 1031 bp, Homo sapiens
gttttccaagattgacatgctgtggtagctgctgcttggtggccatgattttcccaaaagatgttttaaacgacttcagaatcctttttgtaccacaaatatattaatatgttgctgtgtttcagattactgcattaaatgttttactgtggcatggtgtaaagctctatcaaatattcatgctttttcaacctggttgccatattttctttgtaatatcctgcaactgctgtcttttcagtttatatttagctaagagaataaccggctgacttttgatactgacacaggtccaggaaaaagccttctggaaagaataattctgaaataataggaacaaatattttcttcaaaaagtcttggattactgtgatattttagcaccttgatgaagtttttttttttagcattttcataattcactttttaatagtcatagtctatttgattatacttatcattagctatagattttcctagtgtacttcctagctattatagagcctgtagttctcttggttttgcaagattataagagtccttttgtttgtttgttttttgtttttttgtttttttgttttttgttttttttgacgagtctctgttgcccaggctgggctgcagtggcatgatcgcagctcactgaaacctccacctcccgggttcaagtgattgtcatgcctcagcctcccaattagctgggattgcaggcatgtgccaccacaactggctaatttttgtatttttaatagagatggggtttcaccatgttggccaggctggtctcaaactcccacctcggcctctcaaagtactgagattacaggtgtgagccactgcgcctggcctgtaagagtccatttttatgtcttccatattgtcacttgatgctgtttctccagctgcctttttggtgtcagattcacacagaaatattgggaatcctaaaattttatgttgattcaattgattaaagtgctagaggaccaaaacatatgttagagtattcttgggttttctcatctgttgtg

SEQ ID NO: 27937 - DNA, 1050 bp, Homo sapiens
ttggtggaagcctctgatattggatgagggagaacagatgaattgggagccccgaggatgtctctttgggagtggggattcaactgagggaagcccctgaaatgagggagtggaaaaggtcgggttccggagatgtttcctgtaaaggagaaaagtctcctctttttgaattgagtgagggaagcatatcctagaagtgtctcttctgtggagacgctcactctcatcgactcctttaataattgggacagatatgtgggttcagctcagaagttccccactggctgatgggagtagggaggtgaatagatgaaatgggaactcttgggtgaggctgcaccctcaggtgcctggcagtgaagttggccaaggaggttctctcagatggggtgaaaatgggttacctctctgatggaggaagcaaacagggccacagtgttccccactgtggggctgcagggacaccagcctgagtacagcaatcattggcatatttaaggccacagcagcggcagtgttgggaaggaattggtgatccatgggaaatagggtgaggggaattctttataaatgttgctactctgcggtctcaaggagccatacttgcctgatggttggggtgggaataaaagaaattgaatgtgggggatctgactgaagtgacccaccacaagctgctgccttttgagtttaaaacagtggggtcttcttgcagaatagcggagaccatgaatccttttactcgattttggtttcagctggaacagtgctgagtcaattcatttaccatgacgctgccccaggcactcccagaagagagattctgagtcaggccagactgctgggtaaaacttctcaccagaataacactcctaccgggtcgtaataaacgaaggggcccagtgtgctggtggtagccagcaataaggtgctgttgcagctcagccctgcttgcagtcactcggttggctacctacaatctgggttaacagctgcccggttctaacttctccagaccctgacagttaaaaagtgagtgcttcataaatg

SEQ ID NO: 27938 - DNA, 1027 bp, Homo sapiens
ccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtgga

SEQ ID NO: 27939 - DNA, 1058 bp, Homo sapiens
cctgaggaccaaaaacacttgtaaacaggtattctgggaatgctgttgatgtctgccttcacactacagctgcagagttgaggagctgcagtggagactgccttggcctgcaaagcccaaaatatttactgtccatttatgtatttatttatttctgagatggagtctccatctgttgcccaggctggagtgcagtggcacgagctctgctcactgtagcctctgcctcccaggttcaagcgattctcctgcctcagcctcctgagtagctgggactacaggtccgcaccaccacacccagctgatttttttgtgtttttagtaaagacggggtttcaccatgttggccagactggtatcaaactcctgacctccagtggtccgcctgcctcagcctcccaaagtgctgggattacaggtgtgagccaccgtgcccggcctgcctgaccctttaaagaaagtttgccaacctcttatattctgtgtaggtatagaatctctatcttaacctgggggttggtcagacaggtgtgtctacgcataaaaaggctgtgagctgtgtaaggcctatggcctttactgtttgtaggttatattcaattataacataaaatgagccaaggtttagagaggggaaggggcttgtccccatctcatcaggagcccagaactcggggaacaaggaacctggactctgaatcccttgcgaggccccacccttatgacatccagccacttctcctctgtagctatttctttcatgaaggcagcattcattcattcatttatttttgagacagagttttgctcttgttgcctagcctggagtgcaatggcgaaatctcggctcaccgcaacctccgcctcccaggttcaagccattctcctgcctcagcctcctgagtagctgggattacaggtgcccaccaccatccctggctaattttttgtgttttttgtagagacaaggtttcaccatgttggccaggctagtcttaaactcctgacctcaggtgatctgcccaccttggcatcccaaagtgctgggaggagtgcaa

SEQ ID NO: 27940 - DNA, 1058 bp, Homo sapiens; identical to SEQ ID NO: 27939

SEQ ID NO: 27941 - DNA, 1058 bp, Homo sapiens; identical to SEQ ID NO: 27939

SEQ ID NO: 27942 - DNA, 1058 bp, Homo sapiens; identical to SEQ ID NO: 27939

SEQ ID NO: 27943 - DNA, 1058 bp, Homo sapiens; identical to SEQ ID NO: 27939

SEQ ID NO: 27944 - DNA, 1046 bp, Homo sapiens
tgtagtccccaggactgaggcggaggtgggaggatcgcatgagcccaagaggttgaggctgcagtgagccgattgtgccactgcactccagcctgagcaacaaagtgagactttgtctcaaaattttttttttagtaaaacttgtgtagcctaagtgttcataaagtctacagtagtgtacagtaatgtcccaggctttcatattgactcacccagagtaacttctagtcctgtaagctttgttcatggtatcatttatcttttacattgtatttttactgtaccttttctgtgctcagctatgtttaaacatacaaatatttaccattgtgttaatcattgcctatggtaatcagtacagaaacatgctgtacaggtttgtagcctaagagcaataagctatgccatgtagcctaggcgtgtagtaggttctaccatctaggtctgtgtgaatacacacttgaggatttcacaccatgatacatttttcagaatgcatccctgtggtttagcaacacatgactgtatagtaaacctgaagtctttagtaacttccttcatttaggttattcttgttatttctagctgcaaaatgtttatcttcaagtcatttgtctttggtttagctaaaatgtgactttttttccctaaacattgagaaagaacttagcatttttttaatttacactgacaaaaatatttggtttaagatagctttttttttgagtttctattttataaagttactatacaaaaggggaaaacatactaaaatcagtgcttttttttgagacagtttcgctcttgtcgcccaggctggagtgcaatggccgatctcggctcgttgcaacctccacctcccagcttcaggcgattctcctgcctcaccctcctgaagtagctgggattacaggcgcccaccaccacgctcagcttatttttttgtatttttagttgagatggggtttcaccatgttggccaggctgctcttgaactcctgaccttgggtgatccacccacctcagcctcccaaagtgctgggatt

SEQ ID NO: 27945 - DNA, 1054 bp, Homo sapiens
gagaatcgcttgaacctgggaggtggaggttgcagtgagctgagatcgtgccatcgcactccagcctgggggacaaaagcaagacttcatctcaaaaaaaaaaaaaaaacctcattaccaaaatccttgcatacttaagtcccacagttggccctggagaacctgcatataccaaaagctagccctctgtataagagggtttgagcatcccaagaatactgtatctttgatctacatttgtttggaaaaaatccacatataagcagttcaaacctatgttgttgaagagtcaactgtatagtaaatactaggtgacagaaatttttcagccccgttataatcttgggggaacatagtcccatatgcagtctgtactagacagaaaacatcagcacatgacttcctgataatgacagttaaaaaccgtattgccagtttatgtatttactatatatactttttattttagagtgtactcctactttttaaaacagcttttcatggtaactggtagcagcctcatacagcttgtgttcactgtgtctcttgattgcatcattcttgtgcatggtttaatctcatggtattttgttcatcatggcccctaagcatacaaaatccataatgttgccagtaaggggccatgttgagtgattgacctggaaacagaagtgattaaggactacgaaggtggagaatcagtgatggttatttcttgccagtcaggcttgtcccattttaccatagctatgatcttgaagaacaagaacaaagtgacagaagctgttaaagcatctgcttcattgaaggcaatgagactaacaaaaattcaagaagggcctttatcagacacacacaagcttctgatgacctggattgaagagcagacacaggtgcacacggtgctgtgtacctctcagcaccatgatgatcccaaagcaaaaagtgtgtttgaggtgttgaaagaaaaggctggacctggctgtgatgttgaattgactgctagttctgggtggtgtaaacaattcaagaatcgttattcattacataatgg

SEQ ID NO: 27946 - DNA, 1035 bp, Homo sapiens
catcatactgcttaactttctttgaatagctttctttctgcctttttgggtttgaaatttgagttttcttcctgatctgatctcctgccccctcccctcgaaaaaaatcttttttttgcacagaaccagaaatcatatttgcagtgctgtaagcaaacattgctattttagacaccattccagtactgtaactgacgagttagagtacagtactctaatgaaaagtgctttgatattagtgtgtggctgaattttttacttaattagaacttccagcaatttccttggaaacctgactgaccatcaggaaagtggttggttgatataaaatgtagactgcaacttccatatgcctttttatatttaagagccttatcactcctagtttaagtccttgttgacgttggttttcctgtgcctctccccatcttagttaagaggtgagatttacatgtaagattgggttagcgtttataccactatgtttttgtaaacttatttcactgttttctaggattttaaacaatttgaacctaatgacttttatttgaaaaacactacatgggaggatgtaggactgtgggacccatcacttacgaaaaaccaggtaagtggcacaggagacttcctcagatggcagcatgcttggtatactcccttttcagctctaggccttttatagcggtgcagtgattgcgggcaagtgccaaacatcgaaagtgtcaaaattgcatttcatattttcctgaccagtgggaagactaagaaaaactttttgtccttttttgtcattggactaaaacttgaggtgtaagaagaaacaaaattttgttacttaaaagttacgaagcctgctgtatcccaccatttcccctaaaagtgctctggctctatttttctgcatctgtgttgccattcttgttttttctgcacagaaaaagacaagacccttccttacatttaagcttttcttatttccctatgttgatggcacccaacttctatgggaggcctggggaagtgactctgtaggat

SEQ ID NO: 27947 - DNA, 1505 bp, Homo sapiens
aggtttttttgaaatacttttcattttcggccccaattagactttggtacttcatatagaatattttgagacttctaagttagagtaacgtacccagtttcaaaatttctaggggttactctttgattttggtagatttcactctttctccttttattttccatttttttatagttaacgttgattttggattagaataataaatgaggcagcattttattacatttggattagttgacttgccatttacagatgatattggtattacagagtaacagcctttgttaattagaaaactggatttgcatatattaaattttaattcctggtgctttgtcttttgtttttgctgttttgggttttagaactactttatatcctgcgaaattgtgttagatttggattattaaattgataaatttttaccatattatgggaagcatttctgatctcattagaaaccatacatattctcagctgcccaggttttactgattttattttctcattaaagacaaacttctgttttaaggaacttgggaaagttgatatgaatttctaatttaatgtattaggtcattaaaataatttttgagttcccttagacacatacaggcttttcatttttttcaaaagtaccctccttaaagtctgtaacagttaacatttttgagtacctttgcccaggtacgttgcaggcaggggtggagtgggggcatgcattggtcgagtcacatatcattactgtatttagtttggggagtatacagaaacttaaggtttttttgtttttgtttttgtttttgtttttgttttaaagaataccgtagcagtaggcaggacagttccaattcaacaaaaacctctttaccctggcactcaaaactgtaatgatgatgaactggtaagcatttttctgttttcagatgttcaacatcaaaatgagaaaagcactaacacttgatttaaaaataattgattgctagtatttctctaattttcatcttgaagttcattactgaactgttgttaagtcttatcagaattatgccagattagactcatagtcaaaatgtcctgttaaaaactgggaaaatcagagagtacttattttgcctgcctgctttaagtattcaaaatatagtagatatgtgctcggctcagtggctcacgcctataatcccagcactttggggtgccaaggcaggaggatggcttgagtccaggagtttgtgagcagccttggcaacatagtgagacctagtctctacaaaaaaattttaaaaattagttgggcatagtggcgcactcctggagtcccttcctcttgagaagctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgc

SEQ ID NO: 27948 - DNA, 1031 bp, Homo sapiens
tttgtaggcaggtatagtttttatctttatttggtgttttatatgcagttatttaagttctgaaaatgaccatataatttgaagacaacttatttgacggaatgtttgaaatgaagtttgttgaggggcttttgtttgatttagcgaatgggatacagtgttgaatgatgtcctaagtggtaacagccattttcccttaaaggaaaacttgctgtgagctcttagaaagcatgtattctactgtttcaaaggtttcttggttttaacactcaaaaaataaggtgaggccaggtgaggtggcttacgcctgtaatcccaaaactttgggaggctgaggcaggagaatcacttgaggccaggagttcaagaccagcttgggcaacataatgagaccctgtctctaccaaaaaaaaaaaaaaagtgaaacaattgggcttgaagactggaatttatagtaggtaaactatatacttcattaaagtatagtaaaaggttcaattaactagagtgtggggaatgggtattctgtttaactgaactttaagtagaaattccttttttatcttggcctttgttgaaaaatttcctgagactagcttattaggagctatatattgaaactaacctctttgattttggtttttatagttcctgtatagaaaatataggagattgggctgaaaatctcttaatgacccttggcccttccaaccttggaagtcattgattttatacatgcccactgtgaatttgctttgctttgcttaagtttatctttttctccttataccagagtgcaggaagagttttaatactatttatattaaaataagaacttcacaaccttgaacagatggttttggtaccacttgcaagtaaccaaccagtaggcttttatcaggcaaaaatggcttattatttatatttgattattaaaagtataggtatataaggcatactatgtgaagttgttgctttccttgtaactacttacacgttttgaaagtattaaaaagttagtattttgaaaa

SEQ ID NO: 27949 - DNA, 1033 bp, Homo sapiens
ttcacccactgttaagtgtctaactgtgacctcaactggtgataggtgaatcccaccaggattgtttctatcctgtgatgcctcgttcctgttttaacctagcttcccaagctcatcctagagcaacttagtttatcctggggaatttataaaggaaatcatgagaaatcaaaactcatcataaacatttattggaaaatgactgtgaattatgaggttctttcttgtcatctaacatatatagttgcttcatgatcatctgtccaccctgttgttcaatatttggaacagtttctttcaactttaaattttagggaaatcttaaataatggatggttctgcatcaaatgattcattttaccgtatttcactaatttctgatagtatggtgggaaaataattctataaaaagataactgagaattcattttcacaattattctaagttatttagcaaatatttaatggcctttcttgcttaggacaaatgtatcataatcatcaagtgtgcgagcttttctgtttaccaatggccagtgaaagttttaggctttatacataccagtgaactctttgaaaggtcaggatacataggcatgtgtatttatccagaagttgatatatatttttaatttcttacagattataccgaaaagaagttctagagaaattaatagaaaaatgtgtttctaaaggctacgtcttccagatggagatgattgttcgggcaagacagttgaattatactattggcgaggtatgcaactgatgctaaatagtgtgtcatgttcctggtaaaggagcagtaaggtttagaatttttataataaaaagtttaactttcataactgctaaattgtggaggtcttctagttgtttagaatattcatgcacaaagggtaaaaattcatattagtacatttgaacagtaagatttaaaacattaacagtcagcattctcttttaaataattaaaagttcctggtactttctcaatcctagccctttcttctaactaatcagcattatggac

SEQ ID NO: 27950 - DNA, 1042 bp, Homo sapiens
catccttgtaaaatataaatgttaccagtaaaaccgaagttgcctttgatgaacattttatttatttatttatttattttttttttgagattggagtctcgctctgtcgcccaggctggagtgcaatggcaagatctcagctcactgcacactctgcctcctgggttcaagcagttctcctgccccagcctcccgagtagctgggattacagacctgcaccaccatgctggctaattttagtatttttagtagagactgggcttcaccgtgttggtcaggctcttcttgaactcctaacctcaggtgatctgcccacctcagccccgcaaagtgctgggattacaggcgtgagccaccacgcccgacctgatgaacattttctataggcatcccattcccttgcacaggggagacccaggtcaacagtttggtgcgtttttttgtgcatatatgtgtgtatgtgcatttgcagaactaggtagtgtggtggtcttgttttttaaaacataactgccatcttcctgtatcatcattacttctaattctgtcttggcgatcttttgtcaccagctcacctcatttctgttaatggctccataatactctaatattttatataaacctttgaagattctgaaaattataagtatcatagtctccttgtccatggttttgctttccgtgatttgttacctgcagtctgaaaagaggtaagtacagtacaagaagattttttgagttagaccaagttcacataacttttattacaatatattgttgtaattgttttattttattattgggtattgttaatctcttactgtgcttaatttataaattaaactgtgataggtgtgtatgtataagaaaaagtatatataaggtttggtactattggagatttcaggcatctcctgggggtcttagaaagtatcacttggggttaagggggtgtgcaactgtaacaaagttatgtttgtttgtttgtttgtttgtttgttttttgagacggagtctcactgtgtcactgaggctggagtg

SEQ ID NO: 27951 - DNA, 1048 bp, Homo sapiens
tttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaaaccataagcttcatattgtatttctatacacggtcctcgatgactggaatcttttttttttttttttatcgagggatggaacatataggaacagtcagttaagttttaggcagaaaaaatttttaaggcccggcgcagtggctcatgtctgtaatcccagctttgggagaccaaggcaggaggattgcttgagcccag

SEQ ID NO: 27952 - DNA, 1033 bp, Homo sapiens
ccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttcccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtg

SEQ ID NO: 27953 - DNA, 1050 bp, Homo sapiens
cagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttct

SEQ ID NO: 27954 - DNA, 1030 bp, Homo sapiens
aggcgttgtaagatgacctgttggaatataagaagaaaatagcaaaacttctgtttgtatttatttttcctaactcttttaaatttacatatatatatttatttatttatatatttttgagacacagggcaaagccaccatgcccagaatccttttttagtatttctatttttatgtatgttttgtagtgcacataatagattttatatacttataaaatatattttatataatatgtagaaacagagtgagaccctgggtggcggagggtctcactctgttgcccaggctggagttcagtggagcaatcacggctcgccgtagcctcgacctccccaggctcaggtgatccccctacctcagccttctgagtctgggaccacaggtgtacaccaccaccaaatcagtttccaaatcagttcatttcttcccaatggactgtgagccacgagtccctgcaggtccagcaagatgacctcatgctgtgctgtggatcctgtcgggtgctgacacaggctttaattcctgtctagaaacctgtttctagttcagcatcttagactacaggtgtacaccaccacacccggctaatttttgtattttttgtagagatgaggtctcaccatgttgtgcaggctgatctcaaactcctggactcaagcaattctcttgcctcagcctcacaaagtgttgggattacaggcatgagccactgtgcccggaatcctcactcttttttagtatttccatttttatgtatgttttgtagtacatataatatacatgtgaaatgatcctaatatttctatatatctggacaggtacacatatataacttacaaataaacatgtgtatttggggattattattattactattctgagatggagttttgctcttttgtccaggctggagtgcagtggcgccattttggctcactgcaacctccgccttatggtttcaagcgattctccggcctcagcctcccgaataactgggattacaggcgcccacctaattttagtattt

SEQ ID NO: 27955 - DNA, 1061 bp, Homo sapiens
gcacaggaaattttcttttcttttctttctttctttctttttttttttttttttgagacagagtttcactctgtcgcccaggctggagtgcagtggtgcgatctcggttcactgcaacctccacttcctgggttcaagagattctcctgcctcagcctcccaagtagctgggattataggtatgtgccaccatacctggataattttgtatatttagatatttagtagagatgggttttctccatgttggtcaggctggtctcgaactcctgacctcaagtggtccacctgcctcggcctcccaaagtgttgggattataggcgtaagccaccgcgcctggctgcacaggatattttctaaatcagccccttgtatggatgtagaaactgaggctaagtgaggcgtctccattccccaggttctcacattgggaagcagcagagccgggactggagctggggtcttggacccttcctgtagtaccttgccttcatcacagcatgggacattagccatgtcgtgcacctgatcgttcttttcatgcttttctggaacttgaacttcccaattccttccccagtgtttgttctcttacctcaaaccctgagaactatgactaaacgaagctcaccaaaaagaatattatttttaggacaggcgggatattgagggaaaacagacccagctaggggagagggcccgggaggctcagccctgagaggtgcccggtgccttccttctgcccgtctcactgcctgggtttccatcctacctctccctttacttcttctgtgacccttggcaaatgactgaagctcttagcgcttccatttccagcctccagaagctgtcatgaaggtaacagagagctcagcgtgggtgctgggcacgtagtggacactcaggagacaattgtcatgatcttctttcctatactttccctcctatccagattttctttgaccgatagccccaagactgctcccagctgggagcaaagagaacaaaagggttaatgaggtaaaatcacagagcaggaagcacattccatgaggactct

SEQ ID NO: 27956 - DNA, 1051 bp, Homo sapiens
ccgctttttctcaaagtgaatggtactttatctcttctgtggatgaattgcacttgaaatcagatttgtcttgtttttctaagattctgaatcatgattgagaaaaaaaaaaagaactactttcctttggcctttggtgtcttcagaggccagtgttacctttttgctgtggttgtttttttttttgagacggagtcttgctctgtcacccaggctggagtgcagtggcgtgatctcggctcactgcaagctctgcctcccgggttcacaacattcttctgcctcagtctccccagcagctgggactacaggcacacgctgccacgcccggctatttttttttgtatttttagtagagatggggtttcaccgtgttagccaggttggtctcgatctcctgacctcgtgatccgcccgccttggcctcccaaagtgttgggattacaggcgtgagccactgcgactggccttgctgtggttttttttttacaacttttattattttgtattgcacagttattttatgtctatagtagaacacatgaatgcattgatcagaaaagtaaaaagtagcccataatcttactaaaggtatagtcattgttaatgtcttcctgatcagccttctaaaaactacttcagaggccgcctactgccaaatacaaataggtttatataaatgcctcatgaggctcagaggaggctaaatctagttaaggtgaaatctttcagaaagccgtactgtttccaagtccctgtaggattctgcatagacttggctggctctagaatcgtgcctttgaaattcaatatcaataaaacattgctagcctaggcaaggtcagtttatggaacatgtgtagaaaccagtatgcattttacttgggagctgctggagtaatttctaccagttggcgtaggattcatttcctgtaacagaaagcaggatttcctaaatttgtttcctgtgcacattccagttggggaaccttgaagtgtctttattcagctatcgattacagcctgggggcgctgggccctccctgccacc

SEQ ID NO: 27957 - DNA, 1043 bp, Homo sapiens
ttgagacagggtctcattctgttgcccaggctggagtgcaggggtgcaatcatggctcactgcagcctcgaactcctgggctcaagcagtcctcctgcctcagcctcccaaacagctgggactacaagtgcatgccaccaggcccagctaatttttaaatacttttttagagatgggggtctcactcttgcccaggctggtctcaaactctcagactcaagtgatccttctgcttcagccaaaacgctgggatcataggtgtaaaccaccttgccttttccttctttgttgctctctagtacagtagtagacactcgattaggatcctgtgtggcaaggagagggaatgaagcagcacaaactatccctggagtaccgtgtgtcaccatccacacatgcactacttaatacaaataggcagaggtgcactctcccttgaggttttttctgctacattttatttccactgcctgcctttattttcatcatactttggtacgtctctcagtccccctgatgactaaagagcgagaaattctgcacggtcatgcctgggccacgcctgggcacagccacccaggggacgcagcatgcagacgttcacatcctgcccctccttgccactttccacccatgtcacctgaaccaattttttcttgctttcaagtcatttattaacaaataataattaattactctttttattctttgataatttgactgaaaaataattatctcattcagtttgaatttcctagattacctggcaggtggtcatatttgcatctgtctcttttgtttctttgtaagttactagttggcttaaaaaaaaaaaaaaagagtccctctgtggcccaggctggagtgcagtggtaccatcttggctcgctgcaacctccgcctcccaggttcacgtgattctcctgcctcagcctctccagtagctgggattacaggcatgtgcaaccacccctggctaatttttgtatttttagtaaagatgggatttcaccatgttggccaggctggtctcgaactcctga

SEQ ID NO: 27958 - DNA, 1140 bp, Homo sapiens
ctccttgcttcctcccttagaggtggagcaagagccctgttggctgatggacagttgggtacagtaggtgtgtttgcatgaaggattggcctgctggggttactcagaaactgctctgcaaacacagaggattaaaggggtttttgttgaggcagaacagatggacagagagaggcagagttcaaatgaatggatcataaatcagcactcacttgcagaagggaaaaatctgggtctggtcacttaaaaatttgagctaattttaattattatttttttcttcttaggaaagcaaccttacgcttaatggaaaaacaattcatgtgaaaaatttggaaaatatatgtgccagagaaagccctgctgatccttttagtgaaatctccctgattttgtcctctgtcctgctaatgtacacacatatacataggcaattattatttaataagaatgaaaacacatgctcttctatgagttagattttaagagggaacctgtaactagagcttgaagatctgaacccgggtgtgatcatttgggccaggtcagcagcataaattttagtaataaaaccaaagacaatgtgtaaatttatgtttgggaaagttggggcaagctcaggtgaaggaaaagttcattggcgctgagggccacgttgaatttacggtcttccttcaagtaataccttcctgagctcccagaaaaacgacaggtctgtgttcatttttccttttgccccctagtggagcaagaagagtggttcaggccatgaaatcgttctgccaattagaccgtctctttacccatttctctctttctttcgctccctctctgttttctattttttgagacggagtttcgctcttgttgcccaggttggagtgcagtggtgcgaactgggctcactgcaacctccgcctcccgggttcaagcgattctcctgcttcagcctcccgagtagctgggattacaggcgtgtgccaccacatctggctaatttggtatttttagtagagatggagtttctccatgttggtcaggctggtctcaaactcctgacctcaggtgatccgcccgcctcggcctcccaaagtgttgggattgcaggtgtgagccaccatgcccggcgctctctctttc

SEQ ID NO: 27959 - DNA, 1051 bp, Homo sapiens
tcataccaatccttctgtcctcatgtttgcagatggagatctctactctgaagccttttaggggcgtgggcacttttgagagcctgagctggaactgaagctggagctgcagtctgggccttggtttgattcttggcctttggccagcacagcctaagacccttagcagtgcgggcatgagcatgcgtcccaagtttggagtgggcaatgtaggcaagtcgatgaattttgctgccgacaccctttgagatcttgggcttaacctctttggactttacaagggtcttgatagcctcggcgtgtgcactcagggccttggtggtgttggcctgcatcttcttcatgcacttcttcttgtacttcttggcaaagtgcatgttcctcaggaacttggggttcacccacttaagaaagtcatatctttgtgactgggatttcttcctttctttctttctttcttttttaaatttcttcttaaaaaaaccaaaatgggatacacgtggactgggatttcttgatgccatttctgttccattttcgggcctggttgtgtgtggttgtatgtggacttggacatgtctgcaccgaacccacagctcccgaagtgcctggaaccggaagaggaccttatgctttagagggggttaggaatttcatttatggcttatccctgtttatttaaccagtcttcctttgatgaacggtgttatggtctgaatgtatcccttctccctaaatctgatagttgtatgaagttgggcactgaggaggtgattgggtcatgaaggcagaatcctcatgaattcccttataaaagaggcaggaggggctgagtggggtggctcacacctgtaatcccaacactttggaagatgaggtgggcagatcacttgagcccaggaatttgagaccagcctgggctgcatggtgaaaccccatctctacaaaaaaaaaattacaaaaattagccaggtgtgattgtgcttgcctatagtcccagctacttgggaggctgagaggtgggaggattggttgagcttggaaggttgag

SEQ ID NO: 27960 - DNA, 1044 bp, Homo sapiens
tctgtcaataacttttgttatgttgcacgagtgacattatttctcagagtctctgtttttcacatctttattttttcattatttatttatttattttttgagatggagtttcgcttttgttgcccaggctggagtacaatggcacaatctcagttcactgcaacctccgcctcctgggttcaagtgattctcctgcctcagcctcctgagtagctgggattaggcatgcgccaccacgctgggctaagtttatagttttagtagagatggagtttcaccatattggtcaggctggtttcgaactctcagcctcccaaagtgctgggatcacaggtgtgagccatcacgcccagcctttaatggagctgatatttaataggattgaatgattacagtatgggcatctgctggtacaaaatctgaattataggaagataatggggctcatcttttcaccattgggtccccaacccctgctttgcacgcagtaggaggttagtattgtggaacgagaggcattacattgttttattgtaaggcattgttctcagcagtcctggttgaatcagtaaatccaggcatctacctaatcatctaatcacgaggttgtcatctcgcgattacgcgtgcccagtaggctttcttaggggtgtgccgacttgcctatcaataactacctgttattgataggcaaggctaggttggccctgcctagctttcttaactctggcaggccagacctgcccatggctgttgtctcttcccctgacccacccccagcctacacataccttgcaagacttcatattgtgacccagtctgaaataagtaaagattaaatcagtttgttaaggccatgcttcaagatcagcccctcctggaaacccgtgggtggactgtgctgtcaaaagtccgtggctttggctgggcacggtggctcatgcctgtaatccgagcactttgggaggctgaggcagacggatcacttgcacccaggagtttgagaccagcctggccaacatggtgaaaccccatctctactaa

SEQ ID NO: 27961 - DNA, 1034 bp, Homo sapiens
aaaatgtgaaagccccctttgaatttcccacttactattcaccaccacattcaccttgaaatccaaacttctcaaaattaaccaccgtgagcagtttagtccagacttttctatgcatttatatttctattcatatacacatatctatgtatgtctaggataatagatatattagatacatagataatatatttatctacatatataacacacacaagtgtttgtgtgtgtgtagaaatataaatatagactgggtgtggtggctcacgcctataatcccagccctttgggaggctgaggtggaaggattgcttgagtccaggagtttgagaccagcctgggccatatagtgagaccttgtatctagaaaaaataaaaaataaataaaaataaaaataaaaaggaagaaaagaaagaaaaaaattagctgggtatgatagcatgcacctacagtcccagctgcttgggaggctgagacgggaggattgcgtgagcccaggaggctgtggtggactgtgatctccagcctgggtgacagagtgagaacctgtcttaaaaagaaaagaaaagaaaaagaactgttaacagcagtgcttgtcagacttcaatgtgctgaagaatcagctgttgattttgttaaaatgattcagtgggtcttgggtaggatctgagattccccatttcttttttttttttttttttttgagatggagtctcgctgtcgcccaggctggagtgcaggggcacgatctcggctcaccgcaagctccgcctcccgggttcacgccattctcctgcctcagcctcccgagtagctgggactgcaggcacccgccaccacgcccggctaattttttgtatttttagtagagacggggtttcaccgtgttagccaggacggtcttgatctcctgacctcatgatccacgcgcctcggcctctcaaagtgctgggatttacaggcgtgagccactgcgcccgggcgagattccccatttttagcaagctccactgtgatgccaatgctgctgaat

SEQ ID NO: 27962 - DNA, 1083 bp, Homo sapiens
aatgaaaggaaggaaaaatcctggctcctccgtggggcgcggtggctcacacctgcaatcccagcactttgggaggccaaggcgggccaatcacttgaggtcaggagttcaagaccagcctggccaacatggtgaaaccctatctccactaaaaatacaaaaattagcctggcgtggtggtaggcacctgtaattccagctactagggaggccgaggcacgagaatcgcttgaacccaagaggcggaggttgcagtgagccgagatcgtgccactgcactctagcctgggagacagaaccagactctgtctcaaaaaaattaaaaaaaataaaaatcttggctcccaaattaactactaaatcaccaccctggagacatcctaacgccaaactccttgagagacggttaatcaatgaccttattgttcaagccctgctgagttgggtttgtgttatttgcagctaaaatatcctaacattccagcttccccaagatattgaaacattcagaatgttctcttctcctctgtagagctgaactgaccataccctctctttgaagtcaccgagtgtggagtagggtgaaagggaatttaattaaactcaataggttaaataaaattataaaaatacaggctacccatcctgagcaacatgatgaaaccctgtctctacaaaaaatacaaataaaaagctactcctcatggagggggtactgaggtgggaggatctcttgagcccgagaggtcgatgttgcagtgagctgagatcgcaccaccacaccccagccttggcaacagaatgagactctgtcttaaaaaaaatacaggctaccagtggtcacctacaccccaaatatgtgataccctcacatggatgcacagagaaagctgttggtctccttatgacaaatgatatttcctgcattctaatgtaatattgtattttttaaatcattactttaaagattaattatttagaaaataggttagaaaccaccccaaatgccttggagctatttttgcagagacaggaaattactctatagattacagaaagttaacactaaaagaaaacttccag

SEQ ID NO: 27963 - DNA, 1074 bp, Homo sapiens
gacaattaggccaggcgcagtggctcacgcctgtaatcccagcatctgggaggccaagatgggtggatcacctgaggtcaggggttcgagaccagcttggccaatatgacgaaaccctgtctctactaaaaatacaaaaattagccagcatggtggcacatgcctgtagtctcagctactaaggaggctgaggcaggagaatcacttgaacccaagaggtggaggttgcactgagccgagatcgcatcactgcgttccagcctggccaacaagagcgaaactccgcctcaaaaaaaaaaaaaaaaaaaaaaagagagagagacaaggaggcttttaaaagctgcaggtgctgctaacagactttaaattcataagcaaacaataaaggagacagtgttggccattaataagtacactgaagaaaccataatcgtgactcaggggaagggaaccactttcacctaggaagttagggaaggcttcctggaggagggagtatttgaactgagactgaatgacaaagaaccagccacgtgaacatcttgagaagagcatttccaacagtgaggccaaccaggacagatggcctgagaaggaaacaaggcagggttggagctccataaaatagaccaaggtggtcagagtcagacagcagaaagtcttctttgtacaaagagagagggagggaagtcatcagagggttgttcttgtttcgatttgtggttgaggatttgcatttttaaataaaacaaaagtatatgaggcagatattaagttacttttacaattttctagccaggcactttggctcatgcctgtaatcccagcactttggggggctgaggcagacagaacacttgagcccagggttcgagaccagcctggccaacatggtgaaaccccatctctactaaaaatacaaaaattagccaggcatgagggcacacacctgtagtcacagctactcgggaggctgaggcacgagaatcacttgaacccagaaggtggaggctacagtgagccgagattgtgccactgcactccaggctgggcaacagagtgagactctgtctc

SEQ ID NO: 27964 - DNA, 1069 bp, Homo sapiens
gaaaggggtagagactcttctgtcattcctatttgcagacgaagaaattaaggcagacagagtaagggaccttgcccaggatcacacagctagtgaaaggcagagtcaggatttgaacccaggctcatctgaatccagaggccaggatcttacctactgtgctgtttggccttggaaagctgccttgggtaatttgttaggcaaaaacaggtgagtgttacacaaattaataaacatgattctgttattggaaaagaacaaacattagtgtgtacattgcagaaaaatcaaacaggatgaatatgcattatgcttttgccagtggtccctctcagtagcatcagtttagggaggcgtggtcagacacgtcacacacaaacacatccccttcgtctcccatggtagcatctcagtgcaagttgcacattttccacaaagcacttagtacatcatataattttatattgccttgtgagactctttaatacctttcactcttactatactgttggctccttgagaacagcttctgtgcctgttgtttgcttgtttcctcggttgaatcctctggttagcccagagcccagcataggaagaattctcaatggatatttaccagatagataggcaaatggatgcttggggtgagaccatgggagacctctccttcctacatgatagactactagaatgtttgaatttatttacatcaaatgcattctttttaaaatcagaaaaaaaaataccgtttttaaacacaaattggggttcatccatacaataaaatatagtacagcctataaaagtaaagttgtaggtatagatttaatgcatggaatccctattgttgcatttgtttttttttgtttgtttgtttttttgagacagaatttcgctcttgttgcacatgctggagtgcaatggtatgttcttggctcactgcaacctctgcctcccaggttcaagcaattctcctgcctcagcctcctaagtagctgggattacaggcatgtgccaccatgcccagctaattttgtatctttagtagagacagggtttctccatgttg

SEQ ID NO: 27965 - DNA, 1039 bp, Homo sapiens
agtcctacaaatgataaatggtagatctgggatttgaactaagttctctgtcaactccacaaccagcattcattaccattacattcaactgccaatcagaactgaatatgggagatcttgtagtttgggttaagcagagaaaagagcagggccttcgtggtctctggttttcttggtctatttcaacccctgggatattcactaatcacctagttgaggtttcagcacccatagagctcacattccagtgttcttgaattagatgctcttatttgattatcctcctaagagatagcggctattgtcatgtgaaggccattgtcctttggaatctgaaggtaatcaagtttggaggcatgacctgactgatgggtatttcagccacaagtttaagaacaaaaagacagatgcataagaattatgcgatgttcatagtttccacatggaatcccattatgaaaaaggccattttccatttttaagaaacatacatctatggagagtctcctagggttggttgtgtgctatcgtgattaattcccatattattcatgaggccatagggctcagggaggtaagggaaggtgtccagagtcatacagctaaggagtctggagccagccaatcgactcccaaatccagtggtcccatgttcattacagtggcattggatgccatggaattccagtccagagaaggaagagttggttttgtggagtttgttgtgctggtacttctcctccatacaggacagatctagattttgtggaacctgaaactttacaattggagggggtagggacctctaaaacaaaccctataaaaacaccttgtgtttgcaaattttacagacacatgtcaccatgtgacgacattgctaaggcccctgctggggctatgaaagaggccctgaaacttaagcctcacaagcctaacaaagccattgtggcctctatttataccgtgttttctaatttgtgttttggggataataataacagacatggtggactagaaaaaaaaaagggatatggaagca

SEQ ID NO: 27966 - DNA, 1049 bp, Homo sapiens
gtgtggaggtgcacgcctgtaatcccagctactcgggaggctgaggcaggagaatagcttgaacccgggaggtggaggttgcagtgagccaagatcacgccattgcactccaagcctgggcgacagggcgagactctgtctcaaaaaaaaaaaaaaagaaaagcctgtgagcttagtactattgcttggccacattttaattcctacaaatgcaagctattaggttaaaaaaaaaaaaagtaatccaaagaaagcagaaggaagaaggtaatagaggtaatttttaaaattatatagcaaacagtttcacagaaaaaactagctaatccaaagctggttctttggaaagactaataatctactagtctactaagtgctaataaaaaagaacaaatgcataaaaatattagggataaaaagagagcataactgcagatgcagaagagagtaataactgaaatttaatactgtaaaaaattcatgccaaaaaaagttgaacactgcaaaattaacaacttcctagagaaacattatttaccaaaactgaaccaagagactccagaatcctaaatagacctgtgttgagaaaattaaattagtagctaacatatatgcatacatgtgtacatgcatacatacatgcgtaaacatgcccacacacaccagacgtaagcaggtttacacttctaccaaacattcaagaaacgtgaaaataagccgggtgcggtggctcatgcctgtaatcccagcactttgggaggctgaggcgggtggatcacgaggtcaggagatcgagaccatcctggctgacacggcgagaccccgtgtctactaaaaatacaaaacatttgccgggcgtggtggcaggtgcctgtagtcccagctactcaggaggctgaggcaggagaatggcatgaacacaggaggcggagcttgcattgaggcgagattgcaccactgaactccagcctaggcgacagaacaagactctgcctcaaaaaaaaaaaaaaaaaaaaagaaaagaaaagaaaagaaagaaaaagaaacag

SEQ ID NO: 27967 - DNA, 1046 bp, Homo sapiens
tatcatattctctctctctctttttttttttttgagacagagtctctctctgtcacccaggctggagtggagtggtacaatctcagctcactgcaacctccacctcccgggttcaagcaattctgctgcctcaacctcccgagtagctggaattacaggcgtgcaccaccacaccgggcttgtttttgtatttttagtagagacaaggtttcaccatgttggccaggctggtctcaaactcctgacctcaagtgatccgcctgcctcagcgtcccaaagtgctgggattacaggtgtgagccaccatgcctggcctacaacaaagtcttatgcaaaaagagctacaaagccttcacaggtatggtgtcttttaccagaatgaaacagtccctctccttaaggcataacaaacaacatcttccgaagccacgccaagaagtgtgttcagatcatgtcttcattcttctgaatttcaagtgaaagagctgccttcttggaactttgtagaaatctaagatgtgtactagagctgctcaaagacctgccatttacttactgtacttgtgttatcaaagactccataaaatcaagtgatttcctctgcttttgtccaggccgccaaagaacgtggcgcttagtcacttcagattcccttctgtctgtgatcccctctgagaaataaagccataaatatgctgagttctgttgacattcacaccggaaatagcacagagctccaagtattgtggtctcctttccgattttattgctaaacagcaagaaaaacagcagaggggctttcctggcgagtcagagaaatgcaacgtggttttttgtgtgtttttttttctccgcaagacagaggaaactatctcttcacaccattgccaaagccaagagacttcgaatgaacagatagagcccagagcagaacaaacaccatttgataaaatgcttagagcacgtctccccacacgggcagggactatgagcgtctgaaaagcagaggtccggcctcccctcctccccaactcaaggttgaaaat

SEQ ID NO: 27968 - DNA, 1016 bp, Homo sapiens
gttagaattcctgtagattcctgggcctcagcccagaactactgagtcatactttctgggaatcttcattttaaatatctacctctcccctctccaaggtgactcatagatgtcctgaagcttataaaatgccattctaactcacttgcactctcagcactgttctgaaaataaggcctctactttttattttcaaacagaaccttcccttatccctcccttggcttttctccttccttactcttctttctctgaccccctttgaaggttccacttccttctcctcccccaaatacatatgcctctaaatgtataggctctgctaggtgctctcttcagatatcaactgtgtacctcactgcagatgtctcatctagcccacagtctgcctttaggcttgggcaagaggggcccctgccctggacttctcattttagtggctttgaatataaactacacaaattctcattgctaattccaatcactctccagtgaagaataggcagcatttattgagtacttactgaggaatgggtactagactttgactttgattcactcatttactgcccgcagcagccctttgaggtaggtaatcatcaccaccttatataaatgatgaagcaggaaggagctcagagggaaaagcaactttttccagctggtgagtacaaaaactgggttgtttttgttttgttttagacagagtctcactttgtagcccagactggagtgcaatggcatgatctcggctcactgccacctccgcctcctgggttcaagcaattcttgtgcttcagcctcccaagaagctgggattacaggtgcgcaccaccccacccaggtaatttttgtatttttagtagagatggggtttcaccatgttggccagactagtctcgaactcctgacctcaagtgatccacccaccttggcctcccaaagtgctgggatcataggtgtgagccaccatgcccaggcaaaaactgggttttgaacttgggaaagtctgacct

SEQ ID NO: 27969 - DNA, 1031 bp, Homo sapiens
gccttggcctcccaaagtgctggaattacagacatgagccaccatgcccagcctgcaaaacttttttgtaaaaagtttggtatctattttaggctctgtgggccactctgctgttgtagcaaaaaagcagccatagacaatatgcaaacaaatgggtatggttgtgtgccaataaaactttattcataaaaacaagcagagggccagaattctcaagccatagattaccgtaatttaccaacccagccctagtgggtagttttcataagcttgccagaagccccttcaaacctttaggaagctctcactgagcagcaaccacagttaatcctcatgacgttccccaggaagttgtctgacacccctcgttagcctgcagctgcctccagctagcctctcttctgactgccaggtttcccaggcatacctcccccaacaatctctaacccagaactcagggaaggagagccttatcatgctgccctctcctctctttgttcactgcacactcgtcactatcttcttctctcccagttcttcaacctgctcaagacttttctgcctcaggacctttgcacacactgctccatttgcttggaatcttctttccacgcttgttccaaaactagctctttgtcttgttttttcttcttcttctttaattttttatttttaaaatagagacaaggttttgccatgttgcccaggctagcctcaagctcctgggctcaagcaatccacccacctccacttcccaaagtgccgagattatagggatgagccacagcctttttcatctcttagagcccaaattaaacaatacttttatagggaggccttccctgactcctttatttaaaatagcctgcctcggtgtggtggctcacagttgtaattccagcactttgctgaggtgggaggatcgcctgagcctgggaggcagaggttgcagtgagctgagattgtgccactgcactccagcctggccaacagagcaaatccctgtctttaaaaaaaacaaaaacaaaaca

SEQ ID NO: 27970 - DNA, 1054 bp, Homo sapiens
tgccactgcactccagcctgggtgagagagcgagactctgtctccaaaaaaaaaaaaaaaaatgacttgcgattgcttccgtcttaaccagaacaagtagaaccagcatttgaatacttattccccccacattaaaaaaaaaaaaaaaaaaaaaaaacctttggcccgggtacagtggctcatgcctataatcccagcactttgggaagccaaggtgagaggatcccttgagctcaggagttcgagaccagcctgggtagcatagtgggacctcatctttataaaaaaataaaaacccttgtatttgagaaggattctccaaacagggctcttcgtaatacctctctattagtcttttcccccataaactgctcttcagatggctcaatcttcatgtgttagtttgagggacttaggcctacagaaaacaaatgtacatttgtcaattccaaaattctaaaggcattgcactcacatgctctttctcatgctgtgcagtatgtatttcttgaaagatcgccaaagactgatttcaccctaatgctaagggcaggatttttatcccatagctgagaggggcaacacatgaataacagttaattctagtacccagcccagtgtcatctgcacttgttagctttaagcatccttttgataaactatctctttaagagaaattgattctctgtgtatagttcttttaaaaggcatagacgtggccaggagcggtggctcatgcctgtaatcccagtgctttggaaggccaagatgtgaggattgcttgaggccaggagtttgagaccagcctgggcaacatagggagaccccgtccctacaaaaaacattaaaaattagccaggtacaatggcatgcatctgtagtcccagccacacgggaggctgaggcaggaggatcgcttgagcccagcagatgctgctatgatctatggtcacgccactgtactatagcctgggtgacagaatgaatgaatacatagacaaccctggattttgagaaaaaacaaatattgactgtacttcagttatccatttgt

SEQ ID NO: 27971 - DNA, 1094 bp, Homo sapiens
atgacaaagattgtgccctttgatcaacatctccccgtttcccccaactcctggcaaccatccttctactctgagaagccaccttttttttagttataagcgaatgcagctgaagatgggaaatccctgcctcgttcagctagggggatgtcatctgagtctattttactcttctgtaaaatgggtcatgtcaggcatttggcctaatgatgcaatctactgacttaagagaagttggcttccctctgtctcccccaccccctgagccctgcttgctttttttcttttgtagggggaggaggaataaccaagatctaggtactgtggccttatgatcagcagggatcatgatttctatcttcccatgccccctgccacacacatcttcaacacatagtctcagatgacaccttaagcgccaactaggacagaaggtcatgtccttaacaccgctgggaagtcgcacataagctgctgcttgcctccccacctagtcacacaccatagctctacaaaggacacggggaagcaggttcctctggagtgggctgtgccggtgaaaacctggaaggggagatgctgaactcatgagcatcctctgctgtctgcacagtaaggcagcctcataggggtgggaggcattaatagctttttccatggggcacgtgatacgggtcctaaagaccctgagatgttacatttgcaagtatttgtcttatctgggctttatggggacagttttgcctgctgcttgtggatgttgggccatgacagtcttccaaggcatcctaaggctctactccagtagctctccaccgtgcctgcctgctgcggtcccctgggggcctctttggtgtttgaaatatctcaggggaggtacaagggcatctctactttctaaagttctgcaggtgattgtagtgtggaaccagggtgggaagagccatgtgagttggagacagaccgtcttcataggctgtgctgtcacaaagggccccatagtcaggaggccccctgtttggttgcatgttctgtcatcgactttaaattcttaatttttttaatagcaattttgaaaatattttgcatcgggc

SEQ ID NO: 27972 - DNA, 1022 bp, Homo sapiens
ctaaacctgctagaatgagacttaaaatgtacaggtaataaccaaataaaacagccttaatagaaaggagcagctgacatggcacagaccagaatggcaattcttacaccagccttgatttgcagagccctctggatctggaagaggaaactgagaatgtttgcagtttgacttcacctgagccccagggatccgcaaactttttcagttaagggccagatagtaaatgttttgagctttgctggtcctacttgttatcagctctgttgccactgctgttgtagcacagaggttccaactcggccactgtaatgcagctacagagaatagggaaggaaataagtttagctgtgggccaataaaactttatttataaaaaggacatgatttggaaggccagtctgttaacccctaagtacaagcaacagggtgattggccttggataaaaggcaagggggaaatgttaacatgaaattgagccagcatcagtaatgagtgtctatggtcccagctacttgggagactgagctaggaagaactatttgagcccaagagttcaagtcgagcctgggtagcaatgcgactccatctttagaaaaatttcgtggggccactttaaggaaggtgttgctccatgccacagacagatgagtttccggttaggtattggggaaaactggatccttttgatctttactcagatcagcttgtaaaatctccactgaagaacagaaatcaaggcgatctcccgcccctctgcttaaggtttcttgctgccttctagacactacagaacacaaatagcttgtttgtctccctgtatttaacctcttctaagaaagcagatgagcctcaattcgagttgccatcatgactgagccaggcactgcactaagaactttacctgtctgcaggtgtttttctcccaggtgctacccagagctgggatagggtgaggcacttgcctgggacatgagacttaagggagtgccgagaactcagtcgccaaaaaatattttaa

SEQ ID NO: 27973 - DNA, 1061 bp, Homo sapiens
tctactaaaaatacaaaaattggctgggtgtgttggtttgcacctgtaatccgaactgtttgggaggcttaggcatgagaatcgcttgaaccggggatgcgcagattgcagtgagtaagtctagattgcactgttgcactccagcctgggctaaagagtgagactctgtctcaaataaataaataaataataagtaagtaaagtatatgggaggatgtgaataggttacgctacaatactgcaaattaatagtactacaaggccagttgcggtggctcacgcctgtaatcccaggactttgggaaacagcctgaccaacaatggagaaacctcgtctctgctaaaaatacaaaattagctgggtgtggtagcgcatgcctgtaatcccagctactccagaggctgaggcaagagaatcacttgaaccttgggaggtggaggttgcggtgagctgagattgtgccattgcactccagcctgggcgacagagcgagactccatctcaaaaaaaaaaaaaaatagtactacagatactatgaatactgcagatacgacactgttttatattagggacctgagcatccatggattttggtatctgttggctggggtggtgggggcgggtggtcctggagccagtgccctctggatactgagggacaactgtattaatttaaaaccaaccttatttcccccataggtagattgttaacctcatagatgactggggttttccccatagaaatgtgtcctggtggtgtcacttcgtacaggtgtctggcacatacctgtatgtgtaaaaaagtagctcagtgtcccagggacatcttctccttggcaaactcggtcaaactgcagcatcttcctttatcacatagaagctctactggtttgtgctccccaaagaaacagattcagttttgcacatttcagtttgtgttagtttcaaactgaggattctgtgtggtgacaacactctgtcaagaattgcttgatgctgattggttcagtagagatagcaaattaaaaaacaattgctttcagacactccagtagatttt

SEQ ID NO: 27974 - DNA, 1034 bp, Homo sapiens
cacccccaaattcctatgttgaagttctaaccctcagtgtgatggtgctaggaagtggaaactttgggaggtaattaggttataaaggtggagtcctcatgaatgagatagttccattataagacaagaccaaagagagcttgattaccctccctgttctctaccatgtgaaggcacagcaagaagatggccatctgcaaatcagaatgttggtcctcagagacaccccatctgatagcaccttaatcttggactgaggcagaaattaaagaattaaaggaaaataaaatttaaaaagaaaaagaaataagctttactgtattaggctgatttatcccagaggcaggaacaggcacagcccagacccaggaaaagccttgataaacactatctaagaagctaggacacaaaggaatgtgttgtggagactctcccagcactccctcaacataaggataagaaaaagtaaagttccccctagaatcccacctctctccatgtgattgtaccttactctgcaagttttatgagtttatagattcctgttctctgtaactagtaacttcaagtattctgttttatctgagaaatacagtgcaggtcacaagaagcctgagcaagcctagataacagccatctggcttgcttggcaatggtcatatgtaatcctgagttatgcacgtgtcacaatttgattcactgcctttgttatgccactgcatccttgctttcacgccactacacttcatgccatggtaagcttgttttaggctcgcccacccccttttagaagtgtatataaaagtcatgtgctttctttgttctgggcccagtctcaggatgttaatccactgggtctgagtgcactcaataaaatcctcatcctttaccctgaggtctctctggtccccctgattcccacaataggacttcccagccttcagaactgtgataaataaatgtttgttgtctaaggcactgtgtctatggcaatttgttatagcagtccaaactgaatgaagacataattcatg

SEQ ID NO: 27975 - DNA, 1048 bp, Homo sapiens
atggctttggattaagagctgagactttggggtcaaggccatctagagtgtgtccccactttagcctccaataactatgtgactaggcaagtcactcaacatcttggagcctccgttttctcatctgtaaactggggatattaatagtacccaactcatggggtggttgtgagaattaagcgagttaatgcacctaaggtgcttggtacagggcctggtgtgcacactgccttctggaaactaaccatagaatgtgctatgaccatttttggttttcttcatccactcattctgagaagagtgtggaaggctttgggatgggtgcaggggtgcagtgcacaggacctgagctgtccaatctgatgagaccactcagggagagatgctacttataaaaacaccactgtggcccaggcgcagtgcctcatgcctgttatcccagcactttgggagactgaggtgggcagatcgcttgagctcaggagtttgaaaccagcctggacaacatgacgggaccccgtctctaccaaatatacaaaaaattagtctggcgtggtggcaggcgcctataatccccagctattcactacttgggaggctgagatgggagcatcacttaagcctgagaggcagaggcttcagtgagccggggcagcgctactggccacttcgctccactttgctccagccctggggtgacagagcgaggctccatctcaaaaaaaaaaaaacaacaacaaaaaaaaaaaacaaaaaaaacacaaagaatcccaaaaacaaaaaaaacaaaaacaaaacaaacaaacaaacaaacaaaaacaaaaaaacaacccatcactgtgaaaattgaaaattggtagcttattggaggattgaggtgctgatactgaacattctgagaatcttctctgcagtgcttttgagatagaaagggataaattctcagtacttagaaaggacctaggtaactgggagtgtgagttctgaaggtattctttattttgcatgatgtctgcagaggctgctaatgacaatgtctgaagtagtt

SEQ ID NO: 27976 - DNA, 1991 bp, Homo sapiens
tcaggagtgaagactccgtgacagaggatgggacgcagtgcccaaggggaggttggccttgcagggaaagcacatgcctgtccctccctcattagcttcatttggacaaaacatgtaaaatccggtgtgttgtggaggccttttgattggggaactgtaacgctgcctatcgagcaacagcactttaagcaggtggctttgttcaaattaaaggttcttctttttcttttcaggcatcatggaccgatctaaagaaaactgcatttcaggacctgttaaggtaaattgaataatctgtaatctcattcacatttataaacccacatggaggttggtcttgtcgggaattctttccgcctttactttggatttaaatttagatcccttactgtgatcctggatatgaattagtcacttttctcgtgttcagtaacattttgctgcttcttagagtagcttttttgttctgctttgtcttataatcggctgcttaagtttctatatccctccactgtatgcaggataatagtaataatgcatctggcaggagttcaaaacttttaaaattggccataaatataaaataattagaaaaaggctaccttgaattactgtatttgattctaagttcctatgataacggccatttaaaaaattgctctatatttaaaatgtttctttttatttgtctttgtctgaatgcctgctgcgttgtggacagtgtgctaatttcaggagtaactgactttgtatttggaagtcttaacaccctctctttgtagagcactcataccgttgagctggggatggactttgaggctttcatttctagcacttgtccctcacttacaatgagctgttgaagctgaaggaaatctcatccctcctaccccttttagtttgattagctgagggtgttagagttaacttaacaatttaaggttgtaatacagtacttacaggcgtataaataatacatttcaaggctgggcgcggtggctcacgcctgtaatcccagcactttgggagaccaaggagagtggatcacaaggtcaggagttcaagaccggcctggccaagatggtgaaaccctgtttctactaaaaatacaaaaaattagccaggcgtggtggcaggcgcctgtcgtcccagctgcttgggaggctgaggcagagaattgcttgaacctgggaggcagaggttgcagtgagccgagatcatgccactgcactccagtctgggtgacagagcaagactccatctcaaaaataataataataatacattttagtagtaactttgtgaagtgtctacatttgtttcctctttgtcagttttttgctcaattccattttgtcaatacttggaaaatgaaacattggttaatcaatagtacagtaataagcttattgtggaaaatcttcgatatatgaaaacttagactcttctaaaacttcatgaagataataccactgttgaacgttttgacgtatttttttttggtctttttcttaaacgtatattatcaaagaaatttcaatggaactgagattttggcataaagtttttgtatcatagctttttgccaaatagcaatgtagtgtctatttccaaattattgagaaattttagaaagtgtctccttcattaatggatatttgttaataaagcatgatttttaggggtgaggaattggaggggatagaaggtatcattcaggtattcttagccacatactaactatcctctggaggtactgattaaaataccttttcaccttccatctcttatcagtgacattcattattttgctatactagagaacaaactttgtgaaattctcaatatattcatcttttgctttcatgaatgccagaaagtttattttctcttccattctaggctacagctccagttggaggtccaaaacgtgttctcgtgactcagcaatttccttgtcagaatccattacctgtaaatagtggccaggc

SEQ ID NO: 27977 - DNA, 1027 bp, Homo sapiens
tgtccatgtaaagtgcttagaacagggagtgcttggcttggggagtgtcacctgcagtcattcattatgcccagacaggatgtttctttatagaaacgtggaggccagttagaacgactcaccgcttctcaccactgcccatgttttggtgtgtgtttcaggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatg

SEQ ID NO: 27978 - DNA, 1050 bp, Homo sapiens
gagctgatgattgcctcacaccggaggctccttcctgtgccgcgttctgtccagaagacacagccatggatgtccattttaggatcagccaagccccgtggggctttccttcatttttattttatgtttttttagaaatggggtcttgctctgtcacccaggctggggtgcagtggtgtgatcatagctcaccgcagctttgagccgtcttcccactcagtctactaagcttggactataggccaagactatagagtggtccttctttccattcttttgggaccatgagaggccacccatgtttcctgcccctgctgggccccctgctgctcagaaggcatggtctgaggcttccaccttgggtcgtgagcctggcgtggtggtttctggccagcatgggggttgggatgctgtggctcaggccttctgcatggtttcccacactctcttctcctcctcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgcggggccaccagatcctgctgcctccaagctggggcctgagtagatgtcagcccattgccatgtcatgacttttgggggccccttgcgccgttaaaaaaaaatcaaaaattgtactttatgactggtttggtataaagaggagtataatcttcgaccctggagttcatttatttctcctaatttttaaagtaactaaaagttgtatgggctcctttgaggatgcttgtagtattgtgggtgctggttacggtgcctaagagcactgggccctgcttcattttccagtagaggaaacaggtaaacagatgagaaatttcagtgaggggcacagtgatcagaagctggccagcaggataatgggatggagagatgagtggggacccatggggccatttcaagttaaatttcagtggggtcaccaggaagat

SEQ ID NO: 27979 - DNA, 1022 bp, Homo sapiens
gacccctggcgggtgtcctggggcccccggatggacctcagtgggtctgtgtggcccagagtgtgtagggattccgtatattttcttttctgacagtggatccatttttccaggtttctcaaaggggtctttgatctcccaagtcaaaaaccaaccaaattccttcatttgtattcgaagcctcttttatgctggactcttgaaggctaggattcaatgtcgaacacccacacaaaggctgcccttgggggtgttaatttaggacaggaaggagggggttgccattcacatccatacatagtaacagacccagagtcagggtggtgcctagggaacgcagcccatcccgagggctgcagacaacatttcgtggcgagcgagctgagagctctgggtccagtgggtgcccacgaggccaggctggtccggagaggatgctctgggctgtgggacctgcaggggcagaggcctgtgctgtggggtttcctggcgcctttggggagtggggaggaggctgtgggggctgaagcaggggaggggagtgagggtgggcgggtcaggcattctcttgggagtcacgtcttgagtttgaacttcatgccaagcatgttcagaagtctttgcagagattcaagctgtggtgtggggtgcaggtgataagatcattctggctgctctaagaaaggtgaggaacagggtgggtgccgagggggtgctcagaggccggagactccttagaggatgtggcagatcatccaggcaggaagtgtaggcaaactgcatcccggcagagacttccgtgtcttggagctccatcgggtgcacctgggtaatgagggggagaggaactaggcatcgcgggcttagaattcactctgattttccccaccgcctcctcatcaaagccccaccaagtctccatttacacagcccccaggacggggctctcactgtttcccgtggcagaaattcattgctgggaacctgcctccttcccgcggatggctcgtggccctgtttgc

SEQ ID NO: 27980 - DNA, 1047 bp, Homo sapiens
tgggcaaatcataaagtctgagattctagtgctcctgtcagccaagtagtgcacgctgcacccagtatgtagctttttattccttagccaccttctaaaagaagacttgggtaacttgaggcctggcccagtgacaacactctggcaaagtcgtgcacggtgcctagggcagcctgtttacaagatggtgcctgggctgacaggtacccctcgggttctgggtctcaaccctcccctgccagatcctgcacggggaagggcagcagggcctgtgggaggcggtgtgcatccgacaaatcagtgcacacctgctttgtgcctggccccgagctggctgcagagaccctggtccctaccctggggacctcttactgatattaactcagaggatatcctgcctgcaccagcacccagagaagacaggtgcccaggcagcagcgcccatgtcatcatccagaaggggtagagacagggtcacctgaaccttgcaaccactaggcagttacactgtgcgtgggtggagaggagcccccagcagctgctggaatttggagcccggacacctcctggggccttgcttttctcatgcacacaatgggcatgtggaggatagtaatttgggccagcgtgtttccattctagcggggcgcagccatcgcagaccttctttcagaaggctggtgtttaaccccacatgagcccctgcctgccagtggtctccaaaactccaaagcccagatggcgtcctccttccctcccatctggccacgggtggtggggggtctcgaggtcaaagtgcggaggtgcccttctgagaccacccaggaagcgtgcgtcttttccctcttcctcccagctgggccctcctgtgagtcaccatgcggagcagccgcagctggggctctgctccaggccagcgtgccctcgcggggagaagcctataaactcccaggcacctgcagctcatcaggaggaggccgagcggggagcctggtctcatctccctggggatgggctggtgctacaggaatgagggctggagtctgt

SEQ ID NO: 27981 - DNA, 1038 bp, Homo sapiens
acctgcatatctctgagcctcagtctcccacctgtgagaggggacaacagtgctcgcctctcaggtaccatacggttcagagggctcgctccgcaccttgttctaagatggttccatcttgagttggggtcagctcactgcagctgtgatcttactttagagccaaggcagcttgaatcccatggtggaagattcacactgacattgaggtttgctccaaccagctgcgaaccttgagtctctggctttgcgctggcatcttgagcatatctttccatttaactcattctcagaacaatcctcatggctacctccattttacaaacaaaagaacctgatggacagagactgacttgctcagggttacttcactgaaatttaactccaattttcctcaactcagagcctggagccctacagcctacatccctgagcacccactgtgggacccgaggaccactctggggatttcatcacaaagaggattccgggcctctcaccccctgattgtctctgctggtggctgtgtctctaatgagggagagccttccatttgtcgctgtatttctcttccctcttgacccccagcctctgtgatccacaccttgacacaagtttgaacggctcgttactgcgctccattgccggagcagacatttctttgcagcaggacttttcagagcctttaaagagctaaggtgcattatgacatctctaaggagcaatgtgtcatgtggtgcttcccaacctcatttcaccacagagcattttggatttttgatcctctcattttcctctcttagctatcctattaataagttgcagtttttgagaccttgataaactccaaaccctttgtcttgtggatggagaaactgagggctagaacataagggccactgactcgccttctgactgtgacaacgctggcctccgggtgctggacgggcatcttcctgactttcccatgagtggctgggttggtgctgtctgcagtcagctggccctgcccagagggagacagacagccgtggggtg

SEQ ID NO: 27982 - DNA, 1049 bp, Homo sapiens
ggtttttgtaaaaggaagacactggacttgtctttgggacagtgatgggtctgcttgctgtcaggatggtgttttctggaatccattttctttggacttatcttttggtcttggggatttaggcccttttaattttttgaagatgaaagtcctttgttaatgcctgtaagctctctcagcccttggggtgctgggatgtaactggaggtagagggaggaaaagctggaatcctaggctctgggcttccttaggaagcttttctctgtgggcatggggagatgtcaactctagacatttagtttaaaactcaagtcttgggtaatcaactatatacagtaactttagaagaaagtataaagacatattttcacctgaaaaatacatgcaagcttctacctcttgtagtggtaacaattcaattatcttgatacttgagttgaaatggtgtagatttcacactgtggagtggcttccatagaaaagggaaaccttggaaagatgagatttggaagttggtttggactttgaattatccactgcttatttgtgtgtgtgtgtgtgtgtgtgtgtgtgtgtgtgtgtgtgtgtgtgtacttcatgactgttctttctttgataatggatacaaaattattttcagaacatgtgacaatgtgggtttcagggagaatagagtaacattgtcgttcctgcttctcatagtctccaactaattaatgaaggaaatcctctcagaaagccataccaaagagcccacaaatgtttgcaagaaatttagttcctcactttatccctgagtttctttttagaaaagaaccttgtaactctgataccttaacagttaagatacagttcatcttctatattaaaaacagttgtacctgcagctgttgtaacaaaccttgtgtttgtgattatgtgtcagtgttttctttcttcattgggcatgactctaatgattgtacctgtgtttatgtcatgcttattcaaacgtatctttattgttcggtctattgcactttttttttcaaatgtaatcataagtgca

SEQ ID NO: 27983 - DNA, 1024 bp, Homo sapiens
aggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaat

SEQ ID NO: 27984 - DNA, 1060 bp, Homo sapiens
agctagcgttccgagagctagtacctatgtccctgttgagttcacccttaagcagtcctgtgaggcaggtactgttgttgattcgtgccttactgtgaagaagctgaggcaaggggccaggtcaccacagacaccacacatacagcaggtggctgcatctggattcgaatccagagccaggctccctgccttccacagctttgctgtgtccccatctcgacgctcagagaaaagacacctccggaagcttcccctgctgccttcgcagaacagttggtcagaacctcgtcttcccagaatttgggattttctgcttctggaagatgctgcttcgaaaggaagtgatagcaagggctggaatagcctcgcctgtggggcggggacagggagaggcggctgatgtctgggaggcttagaacttccttcttggaatctgtttttcacgttgcctgaaaaagaaagaggaagagactcatacagatggagacacagggaaagactcaacggatttagaccccagacagtcacacaccggagacagacagacagacagatgccccagaggaaaggacacacccccaaacaatcaaaggtgggaggcagacacacagacacccttggacacgtttgctgccctggagccccctctctagcgaggtcgcccttcccatctgagctccttccctcctcaagctgccgctgggcccggcaatccattcaggggccgactgtcagtgtggccagcagcatttcctagaccctcctcccccaaaccggaaaacactcgtagcaaggaatgccccgcctgtgggccaggggtcttcctgggcctctgagccccacatgaaggtgatgagccaagcgccaggctagggtcagcaagttggcatggttggggggcacgtgggtcatgatggcagtgaccttccagctcagtcgggctcctgacggactcaggccttgccttttgctgcttccaagaggtcggaggaggtgaaggcatggctgccggtggaggggtcggggctgctggaggctgcttttcggggtgggtactttg

SEQ ID NO: 27985 - DNA, 1035 bp, Homo sapiens
cagtcctgacttcctcctgttgtgagggcagcatggacccccctccccttatttcctgaatgcctaccatgtgccaggcacagcaccacatgcagccctgcaagagctactagacttgtcttacatggcgctacatgcaaccctccaagagctactagacctgttttacagataaatagactgaggctcagagggcagaagtcaattgcccaagggtgcatgactcgtaattggccccactggatgtccagcccactgcacccatctgtgtcctagccaccctcccatgtcagttccaagaaatctataaacccgaagcaaacggtagcacatgagaaaactggagatggcacgtggatggtcatttaaaatttaatagttccgtactcatgtgaatgtatgttaggaaaaatataacaagcacattgtcgatttcgtgagtattattgcttaagatcgggttaagtaataagtaaaccaattgaatattttatttcagttgaaaagaaaaatactgaagaattttaatgcctttaatggggtacttgagtatggcaaaaatcgggaaggctgagagtgtcatttgggagctgtgtcccaagtccctcgtgggcctttaatcagcagttacagatctgcagctcctcctgtaggatggaagcactttgctctttggccttttgaggtcacccagctatttgaaggtcaggggcaactcgattctaatgagatcaaggtcacagggtcatgttgcccccaggaaagtgggagatggagttctgtggtccaggctgtggccctgctgcagggctgggaggtggagaggtgtggacagagaaggacctcccatcctcaccggcagagaaagctcagagatgctcccagctggtgatgaggctccagcctgaatctcagcctgctgctgatgatggagaagccagcacttcactgagtacttccttggtgccccgtcaccacccaacacctcctcacaaggcttgcagaagagcctgctgagactcagagtgtctgtat

SEQ ID NO: 27986 - DNA, 1048 bp, Homo sapiens
ttgccatgatggtgcttgtcattcatagatgtggtatttggtctgactggaaagctattttctagctgcttcagttatctaaccaccccaaaactcaatggcttaaaccaacagcatttgatttcccacaaatctgtgagtagactgggtggtgcttctgcttaatgtggtttcagttggggaagtccgaaatgatgtcacttatgtgggtggcataggtcctggctgttggccaggacttcagttctccgcgaggtgccctttccacttggctaggtcagccttctcacagtatagtggccacagggtagttgcacctcttttctgacggctcccctccttcagtcctttttcacctatgtatgtacaaaaaaggaagtaaggaattatataggaaaaaattatgatcttactttggacaaatatttgaacaaatgttaggtgtttgagacttgtgattataaagacttaagtactcttcagcagacagctgaagacttgccccaatgaggaaggaaaccaccgttatggctctgaacttaaccacaccttgggtaggacaaccttggcagcctcttgggggcttcctgtttgggcaagggtaggagctgtggagtgctgtaccttaggagtttataacataattgatctgtacgggagggcatgctcattcgtgtcgccctgcttctacccctacacctccccatggtagtattgggaggtattatcataccattattggcagaaagaaccctgaagttttatcctctacatcctggctctctcacacctgtagctgtgttacgttgggtggaccactcatccattctgttcaattctttggaaaatggcatgagaatgggagctgcttcataggactggtgtgagggttagatggatagccagaaaacattctagtctagtgctttgtaaagtattcagtgattttatcatcatcatcatctttgctggatttttatgtaagagcttatgattcaatgttaacagctgctactctgtgaggtaggtgggattattcctcttaaca

SEQ ID NO: 27987 - DNA, 1048 bp, Homo sapiens
taacatggatgtggggaattggctgtgtcaggatgacacccaggtagaactagatggaagctagtacttttcactgaggtagagaagcagggaaagaggcccaggtgtgaggtagcaggaggccatgagttctgccatgttgagtggggtggtggggccaagagctctgccatgttgagtggggcggtggggccaggagctctgccatgttgagtggggcagtggggccaggagctctgccatgttgagtggggcggtggggccaggagctctgccatgttgagtggggcggtggggccaggagctctgccatgttgagtggggcggtggggccaggagctctgccatgttgagtggggcggtggggccaggagctctgccatgttgagtggggtggtggggctaagagttctgcctttggtctgttgagaacaaggtgcctttaggctgcacgtgacaaggtatcaagacaaggtatcagacaggtagaaagatgttctaggtctcgggcacagtggaaaggctgtcatagaagcagaaaaagtctagtgctaagtgggagacaagagaggaacactccaaattgagtttccaaccaaagtcattatcaacaggagtcatcctggagctggatggcactggagagatcgagtctcagcccttttattttacaagtaaggaaactgaggcttagagaggtgggaccagctggttagtggtaaagccactcttagactgaatttttctagtcctagttctatccctcaattgtttactacaccaagcagagaatcttcccgtgaaggtggaacatgagccaagggctcagatgtcagcccccttgatatcagatctattttttgtcagcaaccaaatggacagttcacagcttcacattcttttcttgatcactttagaactgacattcctccagctccttattaaagaaagagcaaagcaagagctggctagaagtggtttggaaggtagaaatagactataccatgtctttagtaatcagcctggcaaagtccacatggcagccggg

SEQ ID NO: 27988 - DNA, 1057 bp, Homo sapiens
aagtccagcagtgcctcctgagtgcctgggcacctggtggagatggtgcagggtccctggcaaaagagcctctgggacaggagttgtagccgccagcctgtgtcacacactcacactcacaattagaggacaacgggaatttaattaacttccaaagtgtgatttttgaccataagcattctaggaatgaggtgctgtgtggggattgagatgaaccttggaaaatacttaaggagaggcttgttttatgctgtcaggaaatcttcatcttgtcacttcgtaaatttttgaccttgctcagttagttagaaaaacaaaaacaaaagcttcctgtccacaactgagataagagagttttgcaagacatctctctgtcctcggagtgttgtggccttctgtgggttctgtagttttaattgctagtggtttcattcctgctcagttagtgaaattgcgacattttcccagtatcttagcgtgactgccctacagccttaataatgatgattttagactgtagtttaagatctgctggggcaaatgccttctcactgcacagtatctcagcattctctgatgttttgtccatttatttttctatatgaatttaagaaccatttttatcaagttttataaatgaccttggtgatattttgactggaatggcgttcaatttataaattaagttgggaaatattatcatcttttctgcatttagtcttaagccagaagtatggcctctcaatctgttcaggtcactatttctctcattaaggatttgtgttttcttcatgtaattttaatatatcctatgtgagtttgatatgtgaatatatatcatatatttcccaagtattagatgcttttgttgcattgtgagtgggcactctttttttaattatattttcaggcctcttattatgtatttatagaaatggtattgatttttgtacgtttttctcatcttctgccactttcagaattggttggtttttgaggcaaccagcagcctactcaggcaaacactcagagaaggtttctggaggatttggtagaa

SEQ ID NO: 27989 - DNA, 1039 bp, Homo sapiens
aggccaacctaatctgaatagagaagctttgacttatatattctcctatgtgtctgtagctagatttatgtttttgtgaaaaaaatggttttaaaaaattctgagtgtgacttttaggctgtgtctttgaagagaattataaccatcagcatttttgtaaatactgtagagtgtggggttcttatgaaaacaattgtggactcaacccttagtcaaagacctactgatggagttaaataagttcactcagagcagtgtctattaacacttcagtttaaataactgagtttttaatttttcacttttccaagttcttcttagtaatttacatttcgtggaaaattatttgctgttactgtagtcttggttagagtgttattttgtaaagatattttaacttaaaaatgagtatttttcagatccgacataaaatgttgagttattttactacgcagtcttggaaaacagctcagcaacatctgagaacaatgaatcatcaaagtcaggactctaggtctgtaataaaaatctgttctgaaaacttttgaatgctacatattcctatattctgaatgctacagtttttaaaattaatctcattttgtttctgtaataggattaaaaaacttgataaattccaattcattatcatagaggagctggagaattttgaaaaagattcacagtctttaaaagatttggaaaaggaatttgtggtttgttactttaaaaattttttaaataagtttaaaaccttatttttaaagagctatacttggaaaaactttcttttttgggagcacatcctaaagctttttgttcagaaaataatttagttttatcttagatttctaatcagcttcatagaaacacttttgaagtacgaacttaaatttatgatgaatatctttgataatgagaaatcctgagagattttactttcaattttattttaatttgaaagagcatatgacatctggaatatttttaacatatagccatactgtttatttaaatttgtaataatagaaatagagta

SEQ ID NO: 27990 - DNA, 1059 bp, Homo sapiens
ttttaatatggtgatttacatgtagaataaatcatggtttaaagtactctgggataactgtaaacatgttacacaagaggaaaacagactttgtaacttacagacaactgtgtgggttactttgcattttatatctctaataataatgaaatggcagtgtctttgaatatttagaagtctcaacatttttttaaattttacttatttcttctgttggcacacttgttatttgggctgtgttaattcctcaaatgatgagatatttctaatccatatgaagaaaatattaatagattaatcaattacattaatatattcttatttctcttgcttattctaataccttgtaaaatatatggtcttttataaacttaattttcataattgtaaatcaaacattaactatttttttaatagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagtaagttgtataacaataacagaaattcgtgaatttttaaaaattattatgatttttaaaagtatttctctttaaaattaggattgcaggatatttctcaaccttgtaaatggcatgcttggagacaaaagaaggtaaacttaatgcaagatacaaccatttactgtcaaataaatagagctcaagagtgagcacccagtgttgcatctttatacatttaactttattcttgttctctacactatgttggagtgtagaatgtgcatagataatttaaaacaataacatgattttagcaaattactacaccagtaatctgaaataattctgcactggccttgttttattttgtactttttagagggaaaagttcatttctgtttaattcatattaattaataactttagatgttcaaaattggcttactatacttctgagttgcatatccattattatttaatgtttgagggataataaaaatctagacatatttattac

SEQ ID NO: 27991 - DNA, 1157 bp, Homo sapiens
cagccagtgctaattaccaaagccattcagtattcagcaataaaggttgaggacagctcttgttcagaaaaatttcagtcttggtgctggatatcaaaaagtcacaataaaaccccactgccattggactgctgtgtggtagggaaagtcagaatactcagcttctgcttctgacaaaaattcaaagaactgaccatgggtaaactgacaagagtgaatgatgttcacctttgacactactgttttaataaaacatgatagattcaaatagttttcacagagcacttgctggtgagtaatacagtcatgcaaaaactggcagtgagttgcatttagttcgtgggccatagtttgccaacctttgatctaatggaacaaattttcaatagtaaattgagaatacagaatatgttcctactcattctttgacttgtggcctgcttgtgccaagcaatcagatccaacttattttagctctgtgttgattgaagaagacttacctaggattggtcaatgaggctggtgaattatttataaataaaggtacttgttgtcttcagagccaaaaagttttaaacagattgccattgatttaaataataattaatcctacctcttcgttgattgtttttgctacataacaatgtagtctaaatttttaagtttttagggaaaaaatcctaaagcaccagcaattgtaaagtgatccacctgatttttaaagtaaataattgtatcttttcatctgagtacttttttctttttatgcagtcactttggaaaactgtacatttgttgttacagtatttccattgtttaaagttatttttaaaatttgcattatgaaacagcatgtacacattcctctgaatatacttagtattgataaagcctcatctttcaaaaatgcgttaacgtaaaaggggctcacatcatttagaacttcattggggttaagatgtgttggtctttatgggtataaaaatttttgatgtataactaaaaattaatgaggtcagttttggtaaaagccttagaattgaagttttcaattttgaactatatttacttaatctaaaaaaaaaaataaatacctccttatgtgcctgcagttagaaactagatctagagttgtcccttgacagtattaaaatcag

SEQ ID NO: 27992 - DNA, 1035 bp, Homo sapiens
gattttctatagactggcttattcaccacacttacgaatgccacaatctatcatttagatttcatgaacacagtgggaaaaaagtgtctattcaatttttatgaaatacattgtttctgaaaaagtttagatactaatctctatttttttctttatagttttgctatgttactgaggaaaaatggaatgtaaatttctctttagaatgttaaaaaaaggtatataaagtaaaaaggcaagccacagacttggagaaatatttgcaatatttatacatgacacaggaataaagaattccactacttagtaataaaaagataacacaataacaaatgtgcgagacacttgaacaggtgctttagaaaagatacacaagtggcgaataagcaactgaaaaggtgcccaccgttactggtcattagagaaatgcaaatggacaccacagcgaggctccactgtgtgcccaccctcagggcttgaatctgaaagactctcatccagtggtggcatgttgtgtgacacaggaagctgaacgcacgtctgcccggtgtgtgacgcagtgatgaagctgaatgcccgtctacccagtgttgaatgcacgtctacccggtgtgtgatgcagtgatgaagctgaatgcacgtctacccagtgttgaatgcacgtctgcccggtgtgtgatgcagtgatgaagctgaatgcacgtctacccagtgttgaatgcacgtctacccggtgtgtgacgcagtgatgaagctgaatgcacgtctacccagtgttgaatgcacgtctgcccggtgtgtgacgcagtgatgaagctgaatgcacgtctacccagtgttgaatgcacgtctgcccggtgtgtgacgcagtgatgaagctgaatgcccgtctacccagtgttgaatgcacgtctgcccggtgtgtgatgcagtgatgaagctgaatgcacgtctacccagtgttgaatgcacgtctgcccggtgtgtgacgcagtgatgaagctgaatgcacgtctacccagtgttgaatgcacg

SEQ ID NO: 27993 - DNA, 1988 bp, Homo sapiens
agggccctggacagcaccccagctccagctgtgggcctaccggaaggagcccgtgccaggcctggcctcctctggaatcggggtacttggctcagatacacaggctcattgcaagccccactctgagccccactaacacactgtcttctcctttttcatcaccaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtatttgttttgcctatttttcctccgttttccagttttagattctactgccagattgcactccggctctgctgaggtgctggtttctgagccacctgttggaatctgtagctgagccccatcagagccgggagaaagaactttctctgtgaggacaggggccgagctactctctgcgtggagtctgggggctggcggctgcgcttaacaccttctgctgtcacaggtggagatgagctgggcacagctaggaggggcggcgggaggcccagtgctgggggagatgta

SEQ ID NO: 27994 - DNA, 1055 bp, Homo sapiens
tggagacagaaaatgttgactgctagatttatacattggaaaagtactagtttaaaatatcagtaaacatttgcattctgattattcatgtagaatggaaatgttaggaatcgagtacaggccactgagttgtctgagctaccttttggcgtctggctgttcatttgcttagcaaagcagcccctcctttctgacagtttgacactgatgacccatcctccattgctcgaatctgctctgaaaactcccctctgtgggaggcttcttgttgacactcacttttggggagtaaagaaaggtgggtttgggtgattgcagggagctggggaccctcccctatgggaggctgcggctgtggagccctgaccgccctgtagccagcctctgcacctgggaggatggagctttcaggagccgttcttctgtttgttgttttgatttctgagagatggggatctgggttgcctgttaggattatttactctggtctctatgtgactttttccatggacttctgaggactggggtctctgcagtgcctggctttgtgaacgtccgtttttgatgcaggtgcaaatcatgccttcctcacccgctcaggactgcgatcgtcagggcacagggcaggcctcccagcagcactcccgtgtccagcgggctggcaggtggccggggtccttggcttcctgggcgtcctggccaccgcagggaggcttgttttcttttgctgggcgtgaggctggtctccccctcgtcagctggtggcgtgagatgcccttaccttgtgtttttggattcttgtagcctcagctcgttctgggtggcgctgcccagacggcttcacttgggacggcgacggctgttcagacggggactcctcagcgcacggtaccaggggcgaccaccacttcctcagctgccacggtaagagccactcctttccgtgccttcaaagacggtcaggcccgtggcgcaggtcagaaaatgcagccttgagacctcaggccggcttctgtcccagaccgctcactgcttgcttcacaaagcagtgaaca

SEQ ID NO: 27995 - DNA, 1049 bp, Homo sapiens
tcaggaggtttccattgttcttgtacttctctgcacttattaaactttctgtgaagaacacttctttctgtggtaaggaagatattaggacaattggaagccccagtgcggttctgttagctggaccctgacccattgtggtggttgtatgtgcacattggctggtgtggggttttggctgtgccatgaaggagtctccaggaaggtggggtggggcagagagaggggctgtgagctggggaggttgcgggggaggcggcggtggccacagtggcccggtcaggaggcagggtcccaggccccagcttcctgaccttaactgttaatgaccttcagggctatgccccatcccgtcaccacctggaattgcccatcttggttggacgaggatgctgagggtctttgggacggatgtcgtgtttcttgttgcaggtttgactgcttcctccctgactcgagggctgggtgcgtggagccggttgtgcctctgtatccgagagccctgctccctgtcatccttggctcctctctgcattcctcacaaagacctgggtggggacacggccagtgtcccacgtggctctctctggggagctctcagacagaaccctccgccctggccttggggtcccatctgtggggcggggtgggggccacacctgccacgtgtaccctgctgcaagtgcagagagaggagtagaggcaggaggggcggctgcctttcgtaggtcaggtgccgcccgtaaccacggttgattactcttaaattagttatgtcttgagacggagttgcacttctttgccttggcgtgaatagatgctgctggattatttgtccgtaaacagagctcacaggacccagaactgtgagaacctctcggaaacatggcgtggatgcagccgttggtgttctgagtgtcctcagatcatcacacagtgtctgactttgctttttggtacagtcaggctgtgatacaataaccagggaggcggacaagaaagtccccagtgacagcgcctcttatgtgctgtttgttggaagcaaacct

SEQ ID NO: 27996 - DNA, 1335 bp, Homo sapiens
gaagggtctattcaattgcccactttttttttttttgagacgcggagtctctcagtgttgcctgggctggagtgcagtggcatgatctcggctcactgtaagctccgcctcctgggttcacgcgattttcgtgcctcagcctcccaagtagctaggactagaggtgtgcaccaccacgccctgctaattttttgtatttttagtagagatggggtttcgccatgttggccaagctggtctcgaactcctgacctcaagtgatctgtcctcctcggcctcccaaagtgctgggattacaggcatgagccaccacgcccaacctgggttattttcttactgagttttgaggattctgcatacattctggatccaagccctttattagatggatgctttctaaagagtctgtccgttctgtgccttgtcttctcattctctagcagtgtctgctgaaaagccgaagtttaacattttgatgaagtccagtttatccttttgttcttttatgcatttcgtttctgatgttgtttctaaaatttctttgcctaaccctgggtcagagaaatgttctcctgttttcttctggaagttttaggttttacatttaggtctggatccattttgagttgatgttggtacacactatggggtgtcggtccaggggtttgcctgtgtctgtccagttgttccagcatgtgagaagcccgtcctcaccactgaattgcctttgtccatccgcgtgtgggcctgcttgtggactctgcacggccgtgttgatctgtttaactttgcaccaacactgtgctgtcctggttactggagctttttttagacggggatctcactgtgtcacccaggttggagtgtagtggggtgatctcggctcactgcagtctctgtgtcccgggctcaagcagtcttcccacctcagcctcctgagtagctgggaccacaggcgtgcccacaccgtctaatttttgtatttttagtagagatgggacttcaccatgtttcccaggctggtcttgaactcctgacctcaggcgatccgcctgccttggcctcccagagtgctgggattacaggtgtgagcccggccctgagattactggagctttctttttctttctttctttctttttttttttttttttttttttgagatggagtcttgctctgttgcccaggctggagtgcagtggcatggtctcggctcactgcaacctccacctcccggcttcaagcgattctcctgcctcagcctggcgagtagctgggattacaggtgtgcgccaccacgcccagctaatttttgtatttttagtagagacaggg

SEQ ID NO: 27997 - DNA, 1073 bp, Homo sapiens
tctcttgcctcagcctcccaagtagctgggattacaggtgtgtgctcccacgcccagctaatttttgtatgtttagtagaggcggggtttcgtcatgttggccaggctggtctcgatctcctgacctcgtgatccgcctgcctcggcctcccagagtgctgggattacaggcgtgagccaccactcccagcctgcattcccattctttaccagactgtcagctcctggaggccaggagtcaggccttccttaccccgccccaccacggcagccccaagtacaggtgattggatggagtgtgcatgtatgagtgtgtgtgtgtgtgtgtgtgcgcgcgcgcgcacgtgggcactgggccctggtgctgcagagctagcagggctcccttcgaagggcttctgtgtcagagtttaccaggagtcccactgtttaccttgttactccacttgcccaccgcccccaagtggagattatcacacagagttgcatgtctagatagcaaaacagtccttgcctccgagttttatcttgcaaaatttcaaacttaaaagaatgagtacaacaaacagctatgtacaccttccctagatccattaattcctaagtttttttttttttttttgagacagagtctcgctctgtcgcccaggctagagtgcagtggcgcgatcttgggtcactgcaacctctgcctcctgggttcacaccattctcctgcctcagcctcctgagtagctgggactacaggcgcccaccaccgtgcccggctaattttttgtatttttagtggagacgggttttcactatgttagccaggatggtctcgatctcctgacctcgtgatccgcctgccttggcctcccaaagtgctgggattacaggtgtgagccactgcgcctggcccatgaattcctaagttttgagcaaagcagttttaacctgtagctgacacaggggttggtatttatgggatgcaagcctgtgcctttgttgagtatcattggaggcttaggcaggtgctttatggcactcctgaatgtgagctcactgtcgggaaggagatctgtgttgga

SEQ ID NO: 27998 - DNA, 1433 bp, Homo sapiens
gttaccagttgatgggtatttgggttgtttctagcttttgattattatgagcaatgcttctatgaatgtttcctataaatctttatatgaacataagtttttctttgtcttgggtagataactaggggtgggattgctgaatatggcaaatgaatattaatttctgaaggaactccaaagtggctgtcctgttttgcattgtgtctcaccagcagcgcataaaggttgacatccttgcggaaagctggtatggtcagtcttgaattttagccttttcgatgggtgccgtgccattatgttgtggctttgatttgcatttccctagtgactaatgctgagcgtctttccaccagcttatttgctcatttgcctatcttctttcgggaggtgtcttttcaaatcttttgtctgtgtgttttaaattgggttgttagttttgtcattattgatttagtaagagtttaaaatgtattttctagatgtaagtaatttatcagatagaattgttctgtaactattttcttggtctgtgtttgccttttcttttagctgcatgcgttttaaagtgcaagttttcaattttaaggaagcccaatgtatcattttaagaattcattttgtgccttcttaaataaatccagtgtatcattttaagaattcgtcctgtgccttcttaaataaatccagtgagtcattttaagaattcatcttgtgccttcttaaataaatttttgcctaacccaaggtacaggagttttctagaatgcttatggctttagctcttactcaacccaattcaagttaattttgggagagttgtaaggtagggggttgagactcattttttctgtggttaccaatcatgccagccttatgtgttgaggagaccttcctttctctattgaacgatgctgctgcctttattgaaactcagtcggccacgtgtgaggacgtcacttctgggatgtgttctgtccactcatgtccttgtcttcccttctgcagctcagcactttccagcccatttagagggagtgttgatgggtggcaggagtcctccagtgctgctttttcgaaaacgttgagggctgttctggtcgtttgcattcatgtgtttcagaatcagttcgtcaacttctacaaaaaaagcctcttgataccttgatagctttttgtttgttttgagacggaatttttcactctttcacatcttttcctggagtgcagtggcacgatcttggctcactgcaagctccgactcccgggttcaagtgagtctcctgcctcagcctcccgagtagctgggattacaggcacgtgccaccacacccggctaatttttgtatttttagtagagatagggttttgccgtgttggccaggctggtcttgaattcctgacctcaggtgatccgcctgcctcagcctctcaaa

SEQ ID NO: 27999 - DNA, 1084 bp, Homo sapiens
atacacatactcgcatgcatacacacatatattctttttctcctattataactaatgtagcatatacgctaatttttaccttgacattttttcttaatataatctggagatcatctctggtagcattttattttaattgaaaaacttgaagttttatgtgtagtacactcaggaaattactctgaatagtgatgcttttctgcataattcaagcactaaaacttaaaaaaaataattttggaaggaaatagtttaaaaaatacatatatttttctctgccaaggcaaaaagcatataataagcacaagttagctctgcctgggaatattgggctggagacaggggaggctcagtcttaagggaaggccaggcagggtggtctttgcattggtgggaggctgaagcctgggttagctaacgggccctgcctctgtgtcttcccgtccagcctgcagtgggcttagaaatacttcctggaattatgtgtaaaccaggtacagtcgcgcgccacttagtgatggggatacattctagaaacgcatcattaggcaatgtcatcgttgtgcgagcatcgtggaatatactaacacaaacctggatggcacagcctgctacactcttaggctgtgtggtgcggcccctggctcctgggctgtaaacctgcatggcttgtgacgtgtacagttgtaacacgatagtgagtttgtgtatctaaacatagaaaaggtacagtaaaactaggggataaaagatgaaaaatggtgcatctgtgtagggcactcaccatgaatggcgcttgcaggactgggtgttgctctgcgggagtctgagaggcctgggacatgactgtgctgctgtaggctctggggcactctatgcttagggtatgcttagggactatggaatttataaaaacacagttttctttcttcagtaataaccttgacttactataactttataaacttaactttttcaaactttttgactcttttgtagtaacacttagcttaaaacacaaacacattatacagctgtgcaaaaaaatactttctttgtatccttattctgtaagctctgtcac

SEQ ID NO: 28000 - DNA, 1027 bp, Homo sapiens
agaaaaagctaagctggaacagttgtggttgcctggattgagggtgacgtagtgtggcattaggacatgttttaagcgaatagaaacgttttaaatcttgattgtggtagtggttacacaactgtatacatttgcccaaacttttcaaattgcacacttaaaataggtggattttgttttatgtaaactgtatttcagtaaagccgtaccaagtccctggggccatgttccttcctgttgcctgtagcgtggtgtttcggggaaggaaaggcagttatggctgtggttgtcatttgtgtctcatttgttggcacagaatcccaatcccaatgtctgccgtctgctgcacgggggcaccgcagagcgagggctttcagcggcctggcgggaaacagcctagttaactgcctcttaaatctgatgctggctgtggaactttgcatttctttaggagagaatcagtatttggaagtgtttgcgtgagagaaggaaaatttgttcgttatagttgtgaaaaagaggttactgctattcctgcagaggacacaaatgaggagctgtgtgtttgggacctgtctgtaccccgagcgtcagttctgtcttcccttcgtccaagcaggagcgtctgctctggattagacgagaaagagttttcatgcccgcctgctctttcgccacagatctgttgcgctctcctcagcgttcaccctttccaggagcaggtgtgtggcaatagcttatgtagccttacactcacaaacaaggcagttttctggcttttaaatagttattttctttctgagtagtacgtactcatcctagaaaatttgataaaggcaaaaaagtatggaaaagaaacgcatgctagtctgtattcctgtcaccaagggagaactgtagaaccgagaccacgggtgtgtggctcaggcagcatcgctggttcatcccacagcactcacggagtgcttgcacgtgcagggattctgcgcctgttctctgaagcttaaacccaaacaggcgcgctgtt

SEQ ID NO: 28001 - DNA, 1065 bp, Homo sapiens
cctgcggggctgccctgcaccctgccttccacttgacactgggggccatgggctgaggttcattttggacgtgatttccatggtgatttcctccctttctgaacctccttgtaacttttcgagagtgtgctgttgacttcagatgcttcccctgtgaggggtgaaaatgttttcttcccagctctgagctgctctgtgggaggggccctgcctggggtctccactgattccccagtgcccagggcagcgtgggtagtggcagaaaggggccttgctgggtgggtgcaggaggaagcagcgctgggcatgccttgttctggggggccaggtgtgggggttctgatctcttggggccaatgtgtgtgtgtttcctcggcagaggtcctttctgccgtgacttcttccttctgcctggagcctggcaggtggctctgggtgatgcctagatgcccgtcctatcagcagcaggggtgtgccctcccgggcgggcctctgctgttccggagccctgtggctctcatggagcctgcactgggtttattgaactctcttgtccttctcttctctttttattggggctttgaccatttaaattcctttactcttgttttggtgggtcttgctggggaggggtgggggagagaggagactgtgctgccagcaccccgggctgctctcagcgggtgggggcacctgtctggaatctccatgtacaagcacaagcaggcattgtggcgttttgggaagagtcgtcagaagttgcctcctatggggcagaggtgccaggaggagactcttgctgtgcccaggtccagactggcaggagaagggagcggtgagtgatgggacatggagtggtccatggggagcagagccaggccgggaccctggaggggaggatgatgagaggccgaggataggtcatgtgggggaggagcccttccttctgctgctgtgccctggtcgctgctgtgcagaaccttctggtctgcagtgtcctctgggggctctgggtgttacctgttttgactgttgtggcctcatcttcatggaaggttgtagaaa

SEQ ID NO: 28002 - DNA, 1026 bp, Homo sapiens
ccacagggcacacacgggctggggctggggtgtggagctggtgcggggcagggcaccctggggtttgtcgatctcagctgactggaggcggctggttccagatggcagtgctgggggtcaggttcaggaggagatggagaagtaggtcactgactgtggtgagggggtcaaaggacagtttctttgttttttcctgtttgtattttaaggagagatcttggagccatgctcaatagcggaaacaaagtgcgccccatttggattcgtgcttcgggtcggtgggagttaggctggatgaggatgggtggggcgggagggggaggttgagcctttgacatgcttcatgtcagccacttcatccaggccactgtcatttagcctgcaccccgctactgcaccccacttggagctggttggcctgggcacgtctgcggtgctcggtggccatgctgtgctgcggggatgcagggagtccacggtgcaggacgcagaaggggaaggtggccttcctgtcatctctcttccttgtggttgtggaggtgacatggccctgcaggggtttggtcgtgtgtctgcaggccctagagcctggtgggaggcggcaaccttggtttgtccaggaaggggtggcagatatccagaatggagcatgtcctgtgggtgcaggttcctcacgggtggatctgtttgtcatcactgcatccctgctacccgggacgcccctgaggtattgatggcctggccagtgatggctgcaggaggcttggcaggggcagcgttgagggccacaggccacctgccatgaggttctgaagtggtgccatggcaggggccaggcccctcagaggagggactgtggggactgagggactgtcttgatggctgtgggggtcaccgagcggatggggagggagggtggcctctgtggatcagggctcttggtggtgggaaaacaggtctgggacaggcccagccctgtgtcctatggcggtgagaggggtgggagtgaacggtggatgggactca

SEQ ID NO: 28003 - DNA, 1026 bp, Homo sapiens
ataatgtgagttttcttccacttaagggataaatttgaagaaagcttttataaattgttggttgtaagtgagttgatcaaagcataattagcagctgtgtttgaggatcttgaagcagaggtgtaacagggctctggagaagcttgcctgagatttggggtaatttgcagggttcccgaagtgctttgcttttcttcttcatggtgctcagtaggaacctccaagccctcgatcatccaggaaacagttgctgtttagggtgttcacctgtggtgcccggctcaggcagcgtgatgggggcgtttacttaatcaggcctttgatagcaataaagcagttaaataaagggggcttttggctgcaggcccttctgtgccgagtgctgtgcacctgggcttcctggacgcttctgcttccaggtgggcctgcggttgctatggcattgtggtgtcagctgcaaacacgtacacagctgttctttccaattcttgcgtggaataatgaagtagaataagtgctgtcaagttatgttcgaaaatggggtgcttaatatttccatggttggaccatgaaagttttgagtgaaaacttttgatttttacatatctcaaatgaacatttgcaccaaagatgtacagctttcgaaaaacaaagagatacatgttgtccaccatgaggcccctctcccatttgagaaagtacctggtgtccgctgttggtcagtccgcggtggtcccaggctcttctccaggcctgccttctgcctggagcaggccatgctgcagtgtgcaggatgatgtagtgaagtgcccccagcttctcccaccgtgggtgtcatgttgtggagcagaagttgtcgttgggaaccgcgtgtgagggcaggagaaattgtttgttgggagccgcatgtggggacaggagaagttgtctgttggggactgtgtttggggactggagaggttggccccccgagccccattgtctgtggcctggtgtgtagacctgtgtccgtccttcctgaggtct

SEQ ID NO: 28004 - DNA, 1083 bp, Homo sapiens
gtaacttataaaaataactcttgcttggttaataactcattctcattacaactcagtcttgcaaactgaggaggagccgggagtattaggggtgggcagggttctcaaagctgcatgtgggtgtcaagtggagtagcagacgggtggcaattggatggggtgtgaaagggcctgcccttcccagccttccctccgtggaggtcttgggtgggagaagggaggggacagaggtttcaccctgaagtctttaaggctaagccttaggcccgagtgtttcagccccatagtgcacaccgggtatgttgaatttggtttaggtagctgtcatgatattctttgtcaggacagtgttgtaaagacagttatgttaatgtaattgtaatttgctggtttgaggtgccagagtttagattttattcactgaggaaaaatgagaaaactcagtctttagtgagattgttgcagatgacacagttgtcccaagatcacggaaaagcactagttatgtacagcttaggatagtcataacgtcatagtcaggttgtgattacagctgaaagaagaaaaaggtgatttgacacccacattagcatgttggtaaattgttgagagatcttttcagatcggtgtaaggtaaagaagctcatttctaaaggttatcttttggcctggcaaattcacattttcttcagtgtatcttggtctattgtgctttcatgcagaatttactctccttttgctctaagatttggcccaagtgtagattcccattccaggacagaaaagcactttctcaccatgggccttgatcccttggcctagggggcgtgtgcttgctgcatgttttaggatgagtactcccaggtgaatgtgtgtctgtgggtgctgtctggagcattggttcccatctgtggggaaagggggaaaatgtccactagcccttaatcgcgctgttgggacgggttggatttggcgagtccaggcccatgctgggtggcggcatgcagacggccacccctgaggttgcaggagctgtgagttctggtggccagtggtggcagccagtgctctggcacaagggac

SEQ ID NO: 28005 - DNA, 1035 bp, Homo sapiens
gctgctacccggagtacgtaccccccaggacccaggttcagatctgctcctactgctcgctgcctggcagtagaaccatgtatcacttttttgggaggatagggtggggtgaggggacagggtcttgctgtctctgtctcccagccgtcatggctcactgcagcctccaccttccaggctctagcgatcctcccaccagcccccacagtagctgggactacaggcttcagccaccacacctggctaatttttgtactttttgtagagacagggttttcccatgttgtccggctggtcttgaactcttgaatttaagtcatccacccacctcagcctcccaaagtgctggaattaacaggcatgagccactgcacccagcactcatatcactttcttacgtggtttgtggatcttaattaaaggttggtgttcgaggaagagacattgttgttcttggtgtggagaagaagtcagtggccaaactgcaggatgaaagaacagtgcggaagatctgtgctttggatgacaacgtctgcatggcctttgcaggtatgagtcggtggggagcgctgtcttactctctagagtctcagcgaagaatagggctttggagattaacttgggtgtgtgggctattgtgagccatataaactgagtaaatgaaaatcatttaaaagaattggatttggacttttaagttggctagtttctttggtggcctctctctgccatagcaggtgaaacaaatggctaaatggatgaaaacacttctggctgctgcgcaatttgacctccactgttatttttctgtatcaatcagttacaatctagagaaaggctggactttctagagctaactgcatctgtggcatggagaggacagaaccacgtcctgccatccccagcagtaaaaaggaccacactggtggatgcaggccatgcctcgccatgttctcagcgctgttttggtcttgctcatttctcctctcagcagatgcaatctaggaagatctcaattcatgtaatgaaattagg

SEQ ID NO: 28006 - DNA, 1050 bp, Homo sapiens
tcctgtagatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgaggtaagcactgtgcgcagctggggctccgaggccaggctgttggggcggtaggctgggcttggaggtggcgccctgacccgcatccccgcttccccacagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtgagcagccctccccgggctgggggtggcatctgtggacatgcaggggcacccgcgggcactcagggatggcctccccgcaggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggtgagacctcacacccgtgcccattccccaccccgcggtggccgtcggagcagttgggactggggtgtctggaatgagtctgggtccccaggccggccggctgacctggctgccgtccccaggatgggctatgccaggtgtccctgcagcagggccgtgtgagcctacagctcctgaggactgaagtgaaaactcaagcgggcttcgccgatggtgccccccattacgtcgccttctacagcaatgccacggggtgagcctggccgctgggccctcatcgtgaaggtctggagggacgcccgcctgcacttgcctggacctctgtctcctctgaggtgggggtgggcagggtggggaaaaaccgagcctccggcctcccgccccccagagtctggctgtatgtcgatgaccagctccagcagatgaagccccac

SEQ ID NO: 28007 - DNA, 1021 bp, Homo sapiens
tgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcaggtactgagcgtcctggccttccctccccaacccgggccagtgcaggccttcacctttcgcctcccacagagccagctccggagccccctgggcccccgccatgagacggcacagcagctggaggtgctggagcagcagagcacaagcctcgggcaggacgcacggcggctaggcggccaggcaggagccccaagaccccccagggccccgggaggctttcacctgtgttccccgcggttcgcttgtcctcattcagcagatgttacttcatgcctcgtacatgtgtcagtgcaggggacaggagctcgagagtcttaggggttgaccaagtcactgaattactatctaaactacctaatacatttgtttacagtgtataatatcactcaaatgtctttttttttttttttttttttttttgagacacagttttgctcttgttgcccaggctggagtgcaatggctcgatctcggcttaccataacctctgcctcccgggttcaagcgattctcctgcctcagcctcctgagtagctgggattacaggcacacgccaccacgcccagctaattttgtatttttagtacagatggggtttctccatgttggtcaggctggtcttgaactcctgacctcaggtgatctgcccatctcagcctcccaaagtgctgggattacagacgtgagccactgtggccggcctcaaatgtcttaatgagtaactatttcattaaattgacaggaaataacaaatggcaagttataaccaataattttaggtaactaacaagtgataaataacaagtcatcagataagagagttaaatagataaggggcccctcttccctgggaccctcggcgctcccccagac

SEQ ID NO: 28008 - DNA, 1050 bp, Homo sapiens
ggggggtctgttctaggctccctgttctgtcccattgagtgtggccccactgaggtgccatcctggacccacaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggtgaggttaggacagcaccagactgcgaggcggctcacctgtgcacacccttccctccagcatcctccctgtgttcccttccttgctgcctccacttcctgtcaccctactcacctctcttcctgcccctgcttttcacaggctgctggccaactcatgggcctgcctgtcccctgctgcctgtctgcctgcccctcgtccgcctgcctgcccctcatccgcctgcccctccatgcacacaccctccatacccctttcccacctaccccagcccccaccactgggtcacctggacatcccccaccgaccatcctggcgtctgcctgtcattctgcccatccctcgcccactgtgtgtctgtccagctgctaatctgccctgctaatctgtctgtctgctgtaactttgctccttctgtatgaggaggtttgtggttgaatacctcctagaaggagtggaaagagtaggccctggtccacatggagtgggtggtcaccagccccaaggcctggtcattcccgagacaggacatccgtgtggctttgagagctatgtcctcaaacagcagccaggtgctggcccacctccagccggccgaggccaggagttcctgaccagcctctgacccagcggtgaccatgctccacgggttcccagtgcctcgtgcctgcaggatccctgagggtctgacttgtgagcttgcagggtggggcccctcgtcctctcaatcgctgatgccacctgc

SEQ ID NO: 28009 - DNA, 1067 bp, Homo sapiens
gtgagggagctgagatgatgtggcagggtggttgggtgggcgtggcgcagtggcaccgtggtccaggcccgtgccaaccctcacctccccatgtgccttcccagggcaaccagatgagcatcacattcctggagccggcataccccacgcctggccacgttcaccgtgggcagctgcagctggtggaggtgaggggagctggcttgggcacccaggtccctcatggacctcagctcatctgggaaggccggaaggggtcccagtgctgctgtgcccattctccgtggtggaaaacagcccaggagcagaagcggggtgggggctggggaggtccccacacccattgtcagatatcttctgtgctggtcaccctggggggtgtcatgctgtcttcccacctgctttgtgagtccctgatccctgaggggtgagcagctgctcagtagctgttggcttcctccatgcactgcctgttagcatcttttgcccatttctctttgacttgcaaatctttttccatccttttagagttctttgttattcttggtgcttaccctctgtcagacttcagagtaacaaccgtcttctcccctctcacagctcatctggtttttctttgtttttttttttttgtttgtttgttttttgagacagtcttgctctgtcgcccaggctggggtgcagtggtgcaatctcggcttactgcagcctctgcctcccaggatcaagcgattcttctgtctcagcttcccaagtagctgggactataggcacccgccaccacaccctgataattgtgtattttcagtagagatggggtttcgccgtgttggccaggctggtctcgaactcctgacttcaggtgatcctcccacctcagcctcccaaagtgctgggattacaggcatgagccaccacacccagcctgagctgtcttctgatgaacggccttatagttaatgtacttgaatttatccttttttccttggcagcaagcgtttttgcatcttgtttaagaaagtatttgtcactacttgatcagaaaggacctgcctatgttttcttct

SEQ ID NO: 28010 - DNA, 1088 bp, Homo sapiens
gttaatgcttgcagctaactaggaatctacgtaagaaataactaatgaagcgttttgatagttggcctgactttgttgcacatcactgttttcccaaacacgcctctcccttgttggaatttttttttttttttgagacggagtctcaccctgtcgcccaggctggagtgcagtggtgcgatctcggctcattgcaacctccgcctcccaggatcaagcgattctcctgccccagcctcccaagtagctgggattacaggggtgcaccactacgcccagctaatttttgtatttttagtacagacagggcttcactatgttggtcaggctggtctcgaactcttgacctcatgatctgcccgcctcggcctcccaaagtgctgggattacaggcgtgagccactgcacccagcccttgctgggatttttattattttattttctagttagtgttgtgtaaaagtgtaagaaaatgagtttgtggagagggaaggtttgccaggaggggcgtactggggtctgcagggcatctgagactcccctgcctgtccccaccctccagattgtgactgcagcgcggcagggacccagggcaacgcctgccggaaggacccaagggtgggacgctgtctgtgcaaacccaacttccaaggcacccattgtgagctctgcgcgccagggttctacggccccggctgccagcgtgagtcccctctccccgctcaacctctacctgcgctcgaggtggacacctgaggcctggtgcctctgaccaagcatgtgggccaccctttcctgcagcctgccagtgttccagccctggagtggccgatgaccgctgtgaccctgacacaggccagtgcaggtgccgagtgggcttcgagggggccacatgtgatcgctgtgcccccggctactttcacttccctctctgccagtgtgagtggtgcctctccacgtgggcgtgggtaggggaggcccgtgggcctggcctaccgtgacacccgctccgctctgcagtgtgtggctgcagccctgcaggaaccttgcccgagggctgcgatgaggccggccgctgcctatgccag

SEQ ID NO: 28011 - DNA, 1071 bp, Homo sapiens
gaaccaccatgcctggcacgatattgtgtcatttttagctgcactttgactactctgtaagcttgaatcttcttgacttttcgagtgctttcttttttttttttttgatggagtttcactctagttgcccaggctggagtgcaatgctgcaatctcagctcactgcaacctctgccccccgagttcaagtgattctcctgcctcagcttaccatgtagctgggattacaggcatgcgccaccatgcctggctaatttttgtatttttagtggagacggggtttctccatgttggtcaggctggtctcgaactcctgacctcaagggatctgcccgcctcagcctcccaaagttccgggattacaggcgtaagcctctgcgcccagcctgtatcacctatttcttataagttgtgtgtttttctcctgatgggtcatttgccccttattttgggggggagcttttttccgtgtcctgattttgtaaattttgaggtgaatctgcccacgttgttctaccgaatctctggctgagtcggatgtagatgctcctcccttacccaggaattctcttgtctgctggttctgtgatggtttttttatgtggaaatgtttagtttttcatcaatagtgtaaaccaggggtcaacaaactgtcggaaaaggcccagacggtaaatgtcatagactgagggccgtgtggtccctgtggggaaactcctcagctctaccgttaccagctgtagcttgcaagcagccatagaacgcgtattcatgagtggggttggcggcgttccaataaaactttatttacaaaagcaagcgaggagtccatagactagtttgctaatccctggtgtaaactgacaatttatcttttcgctactgggccatagtaagcactcagtaattacctgtggctgtacagtattcactttcaatgtgttcattacaatgaattgtattgtctttcctaatggggacacagtgttgaacatcaatattttattttgtctaaattcacaagtgagattgttttggttttgtaaaatacttgggaaatcatccacactt

SEQ ID NO: 28012 - DNA, 1046 bp, Homo sapiens
ttttttttttttttttttttgagatggagtctcactctgttgcccagactggcgtgcagtggcacgatctcggctcactgcaagctccgcctcccgggttcatgccattctcccacctcagcctcctgagtagctgggactacaggcacccaccaccacgcctggctatttttttttgtatttttagtagaaacggggtttcaccatgttagccaagatggtctcgatctcctgacctcgtgatccacctgcctcggcctcccaaagtgctgggattacaggtgtgagccactgcgcctggccatgtgttcattattaattcaagaccatccttggccattctttctgactgttggctccctttcctacctcttttcccctggagtccccattagatacaggagcaccttctggtttccttctcataatttctatttcctctctctttatcttctgaggtgtcttctggatagcttcctttgctcctcttccacttcactaaatctctcttccactgtgtctgtctgctgtttagcccatccattgagtctttaattttatagtttcatttttcatttctagaagttctgattggttctttttcacatctgcctgttttccatagtgttattttttttattattatgttttagatttcttttttattttattttattcttttttgagacagagtatcacactcttgcccaggctggagtgcagtggtgcaatctcggctcactgcaagctccacctcccaggttcgtgccattctcctgcctcatcctcctgagtagctgggactacaggcacctgccaccacacccggctaattttttgtatttttctttagtagagatggggtttcaccttgttagccagatggtctcgatctcctgacctcgtgatccacccgccttggcttcccaaagtgctgggattacaggcgtgagccactgcgcccggcctatgttttagatttctttatgaccatttttaacattcttccctggcttctactagattactccattttgtgaggttct

SEQ ID NO: 28013 - DNA, 1108 bp, Homo sapiens
ggctcctggacccccagcagggagctggcagggctcatctagtgcctgcaaccgagcagcccaactttcatgcgcttggatttgggacccgcccttgccttctgtggggccttactgctctgtccacgctccagtttacaggggaggtggggaggcgggtggagctcagacaggacaaaggttcactcccattctcacggccagtgccgagcagaggcgggagccctgggccccttcggatgtggctggtgggtctgaggggaggagtggcacagtcacctgagccggaggacttgggctgtttgccaggagctgtgggccctggggacccacccaggcacttgttgctgccagcacagcttcaggtgctgagctccagcagagctaacttgtcctgggaaattaagtgccaagtggggacgcagctcgtgacagcagggagtggaacccaccaggcagccaaatgggcctccaaggagaggaagggcgcgggagccggggcttgccttggcctgcagggaagacattgccatcccctgactcaccgcacctgggtgtggactgagctcagctctccctgcaggtgcaagcaggggtgactgggaatctttcatggaaccacagcctctgttaccaggacctggtcacccaccagtgtcccaaaacattagcctgcccatgttctccctgcaccctttacccgccaccccacctctcctccagggaagggggctccatgtcatcagccagcaattttctgcctctttacctccaccatcaccttactcccacccaaaccatcacccccactaccagcccactcccaccatcatcacccccaccatcaccgtcatcacccccaccatcaccgtcatcacccccaccatcaccgtcatcacccccactcccaccgtcatcacccccacccatcaccacccccaccatcaccatcaccatcaccatcaccatcaccatcaccatcatcacccccatcacccccaccatccccatccccatccccatcccctgggttgctgcttcctccttcctgaaatgcaccctgtagtttttctattccatgacagtctatccggaattgtctgaaaac

SEQ ID NO: 28014 - DNA, 1040 bp, Homo sapiens
agtctctgccgccgtggggcctggggggagaggcaggggggtccctgggcaggccctccgtgaccaggcttctgaaggtctccgaatacccagccctgccctcacacccggctgctgcggtcatgactgtcagacgaggacccgaaggctcatggggatttattggctcctgtccctggcgtcgggcacagccaagtccaggggctgtggcgccaggaatctctggtgccatctcttggctgcctctggatggcttcatgcaccggcagctcccgtggtgacaaaaggggcctggcagctcccacctcacctcctgccagcctagccacctgcgtcaagagtactggagtcctagcccggatgctggccgtccctggccccgtgccaccctgaccagtcatgctggtgggagtgggtgctcctccccaatagggcaggcctggtcacgtgtcccccaaaattccctggcctgagaatgggggaggggcgggtcagtgatgggcagtaggcgtctgtccccaaggaagggggtgaggatggtcgtcgaggggggtcactcgcactcaaagcgtgcaagggagagcggtggggggcagtgcagtccaacgggccaggccccttcagccagtgagctgtggtctctgtcacgcggcctcttggcctgtgggagcctcagtggcaaggcccggagacgtcaaggggcccgggcaccgcggggacccaggcttttctggtgatccagcgccctcccctcccgccattccccgcagcctccaagagggactgtctggagcggttcgggccacagacgctggagcgcatcacacgggacgacgcggccatctgcaccaccgagtactcacgcatcgtgcccctggagaacggagaggtgggccggggaggggcagggcggtacgggggctggagaacggagaggtgggtaggggaggggcagtgccgagcggggctggagaagggaaaggtgggcccgggaggggcagtgctgagcaggggctagggccacactggcgtcaccgcat

SEQ ID NO: 28015 - DNA, 1046 bp, Homo sapiens
gctgactttctcaaactcagattgaggcctctggggcctcaatcaaccccaagcctgggagggcgcctttgtgtggacaaacagcagatctggtttcctgggggggcgggggagcagccaggacccagctctgccccctctcctcatccctgccccggctcccagcactacccctcccctgccaggatgcaggccaggattctgctgggagcctcctctcttccccactcacccatgcaggacaggcccccagcagatggcaggcccgggacagaagcggctgccaggctgtgtgtgtgagccattactcctcacggtggccccaggcaggtgcagccttatccccactctttggatggggacattgaggctcagcagttactgtgacttggcctcttcccaggactcggaagcagcagccaggaggcccaggcccacctgccgctgtccacacgtccactctggggccggtccccacaggcctccggaacagcttaattctgtctctctggagaccctaatccagaaggctgtgggcaagatctggaggtgggggggggtctggccgcctggatcccggccctgacggtccttctgtctgcagctcccccttccgccccctggcttgctgcattttgtccaagcctctctggagcccctggcagggccagcagggaggggtagccatgctttgccttactcctgccccttcttgctccctttggctctagacacattgatccaccttgtggtttactgtgagactcttcctgcccccagggctcgttgcactggcaccccctctgcctagagcacacccccccccttaccacgtagtgctcagacgccaccccgctagagaggcccaccgagattttcccacccaaggcagatgcccctctccaccctggtcttcctcttgtccttagcgccgtgagcagctcacatgagccacatcccctgagtcggaggagcagcaggtgcttggcgcatgtttgctgagcaagtggatgaggggcgcagaggctgggcgtggaaccagctca

SEQ ID NO: 28016 - DNA, 1044 bp, Homo sapiens
cccccattccgcctgtttcccctggggttcctggcccctggagctcactagggctccccagtctaggcctgaggcaagcaagtggtaagaatgggggtacggggtagggggaccgcaattaaataagattaaggtgacacgtggaagcgtaggtgcccggcctcggggtggacgctgcagccgtgtgccactgcatgtttaccccgggcgatgccttttctggggctccccagagatctgggggcaggagtcctggactctgcctcacaccccagcaaggtgctgggaggtgccctgacaggggcccccacttgagggaggggatgggttggggtcctgggagcaaccttgttactggaccggccccttccctgccaagttgtaggtggttagatcccagggaggtcccgggccccctccctgggagttcccagggccccctactccttccctcctaaaggctggcagggtggaggctcccctacacccagctacacaggcccaggccggggcaggggcatccaggtgggatcctggactctggactttcggtcgccacgcagaccaccccacagagctccatgaggcccccccatttctgagcaccccaggtttgcctgcttgtcatggggctgggcccgcctgcacagggcaccagcccaagcgcttctccttgccacttgggaagaaaaggagctgggtgggcaagaggagcctcggggagcatctgtggagagcccaaggagcccggatgctgaccctctccagatctccgacactgggcaccacctaagcctgtctgcaccccctctggcatgggggcccacctgaaaccccccaggtgtgaacccagtggcagcctttgggtcgggcctcggggagtgggcaggcgtgaggcatgtcacctgcacgggtgacttgtctcctggagccctaaggcggtggccatgctcctggcatggtgcctggcctggaaggctttgaagagccccaagtctgtggagggcctgccccgtgagtggtgcctggggctgcgtggcctgt

SEQ ID NO: 28017 - DNA, 1048 bp, Homo sapiens
ccaccattccaactgacacagtgggagcggcgccactgggtgccagagcccggccgtccacgtgggctcaggtccccactctgtctcttaccagccatgtcatcttgggcaagttgctaaacagctccttgcctcaatttacccacccatgaactgagcgtcagaatgctgcctccttcctagaactgtgcagatctagtttactaataagatgcttacaaaaaaagaaaagagaaggaaattacagagaaagatctgtagaagaacctgctgggaacagattttaaagcatagtggagagaaacccatcattcctgcagcgaccagaaaatcacggaggagccaggccagccggcagcagcgtcagcctccctgctgcagctcctctgcgtcctgggccagaggatccaacggtaccaccaggcaggctgccgcggggcctcaggcttctgctgggacccccacgggcctccaaatgaagtcccaggcatgcaaatacccaggcatcccctggtaattacccgtgggaaggagcttccagaaagacacacaggctggtcctcagggcctccaggcccagccttgtaggtcaggacacacaaacacctctctggggacagtccccaaatctcctccttcactggcttctttccccagtgtgggccctgcccatccagcctccgctgggctcctcttggggcagtctgtccgccgtcacccatcacaggccagcactcacctgggcctctcgggacagccggcgtctgccacacaccccctcagcatgcagctgggtgctctgcccctcccactgccctcagagcctgctgcctaccccagccccttagctcctccttccccacccaccccactgtgcaggccagcccaccgcatccccagcccttcctggtcccatcatccaagtgctctcctctggccagctgctcacccaccttctgcagccatccggctggtcccctgcccccacctccagctgggactgggcaggtgcacagctgtgtctggtgatggcgccaatgtgaggcac

SEQ ID NO: 28018 - DNA, 1072 bp, Homo sapiens
gggtggaaggtgctgctgcgagccagccggactcgggggctgctttggattgggtgatgttgggtggtcgagggaggcgcccaaccaaggcccaatgatgacagggagctggcagccaggacctgccggctgcagagtctgaggagtgcctgcctgccagccagtgttgctgggcagggcaccggggcaggctggggcctggtggaccgctagtcctgagggttgggggcctcggcagtctttgggcagtgagtgacatgacccatatcaccctgctgctgggggacactggatgctagggagtaggagctgggctggggtgagagtggaaaccaggagtctgcagtagctggaagatgtggcttgccgggcgatggctgccagggggcggcgctggggaggaggaaaggcacaaggcttcttgtgtttgtggcggtaccagttgggggttgtgatgggaaaaaggcgtcagggtttggcctcggtggctgggtggatggggctgtttactgagagggaagactcagagaagcaggatctcggcattctgggggcgtcaggtggggacatcgggaggcaggggatagataagtatggggtgagggcagggcggcgtcagccatcagtgattcacttctgttcgttttctagtgaacataggaattacagtgaacacctgtacacccatgcttcagtctcagcaatgaacatttaccgtatttactttgtacacacgcacaatttcaaagacaattatagacacgaaccttcatctctaaatatttctacataaatctccaagacaggccttccacagaatcccagtgccatgatcatgcctccccaagataataagtctttttcatatcctctaatgcacagactattcagatttgcccaaaatgttcttttattgccactatacctgcctaatttttttattttaatgtttattttgttttgttttatttttttgagacagggtcttgctgtctcccaggctggagtgcagtaacatgattatggctcactgcagcctctgcctcctgggctcaagcaatcctcttgcctc

SEQ ID NO: 28019 - DNA, 1032 bp, Homo sapiens
acccaccccaaaaaagaaagagaaacaaaaatgcagataagtgtcaaatagtctgatctggacttcaaatatgcccagcaggttaataagaaatatacttctgtggactgggtgcatatacttctgtggactgggtgcatatacttctgtggactgggtgactatacttctgtggactgggtgactatacttttgtggactgggtgactatactgtggaccgggtgactgtacttctgtggaccgggtgactatgcttctgtggaccggtgactgtgcttctgcggaccgggtgactgtacttctgtggaccgggtgactatgcttctgtggaccgggtgactatacttctgcggactgggtgaatgtacttcagccgaccgggtgaccatgcttctgcggactaggtgactatacttctgcggactgggtgaatatacttctgctgactgggtgaatgtacttctgcagactgggtgactatacttccatggactgggtgaacatacttttgtggactggttgactatacctttgtggactcggtgaatatacttctgcggaccgggtgaccgtgcttctgtggaatgggtgaatatacttctgcggaccaggtgactatgcttctgtcaaccaggtgaatatacttctgtggaccgggtgactgtacttctgtggaccgggtgaatatacttctgtggaccgggtgaatatacttctgtggactgggtgactagggaggagccggcgtgttagcgccagcatatgcagtccctcaggacagccagcctgccgtgatcctgtctgtgtggtcgtggcagtggcctgcagcaagccatcgtggttggctggaactagacgtgtgatttgaatgcaggagttcagtcagcccctcagtggcctaaaaggaagaaggtgtcagtcacagggctggttctgggccctgccttggggggaccccagttccagggttctgggccctgccttcaggggacccgagttccagggtcctgggccctgcctttgggggacc

SEQ ID NO: 28020 - DNA, 1029 bp, Homo sapiens
gctggtctcgaactcctcacctcaggtgatccacgtgcctcggcctcccaaagtactgggattacaggcttgagccactgcgcctggcatggcaatttcttttaaagggatctattcaaacttgctggggcagggtgcagtggctcatgactgtgggccgaggtgggaggattgcttgagcccaggagtttgaaaccagcctgggcaacatagcaagtccccgtctctaaagaaaaaccaacaatactagtagtggtggtgttgcacacctgtcgccccagctacttgggaggctgaggtgtgggaggatcacttgagcctgggaggtcagcgctgtagtcagctgtgatcatgccactgcactccagcctgggccacaaagtgagacccatcccccaaagaaagaaaattaaaaagctagctaatatctttttatgatacttttatacacatggactaactgagggccttcctcaccctactgtgaattatgaagggcattttgctccgacatttatttaatagacatttattgagtacctgctatgtggaaagccttacaccgtacgttgacagtttgaaagttggacttctagctctactgcgtagacttgtggttagagttcagtgagctgatgtgtaaagagtgtttcgctcaatgtctagaagtccaaaagcacctagtaaatgccagctgctgttttactggcaaagtctctaattaaagttctaaatagacgggtgtgaaggtgagtaacaagggccatattgaataagttgctcagtatctgcttgtttaggactttgcatgttactgaatgtaatatgtaaaagtttaaaaaatagtctaataacaagactccaattgtttatctctacaaagaccaagtttcagaatattaacagagtgttgggccgtgatcctttctgaatcagggccccttggagaaagctgtgcacgagttcctggtagggtatttagcccgtgaagggcaagtaatatcagtcttgaatgacagagttatctgc

SEQ ID NO: 28021 - DNA, 1048 bp, Homo sapiens
cgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaagtttctgtctcgggtcttcatcagcctttttctaacgcggagaagtttggggtcgtgcacggacgccctggccacccagtttcttgttgctggtttgcctgggcgtgggcaggagtgccctttggacccctccctgaactcatgctgagcccagggtgagaccggccgggtgcgggtccccacatccttccgtcacggggcagctgtctcgctccctgtggggacccagcaccatccagctctggagacgatgggcaggaaggtcgggaggagggactcacccccttcagaccctctcctggggctgagtgggagcccgagaccactgcaacagcctcaactgcggtgaaggagtctcatggttggggagtgagccccgaggccccagcccatccaggctgcagcagagtgtgcacccgccgactgcggggcgtgctgctgctgaggatgcaggtgggc

SEQ ID NO: 28022 - DNA, 1079 bp, Homo sapiens
atcttggcctcaggtcagagaagactcagtgcccagaagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaataggttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctccgtggccatgcagtccccagaggattggtgttctctcaaagcgggtgtgtggatcacacagtgtcctctgaagtgcttcgtcataaaggcaggtgctgtctggaccctgtgcctcagtgccctctgtccctgtcaccaggcctcggcgggtgttcctgccatagctgtgcagggtgttcccacccacacccctcatgccgcaccctagctagctggggtcctgtaggggccactccacatcttgggcgggacttctgtcgccccaggcacagcccacgttcctactggagcccattcttcacagctggagtgggctcagcctatgcctgtgttgtggaattatatgtccataaagggattggttggtatcagtaatttcagggttaaatatttgctggcgtggtgcattaaattattttagtgccagataaatttttaaaagcaaagtgctttagtgtgtcccctcaaatcctacttgggataaagagatgccacctaatgggtggcagaaaggaccctggtagaggttcttggtgttgcttgtgaagagctctggccagctccacgtgaccagggagaggaaaagcccggccctcctggaggtgaag

SEQ ID NO: 28023 - DNA, 1076 bp, Homo sapiens
ttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcaggtgcgtacttcaggtgtggtctgaacaagccaaactttttttttagattaacgaaaggaaagataactggtgattaaatagttgaacttggaaatgtaacctgaaatacagcttcactctttcatcttttaaaaagccccagttgtagggtgccttattgtccttttggaagtagagatcttagaaattgacatttaaatttgtgctcatccagttttgttgcctattcactttatttttctttaaccaaaatgtctgtatcattttaattaaagtaagtaattggcaaaagtaagctaccaaaaacgtaaaacttgcaagcgttcacttttgcttttacatataaagtctttgtactcttgaagccgggcacagtggctcacacctgtcatcccagcatgtgcttgagcccaggagtttgaaaccagcctgagcaacatggcaaaactccatctctacaaaaaagacaaaaattagctaggtgtggtaatgcacgcgtgtagtcccagctacttgaaaggctgaggtgggaggatcacctgagcctgggaggcggagactgcagccagctgtgttgcaccaccgcactccagcctgcatga

SEQ ID NO: 28024 - DNA, 1027 bp, Homo sapiens
atggttaaggaaagctatttcctgcttttaaaataaattacgttaatctgctgcccccactcttgggtaatgggtggttttaaacccatgtactgggagtgccctaaaactcatctctcaactcgggttttccctaagtgagggagacaatagtgtagttacacgagcagaaatctgagtgtggccatggacgcctcattccaacacttacgatctggagaaatggagttgatggttttgaaggtagcatgtaaccctaacttgcaacaaggtgagcgttaaacatcattaaagataccgttcaggtcacagcacacaggtgttctgtgtgtcacagccaaggcattttgccgaggtttctggaaatgctttcagccagcttttttagagttctttaaacgtgatattaaaacactccaaggtttctagtgcagtcactgaattggtttgaggtttcagtttgaatcacggttggcttcccggcaggtgtctgtctgccgcctctggagaccggggcttggttcctggtgcctgcctggtgtcagcctcctgccggtgtgcctccagcgccctaggcctgctgggccttttcattccatcctcaccccaccccctcgctgcttcccccaagaaaaagggcctccactgatttttatttaacctgactgacctattgcaaccctgcaggcaagatgctgcagacctgtgagctaagtctaatgagttaaactgagttgttaaaaacagattttcaaacactaaggtagtgactcctggggtgtatagacctgatctgatgacatagtacatgtggaattaaaagcaaagtttcctggacagataaaaactagctgtcacctttgttcctgtcgtgttagacgttgccattttttatagtgcgcttttaagatccagctccaacaggaatgagtgttttggggtgcggttgtgggtgaggagacagggcttggcagtgttgccaaggagggggtcctgtggctggaccacatctagcaaggggtaggca

SEQ ID NO: 28025 - DNA, 1062 bp, Homo sapiens
ttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtctttaatgccttctgtctatagtgcattttgtgctttttttaaaaagcaccgaaaggttaaatagtctcaattcaaagatgatcacagagtgccccactttcccgtcgtcagactttgagcagattccctaagggaaggcactcatgcaggcaagcagacctatgctaggtctggtgtgccttacaaaaaagacactttttttttttttttttttttttttttgagacaagagtcttgctctgtcacccaggctggagtgcagtggcatgatctcggctcactgcaagctccacctccgggttcaaatgattctcctacctcagcctcccaagtagctgggattacaggcccgtgccaccatgcctggctaatttttgtatttttagtagagacggggtttcaccatgttggtcaggctggtcttgaactcctggcctcatgtgatctgcccaactcggccttcccagagtgctggaattgcagatgtgagccacagcgcttggctaaaaatatgcagttattgagtatgagtagcttcataaaagaagaaaaatatgtccctcgttttgatcatgtaaacagcctagacctaagaaattgagccgcacataaaatgaatcatgcaattgctgcattat

SEQ ID NO: 28026 - DNA, 1060 bp, Homo sapiens
cccgtgagggtcattcacttggcagcagggctggtatggagggtcccagatagtgatagcatccttcctggccccagcccctggttggggagctgaaagtcgggactcagcttcttcatatcctcttttcagcatggtggtggccagcccatacttgcaaaagtccagaacagacttgggtccctttgcaggccacacccaaactggcacagcgtcttgttcactgtgcttgtggtcagagcagcccatctgcctgcggaggtgctggggagctcgtgccacctccgagctgctcgcgtccttgctcacgtccttactcacatccttaccctgctatactgtccaatatttcctatttgtccctactgtctggcttgtgaagccttgtcctgagcagttaaatgatgaaattgtacatttgatttgttagctgtatttttgtctaaacgttagttgtttaactatattaaaattatctttacaaatcatcttgaatcatctcacatagcacacattaggaaacactggtcagaaggacttgctttatgtagagctccactgtttgtagggaggtggcccctgctgcgcgtgtttggcggcaatgtcaccttttgttctgtggtcagttggtcactatgtgcttacactttaccgctaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaagg

SEQ ID NO: 28027 - DNA, 1117 bp, Homo sapiens
ggcgctgctgtgtcagcggttaccagactggcaggacccaggactgctttacactcctaaaaagcagggaagaccccaaagagcttttgttatatctattgatagtcaccatgtttgacatttaaaaatgagtcatttaaatgctgaagtgccttctatttaaaattggaaaccagccgggcacggtggctcatgcctgtaatcctagcactttgggaggccaaggtgggcggatcacctgaggtcaggagttcaagaccagcctggccaacatggtgaaaccctttctctactaaagacacaaaaaaaataactcggcatggtggcacacgcctgtaatcccagctactcgggaggctgaggcaggagaatcccttgaacccaggaggcggaggttgcagtgagctgagatcgtgccactccactccagcctaagtgagagcgagactccatctcaaataaataaagtaaaattgtaaaccattatatattaacataagtaaaccatttagtggaacctgttttcaatgacgaaaacaatgagaaagatggttttgttttcacaaatctgtttggcttaactgacagcttctggattctccttccgaattcaaacttagtgtctccgttcagcttctgaaatgctctagcatatactcagagtggctgtggaaacagcatggaatgttggtgttgtgcagactgctttgatccgggggcctcccaaaaggacccctggaccacgctttgagaaccacttctctaagagttgtaaaatagctctaaacacttggggaaattgattacttttaggaagataagctgtgtctttgaacaatttttagtggctcaaccatgtgcttgccccttggggcaagtgtggaatcaatctgatgcgctgtcaccggtaaagctgttccagtacacacctctccctcaaagtgccctacacagccccttgctgaatcctttgcagcagtgaaaatcgggggttggggggaggcaagagtaggctgtgcttggggccatggaattatgcaggtctctaagggtgtggaccgaggagaacataaaggaacagtgatttaaacctgtaataaacagatgcccttgaggg

SEQ ID NO: 28028 - DNA, 1047 bp, Homo sapiens
gtctgttcttgtagacttgtttcagcaagtttcataagatacctcttgttttggaaaagcgcgtatcttgaattttttcaggctttccaccagaggctgtcccttattagtagttgattgaattcagactatgtcaagcagagctcattgtgctgtggtgagaagacagggcacaaataagataatttgtgattgactgcccagccgtacccatggttaccagacagcccagcccatgttgcatgtgcatatgtgagcctcgcaaaggcttgtctaggacgtgcggatcatcggttgggccttggagggtgctggggtttcttcatgtaaggaggaaatgattggaatgggcattggctcccgttttgttcgcggtgaagttggcaggttctgctgttgatactgtgagtttttctacagccttagggtcataattcccttaaggtcagttctgtggagcccagtagggtgcttctcttcagtgtttatttttaagctgtgccacgtcttcattgtttggaatctctgtaaacaagacacgtttttcctttttatatgcctgtcccataataccaagtggcttatttggctcttgaagagctaagattgaaagtgtttaacaggtgactccctactatctgtgggtccctgcactgtgcccttgcctgagaggtctcatctctctggcaggctcagaagaccactagaaaattctctctaaacagagtctctcacttacatttcttatttaaatgacggggtcccttacagtggatactaagatcagcctttttatgactactatcaaatgatgtgtgttaattgcattacaaaagttctataattaacagttaatggaaatgtactaattgggaaagaggaggtcaaagaacaaagtccagtttgctcatttcatgtacgtgtacacagtcatctgtgagacagtctgtgttgtctaggcctcattttattttttgagtagtaattttgaggttaagttgttatatgaagttgaataggtaattgtacatattttaataagaattc

SEQ ID NO: 28029 - DNA, 1039 bp, Homo sapiens
aagccaccacacccagctaattttgtttattttttgtagaggagaggtctcactatgttgcccaggctgttctcaaacttctgcgtgcaagcagtcttcctgcctcagcctcccagagtgctgggattacaggtgtgaaccactgcatagagtgcttcctttactcaaatcatagaatgtttaaaaaccaggatatcagccatgtttcaaaaccacattattcccatggatgttttgttttactctcaaaacccaaaagcataaaatcaaacccctacatactggagacttcaggctttcaaagagattgggcaaatcaaaccaccttacttttcaggataattgataaacccatcagttgttgatgcttagaatggttagcagaagtaggtaggaaacactcagacctcaattttcatgaacttcacttttcacagtattttaaacaattagagatgttggaaagaggtaaggaagaattttactatttagtctgctgcacatattcttttgttgttgtttttttgtttgagacagaatttcactcttgttgcccaggctggagtgcaatggcacgatcttggctcactgcaacctccgcctaccggtttaagcgattctcctgcctcagcctcctgagtaactgggattacagacatgcgccaccacgcccggctaattttgtattgttagtagagatggggtttcttcatgttggtcaggctggtctcgaactccagacctcaggtgatccacctgcctgggcctcccaaaatgctgggaatacaggcatgagccatggcgcctggcctgctgcacatattctgacaccatgtgtctggtgaacccagaccctgtaaagaatcttcactggtgattgtttgatataggtgaccttccccctccctctttttgcctgattttatttccctttctagattataccactaaatcagaaagcactgaatattttgtaagtttgtttgggtgagagcaagaataatcttttcttgatttttatttttatttttttaaaacc

SEQ ID NO: 28030 - DNA, 1003 bp, Homo sapiens
attcagggatgaggtcccctggggctaaatgaatgaacagattctgaaaagcagaagctacgtccgggggtctctgggccacaaatcactttctgacctgcagccgtgaggcgtgaggctcactcggaagctcccggaacctggagactgccctcactcaacacttgaacaagcaaggggccaggttcaatgaaacacctgcccgcccggcacaccaggctcaaaagcaagcaagcaagcaaacaaacaaacaaaatcaaatcaggccttcacaactccccaaatcatgtgtgagtttctacagagcagaagccaaaaatatatgttatctaactaggtcctatttacatatatttttatggctgctctaaaaaattatcacaaacatagcggcttcaccccgtttcccctgttgtgattattacacattggatgcctgtatcaaaatatctcatggaccccataaatagcaacaccctgtatgtactcatgacaattttttaaaaaagaacacttacactttccatttctgcaggttagacgtctgaaatggtctccctgggctaacatcaggtcttgggagggctggttccttctagaggctccaggggagaacccctcggccctcagtcccatcctccgtcttcagagccagtggtgtctcgtcactgagacctgctctgccctccgcctctatgttgaagggcccgagattctactgggtccccccggataatccagggtcacccctccgtgtcaggcggctgactggcagcctcatgtgtccacagtttccgtgcaccgggaggtgggcatgtttaggggcccccattctgcctcccatgagtctgcagggcctgactttgtaatttgggatcattcttagggtacccagatacaacaaacaaaaacgcagcaaacaaaaacacagggtgcccagctcaacaggaagtttggagaagcagtgactgattttttagtgtaagtctgtcccaaatattgt

SEQ ID NO: 28031 - DNA, 1091 bp, Homo sapiens
ggtagacttaaactgaaccatacgtatcctaattgtatcaaatgtagatggattataccctcaagttcagaggcagaaatggtcacactggatcaaagaagcaagacccgacagcatgctgtgcccaggagacacacttggaagacccagggtggtagaaggtacaaagatggacaggtgcgtgtgacacaaagagtgagcacaggaaagccaaggtggctgcatccataccagacagggtggggtctaagacaagtagcatcaacagagataaggaggtatatttcacaatgaaaaaaggcccatttcatcaggacatcagtcataaatatgtagcacataataacagaatttaaaaatatgtagcacataataagagaatttaaaaatatgtgaccatacacaaaactgacataattaaagagagaaatagacaaactcacaatcatagttggagattttaacacccttttctcagtctttgatagaacaagtagacaaaacattagtaataagatatagataacaccaccaatgaacttgacctaattggcattaatagaaccctacaccaaatgctgcagaatatccactttttttcaaatatttggagaattcactaagacggatcatatgttatactttaacataagcctcaatacatttcaaaagtttggaatctttaagagtatattctattattacaaaagaattaactaagaaatttatttgatatttaggaaagccctcaatatttggaaattaagcaatgcacttctgaatatcccatggggtcaagaaaagaccataatggaagccaagaaatatttctagtgaaatgaaataaaaatataacatatcagaatttgtgggatacagctaaagcagtgctcccaagaaagctttaaatgtttatattagaaaagcagaaaggtctgaatgtctaaaatcagttatttaagtttccatctaagaagataggaaaataagagcaaattaaactcaactctacttaaaacaagtagaaggaagagaaaaacaatggtaagaaaagaaagcaatgaggcagaaaataggcaaacaatagagaa

SEQ ID NO: 28032 - DNA, 1367 bp, Homo sapiens
acggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaacttggtgtcacctcattcttcaccctacttgatgagtttatgtgttggagctttttaagctgc

SEQ ID NO: 28033 - DNA, 1033 bp, Homo sapiens
aaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggtgaggctgggtgttgcaggcaactgccatgcagatgtgtccttggtgccgtacttagaccaggtggcccggtggtgagcagatgcggcaggtccgccgagctgagtctcgtgacaggcagctcccagttggccgcaggtgggcgggcccaggtcctggcagcctcgtgggctttccctgcggagagtactgctagtaaccagtgatggtatttgggtagatgtcaccgaacgactttgatcactttccaattataattgaataattgggaccacagtgtacacattctgtttttctgttacaaagaatttgagggtaac

SEQ ID NO: 28034 - DNA, 1052 bp, Homo sapiens
atccagcctgcctgtgtggccgtggaacccggtgagcacagaaagtatcaggagggtttagggctgccagcagagctgattagcgtcaccgtcttctgtggctcaggatgtgaatggtggtgatctggagctgaaggatttgcagagtactggctagaactgcaggccctgcaccttgggtagagggaagctggatgggtcatttatgggctctctgtctgtgcagcgtgtgtgctaggtgtgtccatttaatacttaaaacggattttcaggaatgttacatgcctcatgtaatgtggattttttcatgtggtaagtgatgtcctgtcttagttaaggctttaggtgtaagtcagaagtgtccctgggcatctgtttctgtggcctgactcctctggttggtgttggggccaagtggattagaataccacacagccatcgaggtctttttttcccatctgctctttttgcgtggaaggaagatgtgttgtgattgcagcgctgctgaggagcacgtgtccagctaatgggaggaggagggctggcttccctgtgggggggactgtccccttgcctgccgtccttgaaggcacctgcggccagtgactcgaggagcaagtcctgtgcacagaccgcccccctgattcgctcacccccccagtctgggcctgttggccagggcagcacccgagggaaaggctgcagcaaaggagccagcatcatggaaactgttttgagggagaataagctcagattaatctcatgtttgtggaacactgatagcatcccacttgtcttcttatacccccagaatctcaaatttatattacggggaaacagcagttagtgcattttaaaagatgattctggggccaggcgctgtggctcatgcctgtaattccagcactttgggaggccgaggcgggtggatcacctgaggttgggagttcgagaccagcctggcaaagatgatgaaatcctgtctctactaaaaatacaaaaattaaccgggtgtggtggtgggtgtctgtaatcccagctacttgggaggc

SEQ ID NO: 28035 - DNA, 1016 bp, Homo sapiens
attccagtatccccatatcttagttttgtctgttctggaatatcacacaaatagagtcgtgcaaaatacactttcgtgatggcttctttccctttacgtgatatctcggagattcagccacgttgtgcgtatccgtaactgccgagtagtgtgccatggaaaacacgccacattccttcatttattcacactttgcacactggggtggtgtctaagttttggctagtatgaataaagctgtcttgaaaggtctttttgtaggcatattttttcttcctcttaggtaattacctagaagtgaaatttctgggtcctgggtaagtgtgtatggaacgttattaaaacatgctaagtggtcgggcgcagtggctcatgcctgtaatcccaacacttaggaaggctgaggcaggtggatcacccgaggtcaggagttcaagaccagccgggccaacatggcgaaaccccgtctctactaaaaatacaaaaattagctgggcttgggggtgcacgcctgtaatcccagctactcgggagactgaagcaggagaattgcttgaaccctggaggcaaaggttacagtgagctgagatcactccactgcactccagcctgggtgacaaagtgagactgcatctctaaacaacaacaaaaagatggtaagcatttcacgcttccgccagtgatgtgtgaggtccagctgctctgcatctctgtcaacacttggtattgtcagtcttttgacggcagcaggccttgtgggtacaaaatggtgtctcagtgccatttatttgccctcaggagggagtcgccagttcttgcagtaagaaaccactggtgtgcacaaaaaggaaagggccaaggtgacgtgcacaggcaccagcagcatctacacaagtggcagttggaacagtgtagatttcagcaccgatctcgtggtcaggactgtgtgggtaccatcagttcagagagtgggagccatgtgctggattagtcacagtgggctgcctggaagaggc

SEQ ID NO: 28036 - DNA, 1050 bp, Homo sapiens
tggcaggggcgaaggtgctgagcatctgcctggactgtgtggatgccccgaacaccagggactcccatctcctccatcgccactggcgtctgctcggagccagagggtcccctcccgccgtcccctcccgccctcctggccctattgcatgagtccagcatgaagccccgcggagcatgaggagctgcactgtggccgacgcgagcctgaaaccctctctgtttctcgcaacagaaagaagataacacccctggcccaccctcccccctcccatcagaggcaggtagggcagcccagtggcaggaagtcccgcccccatcagaggcaggtagggcagcccagtggcaggaagtcccgcccccatcagaggcaggtagggcagcccagtggcaggaagtcccgcccccatcagaggcaggtagggcagcccagtggcaggaagtcccgcccccatcagaggcaggtagggcagcccagtggcaggaagtccctcccccaccatcagaggcaggtagggcagcccagtggcaggaagtgaggacttggccccgtcggctggtgtggggcagtcttcatgtaccaggccccagtccaggggagacttgggagcttgtggcctctcctgggtgggtcctgctcagccacaccccgtcttgagctgcccttgtccagctgggcttttgtagacttactgcagggtctttgtttccaagtgagttcccacgtagctgcaggcctcagcgcacacccaccgtggtggcccctgccagcccagcagtggccgtgactctgtggataccagactggtcagaagcccccgtccctgagggcaaaggagcctccctcccttcttattgtcatgagtgacctgtggcctcattggagatcagctcagctgaattctgcatcctacacacacacatgcacacacgcaaacgtgcacactcttgcacacatgaacacatgcacacgcgtgcacacagaaacttgtgcaatgcacatgagggcacacacatgcacatcgagtgcacacacacgtgcacacacaga

SEQ ID NO: 28037 - DNA, 1038 bp, Homo sapiens
ccggcagcgccatctgtgccatctgttccaaaaacttaaaaaacaaaagtcggagctgttgcctgcactttccgggtggggctgtggcaggaggggcagcggcgggaggggcagctgcttccttcatgcagggtctgcgggccggcgaggcgggggcagatgggcggaagctgagctggaaggagctggagccttctgagggcctggctgcgagattcatctccctgaattctggctttattcctcctggtccacgcctgctgggaggagccacagatctcggccgcatccggctgcattctgtctccagggtttctggaatgctctgagatgcctggtcggagccaccttaggaagcaggctgagtcctgaacatttgggacctgggcctcgttttttttagtttagaggaaggttccctgcagcccgaggagctgccttcctggatgcggcactgaggactcagaattcaagtctgtggggctgtcgttgtccccaccccgccctgttctcaagtctggtcagcctcatcctcggtgggatgcagatacgcctgcccttctctcgccaggcctccccagcggctcctccctctgctgggaatgcccttccccttctccccctgtggccaactcctctgtatcctgtagcccccccgcccctgtacacgcctcctccgggaagcccacaggattatgtgcgtggctctgctgggctgagctgggtccctgagcccctcctgtgatgtgtgatgccctctgtgtccccgcggcgcccctcctgcctcccaagcctctgggctcctgactgggaagccagggacccccgcgtcctcccctgctcctaccccgctgagagttcagagaaaaccccgttaggcagacagaggatcgcccgcagaaggcgcacgagatgtctgcgcatttttcccagggctcagttaattgaagaacttggccaacgagcacaggaaattaatcgcggcttggaaatgggacgtcccttgcgtatggtttgtctgcctgggcctcggcacca

SEQ ID NO: 28038 - DNA, 1061 bp, Homo sapiens
aggctgggcgcagtggttcacgcctgtaatcccagcactttgagaggccgaggcgggcagatcacgaggtcaagagatcaagtccatcctggtcaacatggtgaaaccccgtctctactaaaaatacaaaaattagccaggcgtggtggcacgtgcctgtagtcccagctatcaggaagctgaggcaggagaatcgcttgaacctgggaggcggaggttgcagtgagccgagattgcgccactgcactccagcctgcgtgacagagcgagacttcgtctcaaaagaaaaaaaaaaaaagaaaagggacccgcataccaccgagggggccaccgagcactcaacgaggggatcaatcagttctgggaggggtgcaggccctgtggctcccagcctgtgtgcaatcgcgggtctgtcttccacgctgcactgctgggatgcccagcctttgaggtcctacattcgtcctagaaaaacgcttttgttaacttactgtctgagacatctctgtcatacttttattctctacagtcttcattgcccctctttgctggcctcttcatatgatttatttattttttttttgagacggagtctcgctctgttgcccaggctggagtgcagtggtgcgatctcggctcactgcaacctccgcctcccgggttcaagtgattctcctgcctcagcctcccaagtaggtaagattacaggcatgtgccaccacgcctggctaatttttgtattattagtagatacggggtttcaccatgttggccaggccggtctcgaactcctgacctcaagtgatccacgtgcgtcagcctcccaaagtactgggatgacaggtgtgagccaccgtgcctggcctcttcatatgatttttaaaagtggctttattgagatacaactgaaacacaggaattgaggtccagttttgtcacccccccgccttagttccagctggggttggccgtgtaagtgctgcccctgccccttcgaaacaatgaatctcagttgtttatcttttgcttaatgaggatgttgaggttcaggtctgggggct

SEQ ID NO: 28039 - DNA, 1067 bp, Homo sapiens
tgtcaacacagcaggggcagcggcctccagcaccaggcccatgtgcttggtctccagagccctgccatgggggcggtcggtttcatctctgccaggccattgtcctggtcctggacaccgtgcaggggctttgggctgggccgtgggggcctccttggctgcctcccctgggatcttggagcagggttgggctttgggaagtgtgcatgcttctgggcttgctgggatggccaagggttggctcttggccggtcacctgggagctcaacgtgcgaacagtctgtagcccagggactctgccttggctggaggtgacgcgtggagacacttgcagaacctgagactgttcccagggttctccaagccagaggagaccccagaatggccaccactaggctctgccagcactgtcgctgcccacagtgagggtgcaggtgtggagtctagagacagcagggagacagaccagcagcactgagcctggagctgaggtctggggacagaactgggagggactcccccagctccgcctccatctcacgaggctcggtgttgtttacctgtgatggcgttttcctcatggggtatcatgtggcgaacgccactctcccctccccagggaggcctccagccatcagggaccctgcactcccctctggcctgagctgctaggtggctcgtgcttacacaggccctggggggctggggcactgtgctgccggccccctcccctgctccctgtttgtggcaggtggcccagagggaggcttcatgggatgggagtgggggccacactaggagaagctccggacaaggctgggccaagctcggaggcagcacggtgtccagaagctagggtggggcgaggctcctccagctctgtccctggcctggcccttggccagactcagcatcctcctagtcaagtcatctgccctgcctggagctgatggtcaggggcccggggtttcggggacttggggctggactggggatttgttcacagtgtcagcaactcctgagcagcctgggctgggaagggtgctttccctctttgtcctcctcct

SEQ ID NO: 28040 - DNA, 1027 bp, Homo sapiens
aaacagaaattctgtactcattaaagaacaactccctgtactccctcccccagcccctggtcacttctgttctactttctttctttttcgttttttgagagagttctcactctgttgcccagactggagtgcggtggtgtgatcacagctcattgcagcctcaatctcctaggctcaaacgatcctccagccccgccttccgagtagctgagactatcccagctttgtgtattttcttttggttgtcgtttttaattttcacatttctgtttggttataactcctgtttctataccaagattttctttccacttggttgacaatgtttgctttcctcttggagctggtccgatagcacctgaaagtctctggattctgcgttcaagagccagcttctcttgtgtatttgttcctttgagaatcaaccagactaccctttgccaggaagtttgatcgtgttctggatgctttgactactgtgctatggactctaggtcttgttttaagtttcacagagaatgtagacttttttttttcatagcaagaaatcgacctggttaggttcaggctgcaaattttgcaccccgttcctgtgtctgtgttcttaggccagtttattttagagactttccagtgcactgtggatctgtcccatatgcgccactggggcccatctgagacctgggcagtggcctatcctgtaggtcagttttcttccctttgccctttagggtcaggaccacgtagagactgtcttgggacgacccaggcgctcacacacagctgtgtgccatcctctcttctcccctctcctcttgtcgcctcccccacactctgactccaggctcgttgccctctggctggaaaccaggggcttttgtgttccctgtgctaggtaggggatggagagtgagagggcaacagggagcccccacactcttgggccaccattcctttagtcaggaggaagattcccctgtctccaagctttttgggccaggacagccattatcactgggttttagca

SEQ ID NO: 28041 - DNA, 1004 bp, Homo sapiens
ttatctgggtagagatgacggtgctggcacctctcctggggcttgttctgaggcctcaatatttcaggaaaggtgcttggccgcttgcctgctaagagatgagtgctcaccgcacgtcaagcagcctgactgtggtagccacatttctgagtttcctgcccagggaaaggcaaatcggctggtggctcctgccatgctgtgctcctggcaccatgagaagcagcctgggtgacagtgacctccatctgcccccggggggagccggcagcagcctccagggccctccaggggtcagaggccactgtggtcccctggcctctcagttctggacagatcccccacctccgcgagctcccaacaggagcctgcagtcaggcccaggctcatgactgggctctcacccggcactctgtgtgatgctgggtggaatgcttgccctctctgagccttcattcctcctctgtagaagtgaggcagatagggtggctcatgcctgtaatcccagcactttgagaggctgaggccggtggataaactgaggtcaagagttcgagactagcctggccaacatggtgaaatcccccctctctgctaaaagtacaaaattagccaggtgtggtgacacactcctgtgatcccagcaatctgggagactgaggcaggataattgcttgacccggggagagggaggttgcagtgagctgagattgtgccattgcactccagcctgggcagcaagagtagaaactctttctaaaaaaaaaaaaaaagaagaaagaagaggaggaagacgaagaagacgaaagagaaggagaaggagagctgataagggcatccacccgggtgggcgggaggggtgggtgtgaggtgtgaccctgggagtgggcaccatccacctgggcggcgggaggggtgggcgtgaggtgtgaccctgggagtgggcaccatccacctggacggcgggaggggtgggcgtgaggtgtgaccctgggagcgggcaccat

SEQ ID NO: 28042 - DNA, 1029 bp, Homo sapiens
attctcctgcctcagcctctcaagtagctgggattacaggtgtgcaccactaagcccggctaattttttatatttttagtagagatggagtttgaccgtgttggccaggcaggtcttgaactcctgacctcaggtgatccacccgcctcggcctcccaaagtgctgggattacaggcgtgagccaccgcgcccagccagataagtcctctcattgtccacactttctgggtgagaaagtgaggcacagagcgttgagcagattgcccagagcctgctcaggagccaggagtttaccttttgcagccacacatctcatctcctgagagcagtggccagaaaaggctgtcctgtggactgagctgaagtctgagtcatctgctccttgccagctgctataggagcgtgctggcctggggtggtcaggaactcctgtacccctgccctcttcctctaattgctgacgtacccacagctccagcatacagcaggtgcttgacagatgtctgttgaatgactgagtgtcctgctgagatatagggctccttctaggagccagagttaatttctttctttcttttttttttttgagacagagtcttgctctgtcgcccaggctggaatagagtggtgcgatctcggctccctgcaacctccacctcctgggttcaagcgattctcctgcctcagcctcctgagtagctgggattacaggtgcatgccaccacgcccggctaatttttgtatttttagtagagatggggtttcatcatgttggtcaggctggtcttgaactcctgacctcgtgatctgcccacctcagcctcccaaagtgttaagattacaggtgtgggccaccacgcccagccaagccagagttaatttcaagaatgcagaggtctgataaaagtcacactttatgaaaaacatttttttttttgaggtggagtcttgatattgttgcccaggctggagtgcagtggtgggatctcggctcactgcaacctctgcctcctggattcaagtgattc

SEQ ID NO: 28043 - DNA, 1028 bp, Homo sapiens
acggagtctcgctctgtcgccaggctggagtgcaatggtgcgatctcggctcactgcaacctccgcctcctgggttcaagtgattctcctgcctcagcctcccaagtagctgggattacaagcatgcaccaccacacctggctaatttttttgtatttttagtagagacggggtttcaccgtgttggccaggatggtctcaatctctgacctcgtgatccgcctgcctgggcctcccaaagtgctgggatgacaggtgtgagacagcacacccggcccacccccagcatttgtcccacctttcctgtgtgaatgggatcaccacatagctgatatggtgcagggcgtggtcctaagttattcctgctaactgactagatgatggaattagcacactgccatcttgcaagcccccagtgattaacatattcaggtgttcagcagcaacaatgttcacatgggaagaaacgggaaaggagatactgtgagccttctgatagaaaggacgtcccatctggagcccggcaaacggtggccgcagtctaactggggccctcaagccacctaagttcagagtaaaccggggaactcgtgtggctgcccctcctgtacagattccgactctgcagggtaaacggcctgggctcttcaataaataaagtgtgaggaaaagaatggaccctgccaagcacagtggcacacgcctgtagtcccaggagcttgggaggccgaggcaggaggatcacttgagcccaagaggtggaggctgcaggaggtggaggctgcagtgagccgtgatggcaccaccgctctccagcctgggtgacagagtgagaccccatctccaaaggggtgggggaacagatagggatgaaaactgaagttctggtcctgaatgagatggcagaagcccaccccaccacacgtcccccactagttacaacaaaaagccctgcacatcaagtaactaacaaaactgaagagtggagaaggccccgtggtgatgttcacacaggcctgggggtgggt

SEQ ID NO: 28044 - DNA, 1030 bp, Homo sapiens
gccttcctaatgtttgtgtcatgtcaggaacctcccttgcccccctcctccctgagtcctaccccttgtcccaagctgtgcaatacagtgataaatgaaaggggccaggcactgtggctcatgcctgtgatctcagcactttgggaggctgaggtgggtgggtcacttgagctcaggagctcaagaccagcctgggcaacatggcaagaccctgtctttactaaagaaaaaaaagaaaaagaaatgaatggaagggaataagtaaaagcatcatttgtaggtgacatgactatgcatatagaacattcaaaagaatctagaaacttagatttttaacaggataattaaatatactggatatacagccaatgtacgaaactcaatatacaaaagtcaattgtatttctataaataacagagtttcattttataggacatcaaatgcctaggaataaattaaacaaaaaatatgcaaagacctctacacagaaaactataaaatattgctgggagaaattaaagaagataatgataaatgaagggagatactatgttcatggaggagaagactcactattgttaagatgtgaatctccgctgggcaccatggctcacgcctgtcatcccagcactttgggaggccgaggcggccggatcacgaggtcaggagatttgagaccatcctggctaacacagtgaaacccgtctctattaaaaattcaaaaaaattagccgggcgtggtggcgggcgcctgtagtcccagctactcgggaggctgaggcaggagaatggcgtgaacccgggaggcggagcttgcaatgagctgagatcgcaccactgcactccagcctgggcgacagcaagactctgtctcaaaaaaaaaaaaaaaaagatgtgactctccttaagttgatatattgggtcagcacaattctggttaagatcccagcagaggggtgtgtgagtgcccgtgcgcgtgcgtgtgtgagtaaactgactgctaaatatatttggagatgcaaaggatct

SEQ ID NO: 28045 - DNA, 1026 bp, Homo sapiens
gggcgtggccggtgctgacttgcgacctcctgctgacgtggcccctgctgtggttcgagcggcgtggctgctgtgccgggcgtggccggtgctgacttgcgaccatctccatgtgctggttgcaggcgatgagcatttccagggctgggcctcttgttagcgtggtctctagggtgtcctgtcgagtgtacctccccgtgggctggcgcatcgtgcaggaaatggggacacggcggtcctcactgtgtgtccactgcccctttgcggtacggggtgccgggtggggatcccaccgcctgcccagttctcctcgtcatgaatgcgccgtggttcaacaaacagcgtccggccgtggcaattctgcacaaaaatgggatggtggtcgcagatttctgaatttagagaaccattaaatatgcaggcagcaggccagcagcacagagcagccgacactcagagggcctttggggatgggttctggaacattctagaaaaactgaactagtttccttggatttgtaggaccagtaaccttggcttggctgttaaattaaacagatggcagtttcattactagaccatcaatctctgacatccctgtcagaggacttgccatacttctcattcaattctgttgaacttcgtgcttacttttattcctttttcagcagtaggcgggcctcctctctgttactagacattgttctcccagtagaaaccatgaaaactgtcatttaggctcagaacatggctgcccacaagttgtgctgggctggcgctgatctcctggggccttgaggtgtgtgctgccttcgtgtctccaaacagcacgaggaagccaacttcacactgacaagccgaggatgcgccgccggccggtcggccggggacaggagactgtaagccccgcatcagccgtgcccggaaatgtgggacgcggcctctggagcgttgctggtgtaacccccctcactcttttaaagagtcaaggattctagggacagccatggcggtgcggtgccgcct

SEQ ID NO: 28046 - DNA, 1082 bp, Homo sapiens
agagtgctgggattacaggcatgagccaccgtgcccagccaacaaagactttctcctatggtttttcttgagtttttatcaatttaagtataacgcatagctccatgattcaagttggtttttttgtatgtggcgtgagatcagcttgaggttcactttttacataggattataaggttgttccagtgctgcttgctaagaaacctgtcttttatccattgagttaccttgctaactactatatacataaaattaatgagaatttcttttatctgtcttttttttttttgagatggagtttcactcttgttgcccaggctggagtgcaatggtgtgatctcggctcaccgcaacctctgtctccctggttcaagcgattttcctgcctcagcttgccgagtagctgagattacaagcacgcaccgccatgcctagctaatgttttgtattttagtagagacggggtttcaccgggctggccaggctagtctcaaactcctgacttcatgatccacccatctcggcctcccaaaatgctgggattacaggcatgagacactgtgcctggcggaaacccaaattttagcatttcacacaagggagagttctttcagcttatcctgatttcttttatgtgtttttcaccttgatttgttacaataatttagatttaaaatttggctttaaaattgggtgattttggccaggcatggtggctcatgcttgtaatcccagcactttgggagtctgaggtgggcagatcacctgaggttgggagtttgagaccagcctgaccaatgtggtgaaaccccgtctctactaaaaatacaaaaattagcggccgggcgcggtggctcacaggcctgtaatcccagcactctcggaggctgaggggggcgaatcacgaggtcaagagatcgagaccatcttggctaacacggtgaaaccccgtctctactaaaaatacaaaaaattagccaggtgtggtggcaggcgccctgtagtcccagctactcaggaggctgaggcaggagaatggcgtgaacctgggaggcggagcttgcagtgagccaagatcatgc

SEQ ID NO: 28047 - DNA, 1050 bp, Homo sapiens
gtgtgctggtgggtgaattcagggcgcttgaactcaggaaggctggacgtgtgtcccgtcgtttattcccggttctcccagccacctccggttcccgacgctgtgagtgcagctttgctggctggtgctgcaagtgtgtttaggattttctgcctgtttcgggagtgtatcggttccgcttgatcagggctgtgttcatgtttctaaaatgttaatggtaagagctcactattgagtaaaagcacagatggtaatttttcccgcaaaaagcttcttagataggggaagttaaaggtgtaagttctcgcagtgtgctgagtgactggctgggtttttctggtgagtaagtgcttggggcaggctgcgggacagccttgtgctctgagaattgttagtgatatcacaaaggtttttatttctgaagggaaactaagggagtcaggatatttaaaaccgcctcggtgcttcctaaacagtggctgttgtttttttccaaagtgaatgaaacatttcaggttaatgttactctgtactttaagtatttctgtttagcatcaccttattaaaagtgagcctggaccagacatggtggcttacacctgtaatcccagcactttgggaggccgaggtgggcagatcacctgaggtcaggagtttgagactagcctggctgacatggtgaaaccccatttatactaaaaatatatacacaaaaaaattagctgtgcgtggtggcacacacctgtaatcccagctacttgggaggctgaggcaggagaatcacttgaacctgggaggtggaggttgcagtgagctgagagcgcaccattgcactccagcctgggcaacaagagggaaactccgtctcagaaaaaaaaaaaaaagcgtgcctgcttgtagtcccagctgctcaggaggctgaggcaggaggagcgtttgagcccaggagtttaaggccaccctgggcaacacagcaagaccctctctaaaataaaaaataataatagtaataatggccaggcacaggggctcaggcctgtaatcccagca

SEQ ID NO: 28048 - DNA, 1027 bp, Homo sapiens
tctgaccccttgagatcctttccagcccgaccccttactttaggggtcagcctgcccccgtaagtcctgttatttattgtatttatattctttttttagttggtccttttttgtttgtttttgagacggagtttcactcttgttgcccaggctggagtgccatggcgcgatctcagctcactccaatctctgccctccgggttcaagcgattctccagcctcagcctcccgagtagctggaattacaggcgcgcgccaacacgtccggctaattttcgtatttgtagtagagacgggggtttcgccaccttggccaggctggtctagaactcctgaccttaggtgatccacccgcctcggcctcctaaagtgctgggattacaggcgtgagccaccgcccctcacgcctggctagtttgtccttttcatggggactttttattgtacgcgggttactctgaaaaagatcgcgattcgtcccctcgccctgcaggcgccgctgccgcctcgcctcgggcgtggaccctgcggctcgggcctgcgcgtgtgcaccccgaggttgtctcacttcctgttcagggcgaccagcgctgcgccctccccactccacagatgaggaagctgaggttaaagtcacttgccccaggtcactccgcaagttgaagcgcaaccaggatactctggaacaggatgcctgacttcagaggagaggcgcgtaaccaccaggcaactggccccacgaaaacaagtcccgcaacttcccttctttggctcctacttgctcccggaagaaaagccttaaacggtattcaagccctttaggatctgatgtcctaggactccactctgggcttccagcctggggtggtactggtccctaggcatggaagctcctcccactgccccttccttcacccggccacctcctcccacaggtgtcttcctggtactcttgcacaggcccgagtcccttaccaccacggccttagcctgctctcgtgctctcagtaatgttttctccatttgc

SEQ ID NO: 28049 - DNA, 1050 bp, Homo sapiens
gggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggaggg

SEQ ID NO: 28050 - DNA, 1497 bp, Homo sapiens
cccgggcgggggcgggcgcgccggccggcctcggtcggccctcccttggccgtcgtgtggcgtgtgccacccctgcgcccgcgcccgccggcggggctcggagccgggcttcggccgggccccgggccctcgaccgggaccggtgcgcgggcgctgcggccgcacggcgcgactgtccccgggccgggcaccgcggtccgcctctcgctcgccgcccggacgtcggggccgccccgcggggcgggcggagcgccgtccccgcctcgccgccgcccgcgggcgccggccgcgcgcgcgcgcgcgtggccgccggtccctcccggccgccgggcgcgggtcgggccgtccgcctcctcgcgggcgggcgcgacgaagaagcgtcgcgggtctgtggcgcggggccccggtggtcgtgtcgcgtggggggcgggtggttggggcgtccggttcgccgcgccccgccccggccccaccggtcccggccgccgcccccgcgcccgctcgctccctcccgtccgcccgtccgcggcccgtccgtccgtccgtccgtcgtcctcctcgcttgcggggcgccgggcccgtcctcgcgaggccccccggccggccgtccggccgcgtcggggcctcgccgcgctctacctacctacctggttgatcctgccagtagcatatgcttgtctcaaagattaagccatgcatgtctaagtacgcacggccggtacagtgaaactgcgaatggctcattaaatcagttatggttcctttggtcgctcgctcctctcctacttggataactgtggtaattctagagctaatacatgccgacgggcgctgacccccttcgcgggggggatgcgtgcatttatcagatcaaaaccaacccggtcagcccctctccggccccggccggggggcgggcgccggcggctttggtgactctagataacctcgggctgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaataacaatacaggactctttcgaggccctgtaattggaatgagtccactttaaatctaatccaggaaaagagtacaaaacgccacattctcacttgtattgggagctgaaaaatgggatcacatggacgcaggaaggggaacaacacacactggggcttttcgggagacagagcgttaagaaaaacagctgttgcatgctgggcttaatacctaggttatgggttgacaggtgcagcaaaccaccatggcactcgtttaccttagtaacaaatatgcacatcctgtccatataccccagaacttagaaacagaacgaaacaaaagaaaacc

SEQ ID NO: 28051 - DNA, 1073 bp, Homo sapiens
gtgcagggactccgggcgtcctgtcctgtccctgcacggcggctttggccccagcctgtagccctctttgcgcagctctgcgcccgcagccctgcatcttccccaggttgtgaggtgatgaggcgaaagtcatcggaaagacgccgactcggtgtgcagggttcctgcgtggaaggagctgtggtccgtggggtcccccgtccctaccttaccctgttcagaattagactgaggcaccattaaaacatagacagcttatatgagtaaacagtgattaattaatgggacagcgctcagcaatggtttgtggtttgggggctactagaaggtcttgaaagaaaggcttgtataaggtgtgtgaggaagcaaagacaattaaataattgggtacagttatgtagtcgctttatttggagtgtctgggtggaaatttcctggttatgtaatcagggattaattggaggtttgtagttgtttaagcttgaatttcgtttcctcctaaggtagtaacttagaaaaaatgcatttgagttaggtttctttttttacatagaggcctagaccactagagccacttcaatctaattgactgctatgtaattattttaactttaatcaaagacactggttttcgcctgcattttccaaatgtgtggcaagcagggtctcacatccactactctgttctgccagcctaacctggcttgaagtaaaatcttaaatttccggtttcttgctgacattccccaaaggcaacttctcccctcccatacattatcaactatttttgtcctttattgcacatttcagaaacagtattttaattaatcactttttcacagagcagtggatggcaatttgtaaaatacttgttttctacttacaaatatttcacatgagaaaaaagcagaaaataatcccctggcactcagctgtaaaaaatctttctgctgtttctccttgtatcctcccttagcacaaacgcccttattaggacatcttgggattgaggttttccttgggaaactttatggggcaatgtttccttagccacattcgggcctttttctagt

SEQ ID NO: 28052 - DNA, 1028 bp, Homo sapiens
agggaagaaggtagaacttactctttatcccactttaaatattctgcttttataaatagagcccccatttttattaattattgaatctggttggattgccacataatgtcttttcatactgctttgcaatacttcagacatacttgtatggaatctgaacattaatgtttcccatcaggatgaaagaataaagggactaagatagtacactcttgaattacaagctaagtctttgtattagtcttttttcatgctgctaataaagacatacccgagactgggaagaaaaataggttgaatggattcacagtttcacatgctggggaggcctcacaatcacggcagaaggcaaaaggcacttctcacatggcagaggcaagagagaatgagagagaagcaaaagtggaaaccccttataaaaccatcagattttgtgagactgattcactaccacgagaacagtatgcgggaagtcgccccggtgattcagttatctcccacaacacgtgggaactatggaagtacaattcaagatgagatttgggtggggacacagagccaaatcatatcagtcttaatttgaatctgaagcttgcccagcattttctcacgtcaccttaatttgcaaaagtggagcttgggtgaaatgaggaatgaaagtaagagagaaagagaaggaggtcatattgagtgtaaaaaatgtggcaatataatacaggagaaaaaatgtttgctgtggaatattaggggaaaaataacacaacaaatgagttctagtccgtgagctctcatttgtcaaccctgttgattttgggaaacatagataagttatctgatctttaattttgtgatttttgaagtgaaaaacactataatattgcataaatataatggaaataatcaaatgagatattaggtgaaagcatttatcttatattcatgtgtaatgcacacgttctttcttcctttctcatccttgcagtcgcattctcttccttttacgtctttcattccatttaggtgtcaaa

SEQ ID NO: 28053 - DNA, 2054 bp, Homo sapiens
ggtatcaagtcccccttccaggtagccattaacaactattccaagttggcattagagactaaactagatggtcataattggtcctgtctaaaatgagagccatggggaatgcccaattatgattggctgtttccttccatgtttgtgtgtgtgtgtgggtgtcctgatgaggtggttctccagatacttgtatctggtatccagattttctctgcttctccacagcaagaaatgatgtagggcatctctaggcttgtcttttgcccctaatccagactcatgggtctcggggattaagggtcctccaccaattcataagaccttcacctattctccttgttaccatcatcacaaaacttctgtttctgattgctcctgctcctctcccatatttttatttgtcttagagaagaaaatacttgaattaatttaggttagttttttttctgagttgttggtacggtcttccttgaccttaatgtttttattccatgttgttatatgtactctgttgggctctcaagaatctttttattatgcaatctctaaaagtaacctaagaagtaaatttttatttgattgacaatgaaaataaatgtctctgcagtatgcaattatgacacatagattagttttgagaaagtatttggttggtatatttaatgttggacagtgcttctttaacaagtgtattaaaccactccaacaaaacttggtaagagaaagagtctccttcagtttccttcctggaacttaagctcatcacggtaggatacccagaatagaaggaaaattggcactttttcattgcttgactggtctgtcttacatctatcctgatgctggcttcaggcagaaaatctctctgttactagctttgaaattttcacaagatattgcagtaatatttagtgatgaagtagggcattctaaagaatatcagtaaggggttttcttcttcctcatagcacccataagaccttctctactcccccacatacaaaatttgtacctcagttttccacatgtgggtgcctggaatctttctcctatctcctgctgatgtgccccattagccaaacccacacagaagccagagaggcataggagaaacctggtgatgtaacccaaacaggcagccctcccaggtggagaacattttggagataggtagaaagtgaatctataggatcaaattgaaaatatgtgacacactcttcatctgcttatttattgagtacacacacacacacacagacatgctactttgctattaaaacacacaaacacatatatttaaaaattagcaaaaattgaagctaaagccaagtaatttcaaacttgacataataaaatcatttggatactaataattcagctatgtgcaaagcacttggtaggcactgcaagcagcagagatgtatgtgaggaaaagcagctgtttccaaagagcgtatagttaagcagtgaaatcagatagcattttatctcctagaaagcaaagtgttaagtgtaggtgaaacttggacagtaggatccagatttgaatgcaaatagcaacttctaaaatcagaaatgtatctttattagcaccgaggatgtgcctatttgaaaacagatgaagcaaatgaggagcaagcattctcttgggaaaaatgtggaccatacaaatccagcaatgacatgattaccgggaccccaaaatgttctgaaaccctgcgtaatgaccacctatgaggcttatgactcctctagagtgaagtttgcttaatctttttctctgatgtcttccttagttatcttctttttaaattagaaaaattaaaacgtagttccttggttttcaacattttttcaagtctggatgttaattttttcatgatactacatgaggtcagactcaatggtaaaatcaattaatgtattttgcttggaagtcattcttgaagtgaaaaaacattctgctatacttttggtttcagcctctctttatgttaatgaatactaaagaaaacaaaagtagccacctagttgcaaagcatgcgcttgttaat

SEQ ID NO: 28054 - DNA, 1095 bp, Homo sapiens
gaaaggtctcaaatcaatggcttccacttccacctaatgataatagataaaaaaagagaaaattaaactcaatgtatgcaaaagaaggaaataaaagagtagaaatcaaagaaaataaaagtaagcaaaaaatagagtagtagataaaaatcaatgaaaccaaaagctggttccttgtgaattttgatataatgataaatctccagccagacatatcaggaaataaacaaatgagagagagacagagaaagagagagagaaggagtgagagagggaacaaatttaccagtataaagaaagaaaggttaatatttgtaaagattctacaataataatgaatgattgtgaacaacttcatgccaataagttcaacaactttaatgaaatggactttaatgaaagatataagctatcaaagcatattcatgaagaaatagattacttggatagtcttatatatatgaaagtaattgaacttatagctaagcacttcctacaaagaaaacttcagactgagatggcttcattgatgaattccacaaaacatttcaggaggaaatagtactgattccatataaactcttcaagaaattgaagagatcatacttttcaactaattctgtgaagccaatattaccatgatatcaagagaagaggaaacattacaagaaaaggaaactacaaactaatatctgctatgaacataaatgaaaaaattcacaaatccaatcctgtaatatataaaaatgataatgcatcataaataaatgggctttatccctgaaatgcaagattgttttaacattcaaaaataaattgaggggacttttattttcacctttgacacataaagaggttggaaacttttattcctgacctttcaacaagaaaaagctgaacaaaccgaaaatcaatgaattttcttggacctgtgagataattgagggctcagggtaaactgccaccagaaatctggaggtgaatacaggtaaacacaaggagtcccagcctaaatggaacagaagctactggagccctaaactgatagggacactaaaaatactaactttgatgaatccctggaggctgaatatg

SEQ ID NO: 28055 - DNA, 1056 bp, Homo sapiens
gacttcttttcagaaatcatgcaagaaaaaagagaagagagtaaaatatttaaattactgaaagagagacacaccaatatagaattccatattcaaccaaattatccttcaaaagtgaagaagaaataaagtctttatcagatgaacaaaaagctgaggaaattcattgccaacagaacttttctgcaagaaatatgaaaagaagttcttcagagagaaggaaaatgatatatattagaaacttggatttacataaagaaaagagcatctaagaaggaataaataaaggtaaaataaaatcttttatttttaaaattcttaattgatctaatacatagctgttcaaagtaataataataacaatatattaggtgattatagaatatgggtaagtggaatgaatgacagcaatgcaaaatataagggattcaactgatatgggggatgatctaggaagctgatattaccatgagggcaatagcacacacaggctttaatgggtaacacttcaacgggtttgatttttggggaagcctcttatagcaggaatctgtccagagattacagcatggggttggctactcagaagggaagaggaaaaaggaaacattttgaggagagggaaatggagagaaaacttactacctaggtgatgtcactcagcaacaaggaagggattctctaggtcagaaaactccaaagtgcgtagcagcttggggtcttataaccacaggcttgcttttgtcaatggccagcaaatgtgaggatatgtaaagcaagcagcctctcagtgactaaaaatctgcttgtttgagctattttaaaaataactggatatgtaaaaatttgagtttggccctgttgggcttttcagctagtgggtctcagcatgcagtgaagaaataagcaatctggggagcagtacacagacattatttttgacttatttatataacagtaaaggatggagggaaggattgggaatgcactattataagtgcaattaccttataatagcctattcccaattccttccctccatcctttgtatgaagc

SEQ ID NO: 28056 - DNA, 1064 bp, Homo sapiens
tgcatttatataacattttggaaaataggaagtaatctgtagcatcagaaatcagatcattggttgcctgtgggatagatggggtttgaaagggtgggaggaaaggcttaaaaagaaacaggtggaaactttgggaatacgagtgtgttatgttgattatggagacagttttatggattcatgaatatatttcaaaacttatcaaattgtaaatttaaatacatgcagtttttatgtgaaatcttgatgtgttttgtctttttaaaaacttgttattagaaggttgaattgctattacttaattattttcctctgttttagactataatcttttcaaagtcaggaatccattctattttttttaacttttatttttaattcagggtatgtgtgcacgtttgttcatagataaatctgtgtctgtgacatagatagacttttgttgtacggattatttgtcacccacgtattaagccttgtactcattagctatttttcctgatactctccctcctcccaccctccaccctcatgtagatcctagtgtctgtgtttgccctgtatgtgtccatgtccctgtgttctcatcatttactccacctgtaagcgagaacatgcagtatttgattttctgcccctcttagtttgctaacgataatgacctccagctccgtccatgtcctagcaaaggacatgatctcattcttttgttacggctgcataatattccatggtgtatatgtaccacattttctttatctgtctacattttctttatcaccacgcctggctaattttttgtatttttactggagacagggtctttccatgttggccaggctgatcttgaactcctgacctcaggtgatccacctgccttggcctcccaaagtgctgggattacaggcatgagccatcgtgcctggccaaatgctagtgatttttgcacattgattttgtatcctgagacattgttgaagttgtttatctccttaagaagcttttgggaggctgaggcaggagaattgcttgaacctgggaggcggaggttgcagtgagccgag

SEQ ID NO: 28057 - DNA, 1041 bp, Homo sapiens
tcctcccactcacttggccacgggccatgtccttgtcgggacaagcgacgctgttagtgacattgtgagagaaagggctcgtagggctagggcggctgttcacccctgggcagccctggtagctctgggtgggtgaggaaagagggggccttgcaggtggggcggcaagggaaccaaaacaatccctcgggcggcaaggaggaggacaggagggtatcccaggaccgtgggcccagggccctgagggctgggagcacaaactgtcctgagcaggcgcgatgtggtggaagcttgggagctcaggagcctggggaaggcctggagcgtcggaagaatggaggccacccagagagcccgaagtctgggcaggggatggaaacctctggcgtccccactcaacagcagggtgccaccacggcggtccggtgcatggcctcgccagcgatggcgggaggctcttggaggccggcggaaggtccagcgcggagacccacagtgctggggcgtggagggggagagcagcccagcagcgggcgagtggctcagaggtgaccgatcggagccccgcggccctggagtggcggtgatgcctggagccaggcgggcgtggccgggcccggctcttgtgtcagccaggtatcactgccgctgtctaaggccttaccgccctgaagacgcctgctctcctctggtctgtgaagctacgcagggtggggcttgtttcagtttgagggagaccgcgtgggactactggacgctgtgggcttttggcttcccgctctctccctctttcccccttttgttgctctgcctcccaaccaccccctgactctgctaccccttttccggctgcctgagtccccatcgcaccccaggacctcctcgtgggggtccaccgctgcagtaccgccaggcagcagcatcccacctcttccgccttgctgcagctccaccaggtccccggctctagccaggccggggcaggccaggaccagacccccaaaggcacaggcccaggttccctgccatcctggttatctt

SEQ ID NO: 28058 - DNA, 1055 bp, Homo sapiens
agatgcccaccaccacacccagccaatttttgtatttttagtagagacagtgttttaccatgctggccaggctggtctcaaactcctggcctcaagggatccgcctgccttggcctcccaaggtgctggtactataggtgtgagccaccgcatccagcctaaagtacagtataaatctaatgttttgtttttgatcttctatctagacaatctgttcagtgctgagaatggggtattgaattccccagctattgtattggcatctatatctccctttagacctaataatatttggtttatattatatatctcggtgctccagtgttgggtgcatatatatttagaattgttacatccttttgctgaattgatccctttatcaatatataataaccttcatctttttttaatcacttttgagttaaagtctgttttatctgatatgagtacagctaccctgcttgcttttggtttctgtttgcatggaatatctttttccaccctttcagtctatgtgtgtctttacagatgaagtgagtttcttgtaggcaacctatagttgggccatgttttttaatccattcagccagtctatatattttaaggggggaaatttaatcagtttacattcaagattgttactgataggtgagggcttctgtcattttgttaattattttctgttttttaaatatatcctttgttcctttcttcccctcttattgttcatccttgtaatttggtggttttctgtagtggtaaaatttcttttctctttctcctttgtgtatgtgctgtaccagtgagttttatacttttttcgtgctttcttgatagtaactatcatttcacttccagatgtgggactctgttgagcatttcttgtaaggctggtctagtggtgatgaattctgtcagtttttgcttgtctcagacatgtcaggcatttagcttcaggacctgattctagttcctgccctgtggtgacaaatagaaacagatccctggtaccctgcttaggtactaagccagctagatgagagcagatgaaaaaa

SEQ ID NO: 28059 - DNA, 1051 bp, Homo sapiens
catcttggctccttcacttacagccccttacccacccccttcctcaaggacttaacttgtgcaagcagtctcccagcacatccaaggacgcaattaactaataagatactgtggcaagctatgtccgcagttcctaggaattcgcccagttgatagcacccagagcccctgtgtttgtgtccagttgataacacccaaagccctgcgtctatcaccttgtaatggatttaaagcccctgcacctggaactgtttgttttcctgtaaccatttatccttttaactttttgcctgctttacttctgtaagattgttttaactagactccccccacctcccctttctaaaccaaagtacataagaaaatctaacaccttctttggggccaagagaattttaagtactagccatctcttggtcaccggctaataaaggactcctgaattcatctcagcatgtggcgtttctctgtaactcactcggttacaacaactgtctatgttcattcagggcactgtggctctacaatcagcaggtgaaaaagtcagccaggcctcgattactcccttcagtttagcaagtttctttaggccctaggttggttcagaggtgctattcaggagtcagggactaaaataaaaaacttcagaaagctaaggttttggcagtgagagtttggcagaagagtgtggaatagatctttaaaaaagtgaaagtttctaaataaagattgaaacctgatgggaaaaacaatagagaaaaatacaaaaattattttcatgctaatgttacttatttatttatttatttttgagacaggatcttgctttatctccctggctggagtgcagtggcctgagcttagctcactgccagctctgcctcccgggttcaagtgattctcccaccacagcctccctagtagttggaaatacaggcacgtgccatgatgtccagctaattttttgtatttttagtagagatggggttttgccatgttggccaggctggtcttcaactcttggcctcaagtggtcagctcacctcggccg

SEQ ID NO: 28060 - DNA, 1035 bp, Homo sapiens
aaaatatatatatatatatatatatatatatatatatatatatatataaaaatacatgttttcagtcatgtagtgtatgtgtgtgtattatctttatatatgctatgtattatgtatatattatttataatatatagataaaatatacattatatatagaaacagacaaaatatacattacacactcacacacacactcattcacacacatgtgcaatgtggtctaaggtattgcagtgtggtaacatgtacacatttcacaagtttacatctttgagttattctggaagactgttatcacctctggcaaggaaggttcattaggaggttaatgggttctaatgtacatgaaacggttggctactgccttgtctgttacccagaggccctaagcaatcaggaagacagtaacaaaatttctgctcttggtaacgtttgcagtgcatttcataggtgtcattaatatcacaagctgagattgaaaagcttctggggatatatgaaaaattaatgggcattagaaaagtaaaatagcatgaggttgtgtgtgtgtgtgtgtgtgtgtgtgtgtgttaaagaatgcatgaagattgtgagcagatgcccaaggggtggagaagagagaaacagtatctctgtggattggagaaaggactgtggagggaagggctgcagtgtaaactgaagtaactgttttaatgaaaatctgtcagacagtagagctacaggcagcactgcttaaatccctagggaaaaagtagagtgtttgcgtttttgcgtagaacatgtatctaatatctgaagcaccttcacctacttccaggtgagcaccaacaatggccccaattcaccttcaagtggattattatcaaagtacatcattatgatactatcaggtcatggcaagtgttataaattgtgtacgcacaaaaattcatattttaaaactctaacccctagttcctcagaatgtgactatacttggagatagggcccttcagtgggtaatgaagtcaaaatgagactgctagagtg

SEQ ID NO: 28061 - DNA, 1028 bp, Homo sapiens
caaaaatgaacacattacattgataaagtataagattgatctaaaataataaaaaagaaatatagtaataaaaattttttatgaattcaagtacaatccagttttctattttaatccatatatattataccaaagtacaaaaaatatataagcttctttacttgaaaaatctccctaaggcttttgctcaacctatcaccacatctgtccatttaatattctcttttttttgccattaatatagaggcccctaaatttgacttcatttttttatttatttgtttattttaaattcataaaattctatgtattcattatgtacatggtgttttgaagaataaatacattgtggaatggttaaatatagttaattaaaatacacattacctcatatagttattttgcaacaaaagcattcaacatctactctgcatttttcaggaatataatattttgttattaactgtggtcaccatgctgcacaataaatctcttgaactcattccttctatctaactgtaattttctatcctttgaccaacatctccttaacaccttcccctcccaactgcccagcctctggtaaccatggttctactctctgcttctatgagatcaacttttttagattccacatgtgagtgaaatcctacagtctttgtctttgtgtgcctggcttattatacttaacataatgtccttcaggttcattcatgctgttgccaatgatgggatttccttctttattatgtctgaatagtattccaatttatagatctctatctatctatcatctatctctctctatatataggtgatatatatatgcatactatatttttaatatatatagtatataccatatactatatatatataatatacatattatatttttcttacagcttcatccactattgaaatcttagttttattttttatcttggttatagtgactaatgctgtaattaacatggaagtgcagatatctcttcaacatactgatttcatttcctttgatatacacc

SEQ ID NO: 28062 - DNA, 1011 bp, Homo sapiens
tagaaaatattttcatttaaaattcagtcttaatattttcagtagtagggggtagagacttatatttgtagttttttatagttttctacatgcttttcatagctgttaaatcatttaagcatacaaggtttcatcatggatcacagggatactgttatttatattttatatttgagtcaatggagttgcaaaagttaaccagttcttaaggtcacaggatgataaagtgctagctttgaaactaagccttctgacattaagccattgaattaattattttactttttgaaataacttctctgtgttaattttcaaactcatctagaattttgtatagcctgatttattgatgcaatggtagcctccacatacactctctggcaggctatcccagaggtcatgaaactaaaaggctcccacaccaaatgaaaatgttcaaattacagcttttgttacatccattttaaaaacagtgaaaagcaagaagaaagatattggatagcttagcacacttaggaaaagctgcaagtaggcagaaggacgaactagctgaattctggttacactaataaacacgtgccctgtttctctctgctgtatcagcctcccctgctgactgcagtacttctgcagcctctctaagtggttcaggctttttgatgtatcacttgttggtttttaaatttctcttgctatactgaaaacaaatatgaataacaaaaacaatccgttcttgcaaagggaaagtgcttctctttgcattctctttgcatttcttcttttttttaatgtttggcttcatcatgctctctggtactgtctggttaacttacacaggctgatagaataggtcagggtatattatgttctgatatatcatatagatgtatgatatagatagagatctatatctatatatagaggagaggaatagatatactctattcagagtagacatatagatctatgtatctctatatagatacttatatatagagagagaagtatagc

SEQ ID NO: 28063 - DNA, 1027 bp, Homo sapiens
ggtcactcactaaagaaaacaattaaaaaactgtttgtgaaactttatatctttaaagtgaatagagatcattctgctattttagattttgctttcagaatcttaagtgcactatcatggcttgcaccatgttctgaagagtagttggccatgatttaacttctttttttaatttttaatttgcgtgaaaagcattttgggcaaaagagtaaaccgtgccttagttgtgttggtattacggggacagttagggtttactgtgatcaaccaccagagttatgtttggtttatctgggtgagtaatgaatgccccaccctgttgtagatttggtgtagattgcaatattctacctgtgcttgactttagaataagacctgttctaaaatgggctgtctacatacagcctgctaaatttttgctttgagattatttttagaattttatgatactgctttaaagtaatcgaagatactcaagtttggaaagcaaggatagtgcattgttattttaggcacgttgggaaagttgtttttgagacttgtatgttagttgatattattggtaaagttagaaggatattgcacactgcactttatttacagtgaaataattcaagatttaataatgagaatttaaaagagtttccttcctaatcctccctattctattttgaataccttcaagttcaatttttaaagacttaaggcttaggaaagagcacatggtcatgtgaacgctaagcaatatttaatatgtatggtaccatttgtttataattgtcttcagtgttgaatattaaagtctgtttcaaagtgagaaataccaatttttcacttcctaagtttgaacaatgggaagaactttgtaagtttaggatttttttattttcatttgattttgactaaactgtattaaataactatgcaggctctattgtatggttcagaggttatgcataaaattgtagaatcaagaatcaagttaacgaaagtgatcttggctgtcgagtccaatttcctactttaa

SEQ ID NO: 28064 - DNA, 1045 bp, Homo sapiens
atatttagattgttttacagaagaaacacttaaatgtgtttgctttccgtattaatacacgattactttgttactcatattagaactatttaaaaatatttatatggatacaagtaaaccatctacctcgataagttgacagatttaaatccgtcaagctagtaaccaggaagcggacttaaagctggtaactaggaagtgaacttcacacttagaagaaacaaaagtgaaagtctgtttttactcagacactttatgggttatctaaaaggagaggtgtgtagtgtatattgcatagccaacattttagccagttttcttctcaccttaaaaaactgtgtgtacatatgtgtttttaaattttaagtatttactatttaaaatttaagtatttactatttagctatattattttcaagatttttaaaacttttattttgcagatggatgtaagtttttttgttgtttgcagcaccacactacacaaaactttcatgattttttggttcgcctatagaattcattagtctttgtcacaatgtagtatgatgaggcaagaggctgcctttcccttttgatgtgttctttgcttgattgctggagtttggccaacccagggacttatgagatgtagtaaaactgcagaaagctgcttttctgaggtttaggtatttcaggtgaggtgcagttggcagcagatgagttaaattctgtgataattttggttttggacatatatcttcagcctttgtgcttcatgtttaccaaagtgtaggagccttagatctcagaaatttgatacatagattcaagttccaaatgaggatactccacggcgcccccccccccccccccaatctatctaacccgatgaaccaagctaggattctttagggcagttattattgggaggagttttgctcccagggaccaaattaatttacagagtgaaatgaacaggatactatttaattaaatgtatccttctgagttgaataaaatatattgtttcactctagggcttagaacagttctttacacatag

SEQ ID NO: 28065 - DNA, 1029 bp, Homo sapiens
ctgcttaataagaatcgcagattattcttctgcacttaatgtttgaggatcactggttgaagttaattagtattcttaaaggtaaaagtgccttgagcactgtgtaaattgactgcaggggtcctttagggattgaattatcacaatacaccaaatttaatatggaagcagggtctttgaacggacattgtttttttttgtttcaggtgtttctctccatcagtgcagcaacatgtttccttgtagaggagctgtctcctccctcaggcttttctggccaacatctctatggaaacccaaagcttcaggtggctaggtgggatacttgcccctcttactcctggaggcacaaataagttgaatcgatggattaaggagttggaaagtgattgtacatgctaaagttgtaatcttcctgtttctttctggctgtttttttttttttttttttttttttttttttttggtatgtgcgtgtgtatttgtgtatgaataattcctataggatttttttgtgggggctaaccatagcatatgaaaacttatgtacaacttaaatatattaagattagtattctttgtacaattttagacatgaaatagaatatcttattgtcctggaaatttcctttgttcctcattcatactgtccctcttttctacaccaccccccacccccacactactgctatcttgacttttttcaagttaatgttatcgtggtatgatttacactgaaagtgtgtaatttgatgaatttggccatacagaacatttctgtcactccacaaaatttgtcctgtatcacctttctcattaattatcaacaccgtcattatttcaggcaactgttgatctgatttttattactgtagatcagttttggctgttctgggtcttcacatcgatttgtttataccaaattttttttttttctcgcatctgactgcttttgctcagcaaaaagcttttgagattcacccatgttttattgcatgtatcaatatgtttctttttactatggagtaa

SEQ ID NO: 28066 - DNA, 1050 bp, Homo sapiens
agctaaaggtagaacactccaggaccaagtgctaatatgttcacaaaacaaattgagattgcacaattttttttgtttgcttgtttaaactaacacctgataaaaaggtacattgctgaaaaatgggaactcatttcttcatcatgcctcaaagtaaatattaaatttatctctttaacaattaattgcacacatacatgagaaatctttatgatacatattttattacaccgtgtacaaaaataatttcacattttagttgggttggaagtttgaaaagaacatagtgcagttgcaggggtgggatgaactgtggtgaggtaagtaaattggacagaaattgggcagaaagatacttcctttttttttttttttaacagttttttatctgtctgaagacagggaagaagaggaatctgaattggaaaacccccactatatctgttgggtttttgttgttgctgttcagtctggaaatgggtggtgtgtggtgagaggtcattaggtcatcagggcagaattgtttgcagagctgggagctacatcctcacggaagtgggatagatgtgctggggaggggtgtgcagagaggagccaggaatgatgtaccattagtggccagggcttgttatggtaacaccaatgttgaaaccaactgtgcattcacatatacaaaagttttgtgtcttaattcatgccagaatacatgcataatcaaatgtctcagttaaggtggagctacagaaacactgggctgaatgaagttctggggttttctttgtcttcgtgtgaggcctctgggctgggtctgggtgtctgatcaagaatgccctgaagttttcccatggggctttggagaacggctttggagctgggcagagctgaggatgagcacagaagaaaggaaacgagaaatggtccactacctgaggtttaaaatcctcaatttttggagggaagaagtgacacaagattttatcggtgccacttcaccagcaagaaacctctaaggccagcagtgcctctgcccaggctttgcttacactcact

SEQ ID NO: 28067 - DNA, 1052 bp, Homo sapiens
ataccgcatgtggcttccacagctggactccagcattcagatgaggggaacgtggtggaacccagaaactcggagacggcagcaaccgtggagccccaagggggtgtcatagcttctgcctggggagtcccgaggtctgagccaccagggaatgccacagccctctcttgttcctgccgctcacagctccctgaatgggggtgtgttagagcttgtttattcctgctgcgcatggctttgtgaatgggggtgtattatggttctagttcgaggggtcctgatgtttgggcccccagaggggtcgcggctcatcactcccatattccagcaattgggagtgtgtaacagctcttttcatgcccactgcccacagctccaggagccagccaggtgcgtgttacagccgttctttgttcccaccgtttggcgagttctgggtttttgtccagtgaccaagaataatgaggtacgtggacaccagagagtgaggaaggcagagaagaatgttattgagcaacagaaaagctcttgacaatgagaggggacgtgaagtggatagccctctgtgtgagggggccccaaaagctggtagccatctttgcagttgagtccagggtttttttaggtttggaatgaggagatgtgggctggaggtagccttggaaaaggcaacattcaattggtttaaaagcattattcggaaagaaccaattgggaaagagtaggcaaaaagaaaagttttcactccagctgtggactctatctatatctagaacaggcagcttggtaggctttaaactgtctttggtttgaaggtcaggtttcaccagggacctgtccctgcctgcctaggagttggtctactgtggcgcctgcctaggaattggtctactgtggcgcctgcctaggaatttgtctactgtccctgcctgcctgggaatttgtctactgtggctatcagaaacagctctgcgcaggcctcctggggtcagtggacactctctttaccaattttggtagcatcatgcagatttgcagaactggcttctagg

SEQ ID NO: 28068 - DNA, 1043 bp, Homo sapiens
tgctgggtggcgccaggaggagagcaccagtgtacctgagcatgtcgaactgtagcagagtagctgaaagcagcatataagatgaccctggtcagctctgtggtttctatggtgtaaagtgggtaggggtttcaggcctttggggttacagagatcagagccactccctcaggtcatggggtcctgtgctaggaggtgtggtcctagggctgtgtgaacattggtggggtttgccattactttatttttgtccatcttggtgttggcttaggcaaaccttagggtctgcgtttttttgttgttgttgttatttttgagacaaaggtctcaccgtgtcacccaggctggagtgcagtggtgcaatctggctcactgcaacctctgcctcctgggttcaagtgattgtcatgcctcagcatcccacatagctgggactacaggtacacgccaccaggcctggctaatttttatgacggggttttgccatgttggccaggctggtcttgaactcctgacctcaagtgatcttcctgtctcggcctcctagggtctgcagttttgttgttgttgttgttttggggcagagcttcgttcttgttgcccaggctggagtgcagtggtgtgatctcagctcacggcagcccccacctcccaggttcaagcgattctcctgccccaacctcctgagtagctgggactacaggtgcctgccaccacacccgtctaatttttgtatttttactagagatggggttttccatgttgtccaggcgagtcttgaactcctgacctcaggtgatccacctgcctcagcctcccaaagtgctgggattacaggcgtgagccaccgcaccccgccgggtctgccgcttttgaatgaaagtaaatgctcttccaagcatttcttgcatgagcagaagagtgtgtagaattctctcggtttgctgtctaaagcaagagggctgactgaccactttagggccacggcctccatccccgccacttcccctcccttcccctcccttcccactccttcttttcct

SEQ ID NO: 28069 - DNA, 1049 bp, Homo sapiens
ggacaaagaaaggacaaaaagtagaacaaaggagatttggtgtaaagaagtattgactaggaacagatgattggctgctagagggtaaagagaactctaaagtaagaaatgaatttgggagaggcccttcagaagccccaagactctgagagattgggttcttgttggagaggttgtgaatggagcccactggatggcagagcagtttatagaagtgctgtagcttgggacattcctgccagtagctcttttgaagtggtgtagagtatgtgctttatcgtatctagatgaatggagtttccaagagaccataggacatattatataagtaattagcatgaccaaaaactgtatttgctttaaagaattgtgacaaatataactgctaggaattatatagtattccagtttcagagttctacttagagcacgtttattttgttttattagtataagggagtttatttttggattataagctaattaggcaaacaagtacagaaactagagatgcataaagatttaattggacaagagagctataataggaatctgattattagcatcaacaagttaaatacatattttatttaaactgcagacatagtgatttaaggatatgatttgattcataaaagttttgtttacctacttgttttccagaatataggcactctaatttaaaaacagactgtgttccaaaagattttgcaagttgggtttttggaactgaaaatacatgttcccatagaaaccatgtttcctggtggtgtgttcttatttagaaatgtaactctgtgtgaacttagcttatagtgctgagtaacagtattttttgggagaaatacatttagagtttctactcatgatgtatttattttatctactaattaatagggatggggaatactcttttacattgtaattaaaaaaattttttttaagacagagatttgctcttgttgcgcaggttggagtacaatggtgcaatctcagctcactgcaacctccgccttctgggttcaagctattctcctgcctcagcctcc

SEQ ID NO: 28070 - DNA, 1047 bp, Homo sapiens
ttgttttcgtaacctcaacattgatatacagcaagagtataataaattcatattttcttgccttgtcttgggccagtgatccctttttttgcatcctcaaaaagttatactgatgttaaatatgccctctttactgaaacagattttaaaaatacccagcattaagtggggtcacctgagaagggaaagaatttctatgaaactctcaggtttttaatttatattgaaattaccaatatttccttatatctgaagtgcatagtactgtattttgcacatagtagacacttaaggatgttattgtgcagtaaaaataacaggaaggaatctgaagacttgtaggtaatcttgacttctttgcttattaatttttgtggtgtttgcaagtaactgaatctctttggacgttgcatcttgcccctttggtttagcagtgggaagaggttgaacccacctccctgtacttaactagagaaaaaaaatccatacaaggagcatctcagagcccagaagaggagctctagatatggaagtggattggatgggaaccaccttggatttggaattgctggtcagggagaggaccatatttaggacatttccagttgaggatcagggcgtatcacaggtcagaagtttcataaatgggaaggtacaaaccttgaaaaacagactagggtcttaatcacaacagaaatggcaacaaaacccccacataattgcaggaaatgaaggttcagggtttcaaatacaggaaaaacacaactggaagatgccagtaacaaagggaaaaaaactttgcaaatgaggtggcttctctaacttaaacttaggatttttctcattgctcacctcttcccatttctctctacctaggtttagctaagaaaattctttcactttttttgttttcttttccacctggccttctccccgatcaccagttcttttcattgtttcattttcagtcaagatttatgaaaacatgaaccatactagagatacacctgatttttttctaggatatttgtctgaatttatagtaaa

SEQ ID NO: 28071 - DNA, 1041 bp, Homo sapiens
atgcaactgtgttgtgctttgtgaggcttttgtaagtggaagtttgtaggtggggcttgttaaagaagtctcattcatttgggagacaccttttgtcctttgcccttctctttatcctacctagaacttggacaggatgatggaggaggagaccatgcagtgacaaacattctgatgcatgttccactttaaagacttgatgttgggtgtccctactaggtctggactgcccattgtgtcttctaagttagaaaagaaagacactccagagtattgaagctgctgtttagttgggaatctgttacatgtagctgaatatagtttctatctaatacatatgatttctgtaaaagatacttgggctgcaatatctcttaaacctttcatgtaatttgtttaggactttttagacttctgaaaatacatattttatacataaattgtcaagcatgttttgaaatgcacattttacaatttgatgtcaacaaagctgaatgcagaacattttaaaactttttattttgaaatttcaaatttaaagttgcaagacttagtacacagaacttccataactttttttctccccaaaccatttgatagtaagttgcaggcatcatgcccctttagcacttaaattcttcaggatatatttcctaataaaaaagatactctcttactatactggagttatcaaattcaagaatttaatattaatgaaatgtcattactaagctgtgcatatttatatttctccggttgtctcaatatcctgcataacatttggtatgggatgcagtcagttccccctttggctcacatgcttctttagtctcctttagggtggagacttcacctgcttttcatggcatagacatttttgaagatgatagaataattatttttcacagtgtccttcagtttgggtttgtgtgatgcttcctcaagattagatttcggttgtgcattttcggcagggctatctcacagattatagagtgtcaggaggcacgcactgccattttatcctattattggtaatac

SEQ ID NO: 28072 - DNA, 1039 bp, Homo sapiens
gtagagaaatgaagtttctgatgtcatctcaaccgattgtcatattgagtaaattgcttgctgttgtggtttctttatccataaaacacataatacgtaatatgtatcaagtgctttccctctaatcagggtgccaattgagatagtgtgtccataaagttggttagaggttattgacagcaaacagttgtaggaatttaatgtggcaattgtactatgatagtatcaaaccagaaaaaaattaactgttggcgtaacagtaatacttttccattaaacattcctgccagtagtgtcataatgcagtgttactggtttaaaactgagaaagtggggagatgtcatgcatttcagcaggtattaaaaaaatactctttaagtgactgtgcagttactgttgagaagaaatgaagtcgtgtatttttaattcttggaagatgtggtaaaacatgagggaaggaaagacaaaataattacaaatggatatacattcaaatgcaggcctctatttaaaaaaatctacctaactgctgtaggaatgtagaagaatagatcagagtgtgagttttcaagggattgttgtagatataaaaaccctttttgagcactttctccattttgtgtgaaatacattgttatttaaaggttgaccacagtttcacttaattctttcaaatatggcagggatttttattttcagtttttttccattcttctttttgaggtataaaatctcttaaaaccagggctaaagcagaaacaaagtcatgctaactttaagtgatacacttggttgcagtgctgacaaaacgtctgtcttctgaaatcgaaatctctaataccaaatacatatacctctttgttgatattagctggaatatcactgtttacaatggactgtttcttttagaaggaataaattttttttttgctgactagaaaaatttagtttttaaactaatatcacatggaagttatatttggggcatatggagaaatttttgtttatgcatacctggtgtgtcagaggctaaactat

SEQ ID NO: 28073 - DNA, 1767 bp, Homo sapiens
ctcaggagtttgagattgcagtgagctgtgatcatgccactgccctctagcctgggtgacacagtgagacactgtctctaaaaaataaaatttaaaataagcaaataactaaaatgaaggcaaaacgtgtccaaaatacaaataagcataatcccaaccatgcaaagataataacagatagtttctctttctgatcatattattttgtaacctgttaccacttccctacttagcaatataccatggtttctatcactgttgaaatgataatgggagtatttatcattggcatcatctgggttagggaaattgaccaatatatattgggaaattggattaaaagtcatttttattgaaggcggtattagttgtaaccttttttggaaaaagaattaatacttaatagcatcaaggctattttttattagaagagggcttgtttcattcacttgtatatttcatttttgtgaaatgagaatcttgttttaaattaaaaggactgcatatttattaagcaattcagattgtatagaagtatttaaatagaaagtgaaagattcttatacttcttcctcctataactcctttcctcagagttaaccactgttaatagtttggcacattctttcagaatttaaaaaatgtatgtgtaaatgtacatctctggttagtttctgaaacatcagtttttaagagttcactgttaattattgtaatttgataatgtctagatggtagtagtatggacagaatttaatacgtatgtaatcgggttaacttcagaaagcagaaatgtcaatgtttaattgtattgatttcaatttttgttgataaaccattctcagcagtctttctgcttattagcttttaataagagacctcatagtaaatacagagattcttctacagtgaaatatatttctgcttactgctttaggtatattttatcaaaaaaatcattgagttactgagtatgaccagttaaaaatatgtttgcatttatttttagataggcttttagaaatacaaaattagttggtactgactggtttaaagagtatattggatataaaatctccataataaaaatcctttcattttgttttacttttaattttgagaaagatagttttgcttttcagatgtgattgatctcactggagatgataaagatgatcttcagagagcaattgccttgagtttggccgaatcaaacagggcattcagggagactggaataactgatgaggaacaagccattagcaggtaaaaacataatttgtataaagcagatataagtacttttaaaaatagaaatcattaattgggttaaattaattttaagaggtaataagatatactttgttactctaaactagtaatatgcttgtgtatttttaaattttatgtaaccaaaatcttcatatttagttttgattgcaattgggtttagatttttaagattttgggatggtgttatgagggattacatttaggtgcatattttaatatttctttcattttttttcttcccctaatcttttttggatgcactgtccaatttgcaacaatttatagcaagggtcagcatcctttttctgtaaagggctaatagtaaatatttttggctttgttggctatagggtttctgttatagctattcagctctggtgtcataacgcaaaagcagctatagctgataaataatataatgagcttggctgtatcctaataaatcttgatttacaaaggcagccagttggtttt

SEQ ID NO: 28074 - DNA, 1028 bp, Homo sapiens
aatcttttaaaattgatctttgaggaggatttcggtgctcaataattccagatacttgtggatgctaaggagcatggaagggccatcgaataaccatcaaaccatttaaggtgtgttatgtcagattatagatgatctggaaaagtaagaaatatgacacagattagtttcctgggctacaaggttgtggctgcaggtgactgatgaacagcagcagtgtaacttgaaaaagtatcagcaacagtgaggtaccactgatatccccaggaagagggatcaactggtcgatgtagtcaggctgtccgtgtggcaggagccacaccccatgcaatgtgggctctcctacggccagatacacaggtcaacttttggtaggaatcacatgtctgacaagtagtggtagcttctgtgttagaaacgtagagttccttaatttgtactctgtatacgattgtggatgtgattccattttgggtattgtgattgtggcagtggtggtgatctgggttgtgcaagtttgatcaaaagctttattctgttcatctcattgaagaacacattagagcactcatccatcacaatggctaaaattaaaaagactgatgggaagtgatgtcagcaagatcgccaactagagttgcttggctatcatttccctcacaaaaaaggaaccaaaacaacgaataagtttattttgtctggagtgactgaggaaatgccctggagagtaccaagagaacagcaaagtccctgtggagcatagagtcaagaatagctccacagggaggagaccaaagtatcctgcctctgccatactgtctcccctgcgaggattgaatcaaagccagggggttcctcttcttataggaagaaggtaagcggagaatcatcagtcctcatcaccaccacaggtgccagcagtcactgctacaagagagttccccagtcctcacaggtcccaagtccagcatgaacagttgctgaaagtgcatgtggctacattcccccacagcaggaacctctttgac

SEQ ID NO: 28075 - DNA, 1097 bp, Homo sapiens
tcagcagagactgcacaagacaggagagagtgggatgacatattcacagtgctgggaaaaaataaaaataaaatataaaaataaaaactgtcagcagagaatatatccggcagtgctatccttaagaaatgaaaaagaagggccgggcgcagtggctgatgcctgtaatctcagcactttgggaggccaaagcaggcagatcacgaggtcaggagatcgagaccatcttggttaacatggtgaaaccccgtctgtactaaaaaaaaaaaaaaaaaatacaaaaaattagccaggcatggtggtgggtgccggtagtctcagctacttgggaggctgaggcaggagaatggcgtgaacccaggaggcggagcttgcagtgagccgagatcgcgccactgcactccagcctgggcgacagagcgagactccgtctcaaaaaaaataaagaaaagaaaaagaaatagagacgtttccagacaagcaaaggtgatggaattcatcaccactggactggtcctacaaaaacacttagaggaaataataggaaatgaaagaatgattaataccatgaaaatatgtgaaaatacaaaactcatcaatataggtaaatccataatcatattcagaataccccagtgctgtaatggtgctgtgtaattccttccgtcctctaatatgaaggtttaaagttaaaaatgtcagaaatatcaacagctacaattagtggctaaggaacacatgaaagataaagatgtggctgggcgtggtggctcacgcctgtaatgccagcactttcggaggctgaggctggcggatcatctgaggtcaggagtttgagaccagcctgatgaacgtggagaaaccccgtctccactaaaaatacaaaattagctgagcatggtggtgcatgcctgtaatccaagctactcgggtggctgagacaggagaattgcttgaacccgggaggtggaggttgtggtgagccgagatcacgccattggactccagcttgggcaacaagagcgaaactctgtttcaaaaaaaaaaagataaagatgtaaattacagcaatcaaaacactaatcatggtggggtag

SEQ ID NO: 28076 - DNA, 1050 bp, Homo sapiens
ttcaactgtgcatggaatattctccagtaaagatcgtatgttagagatggtatcaagtattttaccagatcacaactatataaagctagaaatcaacaacaagaaaaacgttagaaaccaacaaatacatggaagttaatatgcaccttaataaccaatgggtcagtgaagaaattaaaagggtaattagaaagttccctgggacaaaggagcgtggaaacacatacaaaaacctgtgggacacagtgaaacctgttctagaagttcatggcaataaatgcctgcatcagaaatgaggaaagatttctaataaacagattaactgtgcaactcagagaaacctgaaaagcaagaacaaattaaacccaaaattggtaggatggaaataataaagcttagagcagaagtaaacaaatagagactaaaagagcaattcaaaagatcagtgaaatttttttgagaagataaacagaatcaacaaacctttagctagactaagaaaaaaggaaaaaaaaaaagactcgaataaataaaaccagacatgaaaaatgaaacattacaaatgtatcacagaattggaggatcacaagagactattatgaacaactgtataccaacaaattctagaatataggaaaaatggataaattcttgaacacacacaacctaccaagattaaattgagaagaaatggaaaaaataagcagaccacaacgagtgggagaattgaataactgctaaagcctgacataaagatccctagtttctgatggctacattgctgaagtgtgtcaaacatttaaggaacaactaatattaattctcaaactattccagaaaattaaagaggagggaatacttccaaactcattttatgaggccagcattaccctgattcaaaaactagacaaggacacaacaaaaagaaacaggccaatatccctgatcaacctagatgcagaaattctcaacaagattctagcacgtccgattcaacggcatattaaaaacatcatccactatgatcgagattcatcccagagatggagg

SEQ ID NO: 28077 - DNA, 1398 bp, Homo sapiens
gtcatagagtgagcttgttatttttgatggattttgtcctttaggcatctccagaactgactgctgcgtagttgaggaactaagaaaatttttgcacaaagtttgagccctagtaaaacatcttagactgtgagttggaattctaaatggttagaatgtagcattaactgagaactgaaagttaagacaggcttcctagtttctgaattatatagttttaagttatctcagaatttattggattaaggcgacctgagactgtgactctagtctccctgcctgccagagcaaatgtaaattctctcttagaagatagtattatctggaacctttcctcaatttttcatacacaatgtctagtactcaggtcagtcataccagaaaataagatgtgtgtgaaaactaacacaaaaaaatggacaatagaaaacagcacagggaaactggaatacttgtctgccataataataattaatatgttcaaggaattaaaagcaagattgcgagtctgaagaaaactaaaaactgtaaagaacaaaatgtaaatttcagaatggaaaaatataaatgaaactaagaagtcagtggataaatttagcagcattattagacacaactgaagagataattagccaactggtaaattaatctggagaatatttttcagactaaagctatgacataaagatgggagcatcaaagagatactttggatatggtgagtagtactaacagtgtatttgtagttccagagggagagtaaaaggaaatagggcaaaagcatgtttgaagagattactcacaatattccaaacttgagaaagatcaagccatagattcaggaagcaataggaatcaaatagtataaacataaagaatactgcaccaaagtacatcataataaaacaaataactatagacaaagagaaatcctaaaagttgcaaggtggaaaaagatacacgtataaaggagcaaaaacaagactaatagctgactttgatacctttaaacatcaagtcacacataagcagaaataatgtctttaaagtgctagaaataaataactggccatcttgaattttatacctagcagaagtctttaaaaatgaagaaaaactagctgaaataattcttcaccagcacacccacaccaaaggaagttctaagtatccaggaacaaggaaaattctctatctacaatgggagctcagagaatagaagtgggattgaaattcttctaacctgccaagattctctttcctctttaaattcctcaaaagaatagtccatggtttgtctcccctacttaacagtagtcccccttatctttggtttcactttctgctgtttcagttacctgctgttaattgtggctgaaaatattacagtactgagag

SEQ ID NO: 28078 - DNA, 1031 bp, Homo sapiens
ctacttaaagtgaatgtcatcagaaggaaatgggtttagttgagtaccatactgtattcctggagcaaatacctgaaggaattttgaattttacaaataaaaggggcattctgagatttctgccattagtcatgaagaagtaacaggagctggatttataagtctcagtgcatcttagaggattcaaagcatacaaaataccttttctgatgaaaatggtagaaatcaaggtagaaatcaacaacagaaagatatacagaaaatccccagatagttggaaatgaagtaattcacctctaaatatcccaagggacaaaaaaacaaatcaaatgagtaatgtcagaatattgtaagctgaatgaaaattaaaacatgacatatcaaaatttgaggatgaagctaaaacagtgattagtggaagatatcttataagagacatcttaccagacatcttattagaaaagaagaatggttttcaattaatgatagcagcttgcatatcaagacattagagaataaagggcacgttaatctcaaagcagaagtaaggaaataataaaggtaatagcagaaatctgtgaaccaaatatcagaaaaacaatacagaaaattatggaaccaaaaactgcttcttgagaagattggtgaaattgatgaacttctaggtagactaagcaagaaagaagagggaagacatatattacaaatataaggagtgaaaaagggaaacatcactacatactctgtagacactaaagggagaatagtggaatattataaacagcagacaagtatcttgaaagtcacaagctatcaaagctcactagtgaagaaatagataacctgtggtagccctacattatattaaaggaactggaacctgtccaccaaaaaattcagcagctaaatagttttacttgtaaattatattaagcatttaaagaacaaatgataacaattccctataaatttgtacagatacttaaaaagtaaaacttcccaactcattttgtgagctaagcattaccctg

SEQ ID NO: 28079 - DNA, 1025 bp, Homo sapiens
gtagtaaaaagttggggaaaagatatagaaattcttgtctttgagaatcttatagtcttattgagaaacaaaagtaagatttcagaggaatattaggagggtgatatattagtctcctattaggatctggtctaattattaaattaataaaattaaataaatttaaatattgtgattgaattatattaaatataatgttcgataactttagatataaaataaatgagtataaaataattttataagtaatttttattaaatataaaaacaaatattaaatttctaataatcgggtgaggttctaatattagtctaataattaagattgtcacaccacagtgacagtcggtgattcattgctcagtgaaaggcatttatttcagtagatgtggaatttgaaggtatcgttgacttgaaggagtctggaaaggcttcatggaggagtggagatttttgctaaatgggtttattgagatcaagcacttagaacagtgcctggcatgtagtgaacactcattgaatgttggctgttattattgctctgagcagcagcagctgggccttgctgaatgggaagtattatgagaagcagtcttgaatgaggaagatattcttggctgagtaatgacatgatttgctgtgaatatgtggcattcatgctgaaattgtgagcctatcctaggtcttctgcctttttgtgctggacttctttgagtctcttagatggcaccaacactctactttcttcaattatgatagagtgctaattcatccctaaactatattggctagtttaatttttggttactgttaaaatgaatatttattagtaaaaattttcttaatcttcagttaaggtgtttttgtttttgtttttttccttcaataggaacatcggaatttgccttttatgcgtgagctgaggtatctatttgcacttcttgttggtaccaaaaggaagtatgttgatccatcaagagcagttgaaattcttaaggatgctttcaaatcaaatgactcacagc

SEQ ID NO: 28080 - DNA, 1465 bp, Homo sapiens
ctttatatagtgtattgtggtagatttttatccattaccttaaaagaatattggtaattttcttataaaaaatacaaaatatctataaacaaaccagtattttcacatataattggaaaaatcagagaaattaaagaaggaaaacagaggaaaaaatacagtggcaaagaatagtaagtgttcaaaaagatagcggcaatgtgtaatggcagaagtttcaaaaagccactaagcttgcagcgttgttttttaaagtacatacttggatgtgtctctgttttgtgatgtatggagagggcgtttggaagaggaaggtctgagattctctcaccatcttccttgtgctttttgtttctgctttacatttaccttgtatggcaaatgtgaatgaacaaaaagggcactcacatcagagtttcttttatatgttgttgcatttttaaaaaaaattctaacaatgctccagtgccttttaggcttagtatctactcagctttgtttcttactcgctctgtcatggtaacactaacacaaatcaaaagaaagagaaataattttacagttgattccaaaccatcattttcgggcattcagcattccttctggttctaaatgtgttttacttttttttttcttctttagtatgcatagtatcttttccagtgattctgagtatacaattaaattttttaaaagattacttctgttctctgacttatctttccttctggatggctttttccttgtcttttttctggtttcttttttttttttctttcttttctagagattcatgttgattttggggtatcttttcacatttaaagatgaggcagcatagactttgtctggagccatgtatgtacataggtgggcttttcagtttgagttagagttgaaatggatacaactggcggttaaggccacaatataaatgcttttgcttcagattagcagtgtagactaacttttgaaattagtgattctttttctttagaggccttttaaagtagatgtgcatcaattaaggttgataagtttgattctcttctgttccctaaacacttgaatttgaagtctacaggagtaatttagtgaatctgtaaatgtaagcatcatgatttttttaaaagtgaatttatattttcattgtatcttcttcctaaatatttcaaatacatcatcttttgaagtacacaggagtcttttgagacaccctttggtatgtgatactgttagttttttctttttcttttccgtgtttgtttttttttgagacacagttttgttttgtcacctaggctagagtacagtggtatgacaatggctcactgcagcatcagcctcctgggctcaacccttccccagacctcagtctcccaagtagctgagaccacaggcacatgccaccgcgcctggcaaataattttattttatttttatagagacaggatctccctatgtt

SEQ ID NO: 28081 - DNA, 1662 bp, Homo sapiens
attttttttcagtagcattaaagactgctatactacctactggggttcttgtaagaattaagagaagtacttatcaacattattctaaggattaaatgatgacccatttatcaagagagatggtatcccctctctccctttttaaacaatacttcacaaatcaattaatataaacacaaattaatacagaaaaatctgtacacaattgtggatacaacgcatttctatacagtaaggcaaggataaactttgtctttttaggtcacacaaaccataaaaagacaatttaaaattttcaacttttgtttgctccaagcagaaaagaaaaaaatgaattttggtattaaatgacttggaaaatttgtagatgactaattctaccagcagtgtgaaacttcacaaaagaatgaagtagctgttcagctactttgggtgaaaaactggtacctcgttccctccctggtgagggttgttgtttttggatttttttggactcttccatgtaaatacaggaaataacctatcaaaattttgtagaaatgtattctgattaaaagtggcttttcttccttcccatgtccaaataaacgtgcactacacagagtatgagattgaaatgtgtaatgatgataggaagagcaggcactttgtgcacaaactgtgtcaatttctcttccaagttcatacacgtagtagctcattttaactcctatgagagtcctgtgggtgcagctatcatagttatccgcagttgacaggtaaagaaatggaagaataagtaccttgtgcaacgtggcactgtaaataacagagctaaatgcaagtgcgtgatagccacataagtgtttttgtcttgtcatatgttatagttctttaatattttctctatttataggtccgaaaattgtaatcacatttatattttttaacatactttagggatgaagagaagccaaagaaccccatggtagagttgttctatggcagattcctggctgtgggagtacttgaaggtagagttatacatttactttttattgcaagtgaagagagattattattcattcattcgtctcgatagttactatttttttagtggactttatttttaatttgatatattctgtctagtaatttttgttggattgctactgttattcacataaagcacagaattgaatgaaggaaaaggaatgtacagagtgcattatcacatactaattaatactttattttatcctcatgttttttccagtgagagggcttccatgatacaattatgttggaatacagggattaatgggatggttgatagatcctttgaagataatattggagttaaatactgggcttgatatgatgctcactttctttttcatgttgaaagctgaatttagcaacttagcatagtcagggtattatagagttctcactttttcagtgattttaaatgtagatattagttttcaggaaaagattgtactctatcttttgaaaaatcagtgaagagtgatactactccatttaagctaaatacctgtttcttaaaatttggcctaagtagtttctgtttgggttccctaacaagggaggagactctttaaatgtaacttcatgtaataatattaggtcccaaagcataaacttttgaaaaattgtttt

SEQ ID NO: 28082 - DNA, 1016 bp, Homo sapiens
aggaggctgaggcaggagaatgacgtgaacccaggaggcggagcttgcagtgagctgagatcgggccactgcactccagcctgggagacagagcgagactccgtctcaaaaaaaaaaaaaaaattaatttgtcaatccagtgttgaagtctttgtacttggtattagtaagttgctttagtgattgtgttatataaaggtggccttaatacgttttcacttgaactatgtgtttgcttcagtaaaagtaatttatttcagagtactttcttatcactttttacatagatcttcctaatactttctttcaaaccaatggttcttcattagggatgatttttagtttgtttgccaaagtacccccactgcaaaagtccctcaactttttgagaacttctagttcattgtcccctctcagcccttctctgtacttcactccttcctttttcatctaaaacctaaaactctctttccccccttcccttctggcaccccctccctgttctctaaccttcattaagctgttcatcttttctgtgtctgtactgagtacctgaagattgctggcaaaaagtcacagaaatgggctaactgtagtggatcatgaatttgagtgatactgagcttccgtgctcccaatcctataacccaacttgttctgtgtaatcaccattctttctctcatttactgcaataaatattttcgttttttccactcatttcagatctaacttatctcttcattctctgagaaaatctttacctcagatttcatagatttactgtcacattaatgaaacttaatcacaggttttgcccagtccccgaatctaattttacatttgtagttttgtatcatattctaaaaacacaacattcccaaatatatgagcctcaggctccataacctagatctatcactacctctactatatttttacctgctcctacatataataaaggaattacccagttttatatcaaaagactgttctttatacgtgctcagaattccct

SEQ ID NO: 28083 - DNA, 1020 bp, Homo sapiens
ccagaatgttagatccactgatagcttgcattgtgtacctggaaaagctgcagacactcaacaccaacccgtgaaagcagccaggagggaggctgtaccttgcaaagccacaggggcggagctgcccaggaccatgggaacctacctcttgcatcagtgtgacctggatgtgagagctggcatccaaggagagcatttcagagccttaaaatttgactgccctgttggatttcagactgtaacccctttgttttggcctgtttctcccatgtggaatggctgtatttacccagtacctgtactccaattgtaactcttctcaggaaaaaaatcagtcagtgttacagtttttaggttcaggtgagaatccttacataatcttaattttagtagccaaaaggccatgttgaggatcattaattttctcccttcttatagggagtaactagcttgcttttgatattacaggcttgtaggcggaagggacttaaccttgtcttagatgtggtttggactgtggacttttgggttaatgctaaaatgagctaagactttgggggattgttgggaagacatgattggttttgaaatgtgaggacatgagatttggaggggctagggctggaatgatgtggttcagctgtgtcctgatgtaaatctcaacttgaattatatctcccagagttcccacatgttgtgggagggacccaggcggaggtaactgaatcatggtggggcagtctttcctgtgctattctcatgatattgaatacatctcatgagatctaatgagtttatcatgggtttccacttttgcttcttcctcatcttctcttgcctctgccatgtaagaagtgccttttgcctcccgccacgattctgagggcttcccagccatgtggaactgtagttccaattaatcctctttttcttcccagtttgggatgtgtctttatcagcagcgtgataatggactaatacactttccatattgaattcttaccagttgttaatgctgat

SEQ ID NO: 28084 - DNA, 1045 bp, Homo sapiens
aggctgaggcaggtggatcacttgaggtcaggagttcgagaccagcctggccaacatggtgaaaccccacctctactgaaaatacaaaaattagtcgggtgtggtggtgggcgcctgtaatcccagctactagagacgctgaggcaagagaattgctggaactcaggaggcggagtttgcagtgagccgagatcacaccactgagctccagactgggtgacagagcgagactctgtctcaataaaaaataaaatgtcatcatcatcatcatctagttgttcaaaaaaaaaaaaatagtaatcattatcatcatctagttgttcatgccagaattctgttattcttgatattttccttcttacctatctcttatcctgctcagtcaagtcctgttggtgcccttccttgcatatatgtataaatgtatatgtatgtaattttatctcttttctgtatttttacttttaacaaccttcatccatgctacctttatttctggatagattctgcaatagtcttttaacagatgaccacccacttcacacagggactttaaaggtgtttcagagacataaacctgagcctgttattcttagatttaaccattcagtgactgtattagtccatttacatgctgctgataaagacatacccgagaccgggcaatttgcaaaagaaagaggtttaatggactcacagttttacatggctggggaggcctaacaatcatgggctggggaggcctaacatggcagaaggtgaagggcatgtctcacttggtggcagacaagagaagagaacaagagccaagccaaaggggaaaccccttataaaaccatcacatctcatgaggcatattcactaccacgagaacggtatgggggaaaccgcccccatgattgaattatctcctgctgaatccctcccacaatacaggagaattatgggagctacaatttaagatgagatttgagtggggacacagccaaaccgtatcagtgactttgcattatacccagaatgtggtggggaaaaaaattcttaa

SEQ ID NO: 28085 - DNA, 1525 bp, Homo sapiens
ccaactaatatataggaagacctccagtcttccaagctaaaacatccaattggctataagagtttaaattttgtggatgatatactaagagacaactgaataagttaaacatgattatatccaaaataactgcttaaatattttttaaatgatacattttaacttttaaatggtatgcaatttgtagatgagtcagactctccaggaaacatggagatattttttgattgtctgttggaggaaaaaaatttcagatagtaaatacttcacttgtagtgtgagtattcactactaccagtgtgtgctgtgtgttcttttagactattgctatgcacatataagtatttgcatctgtccacactgccccgaaagttgcatttttcactcagcagtatatcatgagcatgcttctaagttagtgtagagctttacgtcagtgtttttaaaatctacatagtgtcacatagtctgtatttataaaattaaattgatttaattatcctgtaaggcagtaactcgaaaaagaactattctgaagaatgtctttgtataaatacccttgcgcacttaggaatgaagtatagttagaagtagaatctttgggtcacagggcatactcatttagatgtgttggcactgccaaatttcccttcacaaagttgtaccaagttataataaagtgctagaaggagtttttacaaagctttaaaaacaaaattagagaaacaatatcgacatgtaccatattagacatctgtagaggttatatggggaacttaacttttgaaatcaaagggcaaatgagtcaaggcaattaaatgactggagctaattttttaactggaataaaaagtttttgcttcttgtgcatagtttacatcctggcttggtttgatattccgtggggaatttgaagtgataggtgtgttttttctgttgtttttttctctccacatttgtgtaatcctctcataaaagcaaggtatcttatacactttaatagaaaaccagctattaaaactcataaaaatgacatactctttaggaactacttttgttaacaggtgagatttctagaattgtgatgaatttagaagcacttgtgctgccaatactgattatgtaagttctttattcactaactgcagaaatctattcctcctgtagtttcattatctagtaaaataataatatgtttagagatatggagaatgacctctgtctcacaagcatggcatactagttagattgtagacaagtagatatagttttttgttgaatggaaatatttttttgaaagaaaaatttctcatgtttcgtattatttaaaattcaaattatgtactgctatactacaatccaaatattgcagagctagacataccattaatattttaaaacatgaatttacagaatgtctggttatctcatcttgtccccatcagctttagaatgagaaagtgaaatccttccactcttgtagtaggaaaaacctgccatcgctgatagaggaaaatgcattcat

SEQ ID NO: 28086 - DNA, 1030 bp, Homo sapiens
ttttgaacatccttttgtaaggtatggaagctatttatatttcctggacttttcatggtctacagaaaagtgtaccccagtttgggtcatttcatttcttgtggccattgtagatttccatgaattaaaatatgtaactatttaattttaatggtgacatttaaagtattgcaataaaatatgaaagtgatagttcttgaaatctactttcttgtttgagtatcataaaatggagcagagaatattatcctaaagaatcaaaagtgttctttctgatgtgtctggggtaatgttttaattcttaataataattttatatgtggattagaactaactcaaaaattcttgccagttccatgtgagatcaaaatgagtaagcaaactttgctaatcaaattttaaaacttgagatgtttcttatatttttcataattttatttaatccgtttcaggtattatccatataaaacaaattccttaaactttagctttcagtaaaagataaccatccagctcaggaaatctcagttcaagtaattatagcattttgaaagagaaatagtattgaataccatttgcttttatttgctgtagagaaaagtagcaactttccagatcctcctcagattcagtttgccagatgtgtgccattcatgctttttttggatgttcaaatttaaatttggtatattcttaacttattgacagatgtgtggtggcattttgtgacacttgaaattatcacacacaatagattatgcagcagtttcgcatattgcagtttataataagcacttcagaactattttatacttctgttctttgttgatttacatacaatctttctttctctttaaatacatatgcttatgtataatttgaggttgtatatgaaaataattttcttttaaaaatgttgaatttcatgcttaattgaacagttaccaaagcatgtatggggattaggggctgggggtaggggaaggaaattacggctatactcattatcagaatttggctcatagcaatg

SEQ ID NO: 28087 - DNA, 1034 bp, Homo sapiens
atctatctttctgtctttctttctgtctctctgtcttcctgtctttctgtcttcctgttttcctgtctttctttcttttgtttttttctgtctgtctttctgtctatctttctgtctttccttcttttttgttttgagacagagtcttgctctgtcgcccaggctggagtgcagtggtgcgatcttggctcactgcaaacaccatctcctgggttcaaatgattctcctgtctcagcttcccgagtagctgggattacagacacccaccatcgtggctggctaatttttgtattttagtagagacgagatttcaccatgttggccaggctggtcttgaactcctgacctcaggtgatcctcccgccttggcgtcccagagtggtaggccgggtacgctggcatctggccatattgcatctactttcatgatattcggaaatgctaatgattacctttttctgatagatacatgcacagaaacagagaaataacaagaattaagagggaagagatcaagagactgaaagattacctcacggtattacaacaaaggctagaaaggtattttaacttttatgaaattaggagataattatcagaaaccatgtatttggtgactagatttttaatttcaaatttgctttgagtgatttataattttaggagtagttaatattgtgtgaatagttttgagttttgcttgaaactaaaaatctatagtagactttaaaaaattattctagtgtttaaaattaaatatctcattgtcaacaggtaatgttcctactgctgaaaatagatacaaagttaaatgaatatagttttgaccttcctttttgcatgaaactaaagattactcttgagattttcattaaaatgaatggtatctgagtttttctccttaaaacaggatacaaactcagctgcctaccaagtcttctcagcagcttcgtaaaggaggaaattgtgtcaggtgtaagatggtatgtgccgggagcctagagagcaatctgtgtgtacagggaatgaatgc

SEQ ID NO: 28088 - DNA, 1052 bp, Homo sapiens
agatatgctcattattaaaaagttttagctatcttaaagtgtgaggaaatcagtagaaatcatttcaaattccatcactcagattatcacagttaacaatttagtttacctttttgccagacaccactgtatatatttatatgtttttcaagataaatgagataattctgttgactttccctctacctactctgcctgtgttgggtgggcttgaattttcttggcaagtagcagagaaagctgtgaaatcagcaagaaacccaaaccaattcactaaagctatcaagagtatcaattcaataaagctatcaagagtatcaattcaataaagctatcaagagtagtaattttaaatttggccaaaataatactaccggtatattcatatatactttgtgcaatagtaaaatactaccattaataactatttgatgtttttcggaattcttaagattaagagaaaattgaccaaaactatttagtatatcacaggtaaaaagtaagtgtatagacctgtaaaccaaagatataaatgcataaacatataaatatttaaaaacattattctgaaatgaactattagctgatgaaatcaataagtcaaagtaaacactgtataggaattaagaaaatagtttctagtaaaattgaaaatatattgtctttttattttcttaaaagattactcttcactgagttgcaaatatgttttagggcaacatgttttctggtatagaaaatgctatttctcagagaagctataaattaagcgcatatattttcctcaaactcatttgtctctttttataactgctagtggatattattgaataactttttttttttgcaagatctgcatgttttgtgttttaaggaagtagttccagcttttgtttgtttaatttcatctttcgcagacagaggtttccttgcagcattacctggttgggcttcagcattatcatttgaactttagaaggaattattacttcaatagaagattgttttacagtgctacaatgtagtattgtgactgtcgcaggcatgcacaa

SEQ ID NO: 28089 - DNA, 1093 bp, Homo sapiens
ggctctaggctgtatttataaaacagaaattatgctggagagaagagcgttgtccgagttactattttacttatattactcttgtcttatccaagaagtatctgaagtccttacaatatagcacacccagatttctttaaaaaataaggaaacactagtgaagattggaatgaagtgtattgcgtaaggttttataaatttctctagaggaagcaggcagagttggctctggaacttctctacactgtctacaagttaaaaataagctgatgttccaggagagtacggttggatcctgagagtaagacctggtagaataaacagtatcgtcagtgttctcagattccttgaaagcaggaactaggtgatattcttttttttttttctgagacagtttcactttgttgcccaggctgaagtgcagtggcatgatcttagctcactgcctgccgggttcaagcaattcttgtgcctcagcctcctgagtagctgagactacaggcatataccaccacactgggctgatttttttgtattttagtagagacaaggcttcaccatgttgatcagtcttgaactcaaattcctgagctcaggcagtcctcccacctcagcctcccaaagtgctaggattacaggcatgaagccaccatgccaggcctggtggtgttcttatttatatctccagcatctagtataataaacgacatatgatagatgttccttgaaagttttctgttaataagttcattccctatggagatttccaataatgaatttcttaggggtgatcctcagtgtaggagaacataaaattttaaagtagaaacaaaatagtcacacaataaggaggcaggccaaatacatggggtgaggatgtagctctttgtcccggataaatttatggtttgactctggtttctaaacctctctcccccacacccctcagactttcttcggaatggggcccaggaatctgaagtttcaaaaattccaccagcgattctatgcaaccacctaagcgtggctctttgtaggctcttacagggtattgtggacttttaaatacatttctagaaatggatgcactgtg

SEQ ID NO: 28090 - DNA, 1037 bp, Homo sapiens
acatagaaatgaataaaagatttatcttagtatagactctgtggtttatattagatatataattgattcttttctcatgaagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggtaagaacttttcttttggctctctgaacatagccatggtcacgacatttcctccagtatagtggagagggacctgtcagggagtcaggagagacggggcccagtgatggctctgccatgggcatgatcagtgaccatgggcaagtcatctcatgcccaggctgtgatttcctcagctgtgattttaaagacacttttctcttaagtttctgtctttctgctagagaattctaatgaatcataatcatagattaaattgaccatttgatctggaacttaaaaagagaagtgtaaaatttagcagtatttctcctgtctctcacccattcctccatctgtaatctgattacatgggaatagttgagaatttaagacctaattgtcataatttcatgaaatgtgtttaacaataaaactactagatactgtagattagagtattatttaaaactactagatactgtagattagagtattattagaaggataagtaggatgttgcaaaactgtttgtgaatattttaagaacgtcctgtgcaaaaacgtcattaggctactctattgtagttttcaactacatctttttatagcggtaaattgagcatgtttggtgttatactgtgttatcagtgaatatggcattctgagagaagctatttcaagaatttgttactactaaaccttttagttcctgtagtcatttatcttttattagtgagcataagcagctctaatgcagattttgtggtagttccttttaatatttgaagattccccttgacaactaaaaagagtacgacatatcataattt

SEQ ID NO: 28091 - DNA, 1086 bp, Homo sapiens
ttacttcagaaaggaggatgacagggagactatatgatatagacaaatacactatttgtctattcatttaattgttttctggagtggcatccacagttagccccattgcatatgtaaatcctgaagcaagtctgagaattcattaaccgtggcttgatcttacagtcagttgcttagcgtcatggtaactacttcatagcggtttttttcatttaaacttagcgtacactagaagctaaattgcacaggtgaaaagtatcttcagactttgggattaaacatttctggattttggaatattagttttatttattatgaatgcaaccttgaataaattgccaaatttctccagatagacctcagtcttcttttccataaaatgaaggtaattgtaggattagtcaagagcattatttgtaagtgcctggcatggcatgtagtaggcactgagtaactgttggtttccttctgttacatcagtcctagccgcttttcaaatatgcaatatattaaaatcaactttaatataagaaaaatttcctggaaagcgtagaatcatggaaattagagaaagtcttcaagtgtttaggcaccctgctttttagaaaaatgtctttaattttaaatggaatacttaggatattttcaatatagaagagtagaccctgagaaaaagtcatgcatagtcccactcactactcatagttaattattgtaaatatgttggtatttatttcacttttattttaatatgtagatttgggatttatttttatagttgagttgcatacaaaattttgtgttgccttcttttaatcacttaccttttataaccatttccccatgttgtaaactcagtgaaaacatttagtggctgagtattattccattgaataattaacttcttgtttatgtatctgctactcaatcgtatatttgtgtctacttttacattataaataggctgctagaaatgaaaacttttttcatatttcaggttatttccttagaatagatttcccatgctagaaatgaaaacttttttcatatttcaggttatttccttagaatagatttcccatggtt

SEQ ID NO: 28092 - DNA, 1062 bp, Homo sapiens
tatacgaaatatttgaatattctaaaagtctattacaggttgagtatcccaaatccagaattcaaaatctgaaatattgcaaaatccaaaacattttgagtgccaacatgatactcaaaggaaatgttcattggagtatcatggattttggatttttggattcggaatgctcaaccagcataatgcaaacattccaaaatctgaaaaaaatctaaaattggaaacacttctggtcccaggtatttcagattagggatactcaacctgtagcctgtgacaatcattatcgaaggttcatatcaacaagaacagtaattgaattgttaatgttttagatttattctcaaattcttcctactttgattattatgtttggtctccccccttccccgtttttttttttttttccgaatttggataataggaagatttttaaagagctctaagagaagcttatgtgtgctacctaggcacacagtaagcgttgataatcttaaatattaaaatacagttgatatttatggctgttatttattcacataagactttggaatgacatgtatatcctcaaaaaaaaaaaagtcagttttttcaagggaaaagtattttaaaataatttgttctcttattctatttataatcttatgctgcatagaaagaacatattagccttcctttttaatgagtatgatattacataactagaatatttcatttaatgtttatcagttattttttctcccatctgtacaatacaaccatatagatcataacatctagacgtcaaagaattacttaagaaaggcatgcattttttaaattaaaaaaactttttaattgaatggattttttgtaatcttgcctgaagcccaaaatgtttatgcttattagagctagaatttacatataagtataatataaatgaatataaaaagctttatcttaatcatatggtcctcttgtacatagcaatatgtacaatatgtgtaaatctatacatatttctatatggtcagatattttctagattttgcttgtatattaaaacatgcattagtattt

SEQ ID NO: 28093 - DNA, 1729 bp, Homo sapiens
catattgatgaactaagctgtgtgcattgcagttgccatttatgtttttgtctccccaaaatggcaattatcttacctattagagtaagttaatattagtaaatcatgttgacaatgatcgtgtaataatttctatctttagttagatttaattgtttgtatttgcagcacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaa

SEQ ID NO: 28094 - DNA, 1947 bp, Homo sapiens
ctattgaggtaatcatgtggttttcgtctgtagttctgtttatgcaatgaatctcatttattgatttttgtatgttgaaccaaccttgtatcccaggaatgaagcctacttgatcgtggtggataagctttttgatgtgctactgtattcagtttgccagtattttgtttaggatttttgcatcagtgttcatcagggatattggcctgaagtttttgttgttgttgttgacgttgtatgtctgctaggttttggtatcaggctgatgctgccctcatagaatgagttagggaggagtccctccttttcaatcttttgaaatcgtttcaggagcagtgatagcaactgacccttctttgtacctctggtggaattcatctgggaatctgcctggtcttggactttccttggttggtaggctgttactactgccttagtttcagaactcattattggtctgttcagggattcaatttcttcctgtttcagccttgagagggtgtatatgtccaggaatgtatgatttttttctagattttctaatttatgtgaatagaggtgttcataatattatctgacttgtctttctatggggttagtggtaagagcccacttatttctgattgtgtttatttgaatcttctctcttttcttcattagtctagtggtctcctagtggctcacgcctgtaatcccagcactttgggaggccaaggcgggtagatcacgaggtcaggagattgagatcatcctggctaacacagtgaagccctgtctctactaaaaatacaaaaaaaaaaaaaaaaaaattagccgggcatggtggcgggtgcctgtaatcccagctactcgggaggctgaggcgggagaacggcatgaactcgggaggcagagcttgcagtgagctgggatcgtgccactgcactccagtctgggtgacagagcgagactctgtctcaaaaaaaaaaaaaaattagctcctggattgtgtgattttgatttttttttgaagggcttttttttgggggggtctctatctttagttcagctctgatattggttatttcttgttttctgctaagctttggggtttgtttgcccttggttttctagttactttagttgggatattaggttgttgagatctttccagctttttgatattgtcatttagtgctataaatttccctcttaacactgctttagctgtgtcccagagatgctggtatgttgtatttgaaatttctttatataatttaccatgttaaatataacttatagctaataacttcggaatttgaacctcatagaactgtagtccatagcagatttcatttgatttaaatgactcttattttggttactatgttattccttcctaccccaaaaaagttacgttttgaaataattcagggtagaattcatatagatagaacttcagacatctcaggagaccagtacgcatgaatgaacatgtagggacccctctaatacgtttcacatccattatgatacaacaatgaccatacactttagtagttctcagtgtgtgttctccagatcagtagacagcttcagcagcttgggaacatgttagaattgaaaatttttgagtcccacctcagagctgccagttcagaaactcttcacgtaacctgtgttacaacaagtccttcagataattttgatgtttactagtttcagagccactgcactaaatgaaactattggtagcatttgtgcactgtaaattgatgctgtttaattttcattcacttgtgctctgttggaagcttttttgtgtttccttcacttgggatttcaaggaagtatctaatttttttttttttttttttgctcaattacatgtaattgagaataagataggtatctgattctccaaaagttcagcatctttattttatgatttaaacttgtcgagttatg

SEQ ID NO: 28095 - DNA, 1066 bp, Homo sapiens
aaagtatagcaatccgagttagaaattgcttataatgcattcatctaatcagctcagtgttcttactgaacaaacttttatttccatgtttactcatgtttatttcatcagtttcacctgacattataccatgaatatatttctgttttgctagtgtttttattcttactgatcacatgtccctttttcgtcttccataccactcccagcctagagttaatgaccactaaccaccgtagccacatacttttccatgtttggataaccttatgcagcatatacacctaaagggtggtggtttttttagggggtggtggtggaaggggggagacggtcattgtttttacaaaaattaaatttcatctattttacacatcctttcccctgtcttccccttgtactttccaaccttcagtttcttctttttctaattagctttgtaggagtgacttaaaatataataaagtgaaataacatagcagtgataataatagaataaaaataaacgaaacgtgattggagaaactgcacacatgcacaccaagatttcagatattcttattccttccatgtacagttctcagtgggtatttcagaccttcactcccatcctcagcctctcctattcagtgccagcttctgtaacgctggatgatcttttctttgcctaacgaagaaaactggagatgttaggtatgatcctcctttcaacttttgtgcctcctatctaaattagttgttaaccagcttgtaatgaagggataaacattgataacccaatattatttagaaaatagaaatagaatcagaatatactatgaaatgagcttacaaatttcaacaagtgtccactattttgggagtgtgtttgctcttctccagcagtaatccagaaagctcactttttcccccgagactatctcatacaacatgtttgccctgtagcaaacagctccttattttttcagtaatgtagagctagaccagtattcttctgttgtttttattttgtggagtttttgtgtgtatttttagttttttgaaacagggtctcgctctgtttccc

SEQ ID NO: 28096 - DNA, 1083 bp, Homo sapiens
atattgtttgtcctattaggttcatatgcccctcagtaaagtttttagattatttttctttagtcaggtatcttaatgtgttttaatgttcttgtatttatgaatgtgctccttttttctccccctttacaaaaatgttttctaattgaatattttcattttttaaatctcagaacctcttcacacaaattagtaagggcctcagagaacttttatgttggcaggtatgtctgctaatatttaccacttcagaaattaaaaatgtaattgaaaagtgacatgtctatgtaacatttatgttagcataaatattttaagtgaaaaatggctaaattttttgcctagcccttcttttggaggcttgtagggaaataaaatactgattatatctgtccctgtactcacacttcaagaataacacatagaattaacttggaatttggactagcaaagactgaattattgatcatcttaaaaatggatggaaatcatttttcatggtagtcgtatgatttcttggcaattagctaatttctcaggaaaattaagggtgacagtgtggaaggtaggcatctccgtcagtgtggaaataccaccctctaagacaactgctttatgcgtgggttgtacttcccttgccgcatagtttgaaaatgtctccaggaagaaagtttaccgggtgtgctttactgctctcaagtattgcagccttgtgctatccattgtccagacactgaaaagaattgcttcatatatttttacccaactttgattattaatggcaggaaagttattcagataccaactgttccatgatggttaaatctcagaaatctataattctcatagaagataccataggagagtatctttaaatcttggaataacaatgggtctcttcatacacacacacacacacacacacacacacacacacacacacacacacaaattaaacatggtggaaatttttgacaaatttaaccacattaaatattctgtccattaagattccccaaagatggtggaaagatggcaggttagtgggagaagatatttgcagcatgcaaggcaagatgacaa

SEQ ID NO: 28097 - DNA, 1031 bp, Homo sapiens
aataaaacagtctcagtttccagagcaaatcatatccatctgtactgctgggtaaatgtagttctgattcaaccacatgaataagattacacgtgtttttgaaaatcactatttgctgaagatcataagcaattcacatgctttgtctatggttaattttggtaataagatgcaagacagctcacagatctttaagctatatctagaaatagtgctgattgaatttaagctgattatgcagcttattttggtcgtttgccctcttcctaaattctaaagttcaaagtttaacgtgaaatagttttctcaagtttagctctagccaaagtccatgaaatggcttatgtctgtcaatagttgacctaatagatttgtcctatgttgacactttgttcttttcatactagactgtgcgtatcatgtaggtatgttattttcagtgtgctgtgctttaaaatgggattagaaagtcatggagaattttttgaaaatgttttgatgtgttagtgttttttggtagggttttgggatacatcatttatttattaattaattcattattctgtatttattctagaatgtcatcagtaatgtattgaactaccaatcatgttagtggagataacaaggcaagaccagtatagtgacattagaggcataaaatcaatgggttctataaaatatttgagttgctttataagaactgtgtatcaacaggagtaaagtcatcaagaagaacctcttctaccagtgccatcaagaaagggttcatttatatggggaagctccaacagaatctggatagacagaaataggattctttttcacaggcagggatggagatatgttttagacatggaacatttgagaggataaaagaagcatgaaaccacatgtctggtacctgtgactactaaggcatgtaaataaggcatgctgagagatgagaatgaaggtaaggtggtaaagcaggggtaagattttggaaaccattaaaaaccatgccaaagttcatgaacattttcctttag

SEQ ID NO: 28098 - DNA, 1037 bp, Homo sapiens
ttgatatagcttgtaaaagccaagacaaatttctaccagaattagagatatggcattcatccagccagccatcaaacatttttgaaaaccaactatctgctaggcaccatgctaagaggtagaaaaagctgcctccctacaagagatagaacctttaacctccatacgaaagagctcttaatcttttgcttgaattctccaaagttcagcatctccaactgacattaatatatttttgattcgatgacctgaagacaaccaaaactttaatgagctcagtctttatccctaacctacctctcctactatttcctctcctggttgatggctgatattaatctgtgctagaaacttaataggctgtcaatatataatctttatttaattaatattttatgctgtatctttactctgtcctatccttaaccaaacttcataaaagtcctattgatcacatctttacatgtatcccaaacttctctttacctctgtatttattacctcagttttaggaccacaacatatgctttttgattttttataaaccactaattatttttatatccctacctcttttgtccgtcagctacactcctaccagaatttgcatattatcatgacagtcacccattgaaaagtttttatgattttcgtttgcttagaggaaaaaaccaaaatcctcaggatgcattcagttttcttcacaacccagtaccaagtttatctcttctcaatttattccctttctccatctccatcatcctcattcccctgaatttcatcacatctaattaatgtgcatcatggcttcttcatacttagaccatgttctcacacatagtgggtattcaaccaatgtttgctggtcattattttgaaaaggcaaagggctagattaagcaggagcatatgatcaatcacctgagtgggtcagactgagaagacagtttagttgtttagttgataacttattggaactcttgaagttttatattagaataccatggaaatggaattcataaatacaacttagaaat

SEQ ID NO: 28099 - DNA, 1028 bp, Homo sapiens
tctgaaagcttactttgaaagctgcttctagagaaacctaattattcctggttgggaatgttcttctggtgataccactagcctcctgggtactaagcatgtctgatgataggtgattcataagctcaatgtgacatttcccaatgagttgttttgtcacgggttatccattttgtcagacatgttatttcatcctgagctttaatgtgactatcatgttgctgggcaagtagctgagagtgtcatatagcttgtcaaaaccgtaacaccatttgaaccagaatatgtaattttaaaatcagagctgtgaaatttaaacgaggatcttgctaagtcacagctaattcctttcttacttggtaacctggggtctaatgtaagagtattaggttgccgtcatcagcctttgtaaataagttaaatcaactgaaggacatagtttctggctagggcagggtctgtcacctgttctgggttaagttactgtggggtgcatttgaagatttgaagaaagcagtctgttgagatgacgaacttcttgaatcaactgtgacaaatgcaaaaacccatctgtgtttttttgagtatcattctagtagtcatgcctctagtgttgctttacttactctccaaacatgaaagttagcacatctattaaaaagcaaatctgtaatattagtagaaatcattctgatatagtaactttgcatgttctataaattcagaggagtagaagattacaaaattccaacaccaatacagcatagctatcaaagctgttcttaaaaatagtttgttaatatgactacattttaaaataaaattagaagttctttgtccacatagaattccctttagttaaattattttgaaattagctagtaaaaaggcatttacagaatttgaattagttgacagcacaattttaatacattcctttgtgttggtatttggagtttgtttccttttaaaatgtttataaatatatagatatacacacacatatatatacacacacacatatattt

SEQ ID NO: 28100 - DNA, 1020 bp, Homo sapiens
ggtaacatccttggaaaatatgtgctgggaactgccatattcaaaatacttctaaaataaatggagagtttttttttttttttaaaccaggaaaaaaactcttgtgaagaattagtttctaagtttttggtttctaagtagtttctaagttttctttgtattttattgatctcaaatgttgttgggttttatacatcacgtaacttttgatgttacttacagaatactctaattctatcattagatgtgtttatttctgaaaagtgagtgattgttgaatagaatcccattagcaacattaatgttacaatttaaagacaataatttcttgtagaactatgacgaggatacaagttttgcaatgttaaacatttttggaggtgtacttcccttgagtgggcacagttttagtcattttgatctatttttaagcttcagtttgaaaaagtcatacctcatttgtccttataaatatttatgtcatcttataaccaaattaactcctagattttcatttgaaataactcactttggctgagtgcagtggctcacgcctgtaatcccagcactctgggaggcctaggtgggcagatagcttgagctcaggagttcaagactagcttggccaacatggtgaaacaccatctctcttgaaaatataaaaactatccaggcatggtggtgcatgcctgtaatcccagctactggggaggctgaggcacgagaatcacttgaaccctggaggtggaggttgcagcaagccaagattgtgccactgcactccagcctgggcaacagagcgagactctggctcacaaaacaaacaaaaaaacctcacttcaatagtatacactgcaaaagcataactataaaatggaataagactttatatgttttgcttgacattttatatgccttatatataactttttttacttaaatgagaatagaatacaatatttaaaccaatagcaaggatggactatatgtacaaatcttcactatgagcttcaaaggaat

SEQ ID NO: 28101 - DNA, 1027 bp, Homo sapiens
atatatggttatagaggtttgcataatatttagtcaaatcagatttatttatatgtactttagaagtattctttttaaacagtattcaactttctctgacatatgcagctgcagcaaaaaacgtttactgaaagataccttggaatcatttgtgtacagagtttaaaagttaatgttgtcttatttaccaaaataaaataagaaaataaagatttgatagggccagaatgttaattagactagaaaatgcaactttttattctgtaaatagatcagagtgtgttaaagcaatctgaaaatctgaagcataaatgtagaaaaaattttaaacttctttactctttgttaactcatcaagttgaaatgaaagttaagtgcatttaaaggcattttcagtagaaaacagcttttctttgggagctgctgggcaaacatcctttttttaatgaaatagatattgtatatatgataaaggtaaataaatacagataaagcacttagatgaaaaaaatagactgcaaacactgttatacattcacttgtaggttcttaagtcattttttttgttcttttgttctgtaattgattgctagcaccccctttaacccaccttaaagggcaagcaggaaattcatgttttcgttcatcagcccatccctctgaaaagcgttcgatattaaaacagttttcaaggagcaaaagcagaggaaagaagaggcccagctagactgtagcaaggttagaagatacacgcaagattgcctgccacacacatcgggtcttgttcctgtccagtatttgcatggagatatcaagttaattagggtaggactctgttcttcgctttctatgtgaccttttattatatctgtggctctctagttcatatggtgtcataaagctatgggaaagtctttctagtgtttgacacaaactgcaaaagaaataagcattgatatttccctttgcctgaaggtttttacagcagcaaaatactgcagaggcaaagttgatattgtggtagatt

SEQ ID NO: 28102 - DNA, 1055 bp, Homo sapiens
aatgtaacatattctgtattattaaggaaagaccatagtatatagtaaccacacaaaatgcacacatatataaaattaacatggataagacattcctctgacaatgtaccacaactcaatattagaagaattaatattgggttatgttctaactatgcacaattaactacagatgttccatgcagtgtatcctttgagcaatttttgtttgcaagtatattgttaaaattagggagtgaaaaaggaaagaatctttcaaaggacaaggcatgaaaacaactttcattaaatttatttttcagaatttatgtattttaatataaatgggtaccatatagttttgtgtgtagatattcatttcaaatactgaccttgtaggaaaatatccttatagcttcgcaaaagcaatgaagtgttggtgatcatggtagaaacaattttacgctttcaattaagaaaccagagaaatatttgctggtatgtttctcatatagatgccttgatttgagttgggttcatgggcaaacatatgcttattgtttggtttctttgaatgtgttgaggtacattagtttctattcttgcatggtgagaataacttaaggtctaaaaaaagtgagctattggaatgtcactattatagtataataatctatacactagtataagcactgaatgtattatcttaaagtagccatgttctatttgctttaaataatttacatactaccaaaacaattcaacatcagagtttctttgatgtaacaacggatcacactttctcccaaaggtcaagtggcaaatatttctccaatgaaaaatctacctgtcagttctccaaaggaaaacaaaacaaaacaaaaacaaatacacgaaggtttatacattgcatgataatttgtgagttgtgattaaacggaattgtgtctattacctgaaatctgttgcaaaatagatagttggattcttgttattttttcagttagcatttagcctactcctgcttttttgtttttcaaaaacatgttcagtgttaggaatatttacatgtgacc

SEQ ID NO: 28103 - DNA, 1059 bp, Homo sapiens
aagccactataatctattccacatgggcaacaaagtacatttaaggaataaaactattagactatatttattgaatgatgaaactcaagctggtgttatataaagtgatgaaggaattactgaattctctttttttcgttttttgagatggagtctcgctctgtggcccaggctggagtgcagtggcactatcttggctcactgcaacccctgcctcctgggttcaagtgattctcctgcctcagcctcccgtgtagctggtattacaggtgcccaccaccatgcctggctaatttttgttaaattctcttttccaaagatgcgatactattattctgttgcagcaacaaaaactgggtatacacacaaaataattgaaaacatgatatttatacatctaggctcatgtcagcattattcacaacaggcaaaagatggaagcaatccagatgttcattggaaaaataaaatatggtgtgtacagacactggaatgttattcagctgtaaaaaggcatgatattctgatacatgctatggcatcaaagatcattgagaacattatgctaagtaatataagtcagacacgggaaaacacatgttttgtgattttaattatataaggaatctaggataattaaatacataaaagcacaaagtagatcagtggctaccaggaactgagaagaggaggaaatgaggagttaatatttaataggtacagagtctcagtgtgagatgatgaaaaagttctatagttggactggtgatggctgcgctttacacttaaaatgactaaaatgatacattctatactgttttgtatattcatttcagtacaataagaataatttataaaagacgctaatgagctcctagtcatcatatgacacaaaggtgtcttttaggaaccatgaaattaatttaaaaaaaaagtctactctcatacctacacagctattttccgtctgttatggtaagaaacagaagttaaggttgttaacaaaaataatttggaaagcaagacaggagatcaactgtttgcatcactttaggcgaa

SEQ ID NO: 28104 - DNA, 1093 bp, Homo sapiens
caggaatttattttttcacgattctggaggcaaggagtaccagctcaaggtattggcagggtaggtttttccgagccccatcctttgctttgcaaatggatatcttctccctgtgtcttcacatggtcttctctgtgtttttgtgtcctaacctcctcttcttataaggacaccagtcactggattcaggcccatcctactgatctcctttaatttaattacctctttaaagacactaactccacctacagtcggattttgaggtactgggagtaaggacttcagcatctgaatttggggggagacaattcagcctgtaacagtcatgatatgaattaactgctattgtgcatgagatgtctaacgaaaagacagaaaagaagtgtaaagaagtgattactgagatcaacaaatgttgctataggactgccagtctatagctactgcagatatatatatatatatatatatatatatacataaaacaatgtgatagtgggtgatttgtagatggtaatagaccattcagagaaacaagctgaatattttcttacattggaaaaaaagggggacacaaaagaaatgatttcccagcattttattagattccataagaattctgagcatcaaactatacactgctatatatgaagccagatccaatgggaatcttttgattttacatatcgatcactttcaaaataaggatactagccttatttgctgtgcaatattatcatgacatatatttttaatttattgggtctttcagtttttgtgcatctataaagcctaatagttcagcctctctgtaggcatctttgctacttcctatctgaggaaataatgttttattataaaattacaattttttgtaatttagatctctagtttctaagataagaaaacagatctatcatttggggcaagaatagaaacaaaataaactctcctcttaaagcaagggaaacaactttctgaaaaaaaaaattgaagacacacctttcatgtattttaggaacatttcacttttgctcatcttctgactgcattgtgaaccatcatagctagatcaaaattagttatgttaata

SEQ ID NO: 28105 - DNA, 1040 bp, Homo sapiens
tttgtctacacaaaagccagacagctactctaatgcccagtgaattctgacagtatgttacagtttaatgtgatgaatgatgtaaggacccgcctaaaatgctcacgcagcttcccaatgtcttaccctgacctacaaaccagctcataggtctccatgcatgtgttgtagaaagtgatgtagatggccaggcggggtggctcatgtctgtaatcccagcactttaggaggctgaggtgggtggatcaggaggtcaggagtttgagaccagcctggccaagatggtgaaaccctgtctctactaaaaataaaaaaaaattagctgggtgtggtggcaggcgcctgtaatcccagttactcgggaggctgaggcaggagaattgcttgaacccaggaggcagtggttgcagtgagccaagatcgcgccactgcactccaacctaggtgacagagtgagaatctgtctcaaaaaaaaaaaaaaaaaagaaaagaaaaagaaaaaaagtgttgtagattagttgaggatatatatagggagaagttacttcaaaaatgttattttttataaaagtctttttgactgtgtttctcacccacttaaacacctccagggtagagactgtttcttatttatatatattcagtcttgtatatagaggatcctttcctcatgaatgtttatagaataaagttagacattagaaacaagaatgagccttttgcttcttgttgcctgcagggctaaggcgaagctcatggaataagtctaggatgtttgtttttatatgaactgtggtgtaatagaaagagagcaagaaagaacagcagtaagtaggacaagaattagaagctgataagttagtccttctactttagcttagcatttaaagcccatcccactattcttcagcatatgattcagttgatgtgaaactctcactggcttttcatagctctatacatttgcacatactgttctatatgcataaaaattcttttattcctttttcacctgaaaaaaaatatctgctgatccttta

SEQ ID NO: 28106 - DNA, 1057 bp, Homo sapiens
atatctagaactacactggagaaccgctgatgcaatattaaaattttacaaatgttcctctcaaggaatgtttaattccttatccaatcattttgttattcagatgcattcaaacatgttatggtgttttgctggtaggtgtcctccttctagacctgtggtattttgacttaataatcgtgactcatattcgaccatttaaaacttgcttaggttgacaataggcaataccaagagtctcccttagataaaatatcacagtttcctaaatctgtcgctcttatcttctaaggcaacagaggtcagaggagctatactaaaatcttaactaacaaacattttaaaatacaactgaagaatgtaatttgtaacaaatttgttcacaataatttttaaaaatccctttgtatgtacactaagtaactgaacattttagaaagactatcagtgatgagaaaaatacaaataacatgaaaataaattatttggaaaattatgctacaaaactataaccactgaactcattcaagcatcaaaaatattagttagaagccttgctctaatgttttggaggtttcccaagactttcaaactactaatctcacttcttaatataaggtagagcaagattctgaaaagtctttgagtttttagttttgctaaagctgttgtttcaactgagcctaggttatacaattgttaggctgaggtctcatcaaataactgaacaaatggactaatgaaagcacctcatatctataattatccacagaacacaaaggaaaagaatgggtaatttcactgtctatattacattgggctggtacttttgttgtgaagctggaatattgaagatgcagtgtaataattcagaggttatttatatatcctttaagactgatactatctgtacattgcacattggcatttatttctacagatttattttggtgtagctggtatgggagccataaagtaccagtgttcatttttccagggatgaaatcagaagagtgttagagaatggtcttcttcctcaagctatcagtgtgaatct

SEQ ID NO: 28107 - DNA, 1029 bp, Homo sapiens
agaatttctagactagtaaatacttctctgataataacttaattatagctatttcaaaccaaattgtttaattgtggtgaatcatatgtaaattgttcagatgtaggtcaacacccacgcccacattctagcacctctttcctaattcaagacaactttgcagtgcctaaaagagctgaacagtgcagattagagacataagacaaaaaaaaaaaaaaaacacaaaacaatggtaacataaaaaccaaccgtgtcagaatggtaacacaaaaaccaaccaggagtcagaaagtctctgtaataatgaataggcaggttgtatttatttagactttgcttgattatttcttaggctttatatgtttgtagataacagtttcctcactgctcacgagatttgtggcaagcaaactcatggtgcttctaggatattaaattttctcatctgtaaagtacatgcaatagcatcattattgtctactcattgaactgaaataaggattaaacaaatcaaggactgtaaaatgaacgtgtgactcctcaaatcccatacgggaagaacatgctgtttttcttgatctggttgagtcaaagatcactgatggcaagaatgccttctgtagctgcaggtgaggacaactgagatacggtgcaattgcagaaagtaaataaactttttattttttgagctgttacattatagttctaatctatggatgcctttgtgatgcagcattgtatcattttctgatgaatggctaaggttttatgattctattttatctttatatattgtctgctgtattttcaaatattttatttccatttatagatgcattgaaaaatcataaagcacattgcataaatgtgttacatttgtttttgcttatttgtttatttgagacggagtcttgctctgtcactcaagctggattgcagtggcgcaatctcagctcactgcaacctccgtctcccaggttcgagcaattctcctgcctcagcctcccgagtagctgggattacaggcac

SEQ ID NO: 28108 - DNA, 1032 bp, Homo sapiens
cagttgtcttacatcgctataaaaattcagggaaaaatagaccttttcatgttatgtcccatgtacaaattcattttgtatgcatctttttttttcctcactaggctgttaacccctagagggtaatgactgtgtgttattcatctttgaacctaatagatgcagaaaaaaatattcattcaattaaattggaacaaagtgtaagaaaagaaagtaatcggcagggcacagtggctcacacctgtaatcctagtactttggaaatccaaagtgggtggatcacctgaggtcaggagtgtgagaccagcctggccaacatggtgaaaccctgtctctactgaaaatacaaaaaattagccaggagtggcagctcacacctgtaatcccagctacttgggaggctgaggcaggagaatcgcttgaacccgggaggtggaggttacagtgagccaagatcgcaccactgcactccagcccgggcatcagagcaagactctgtttcaaaaaaaaagaaaagtaatcaagtagaactgttaaatcttacacagattttataagatgccactatatgccttgctattatgcctggagtaaattataatcaattctcctgatggatgagacacaaataatataaacacatgggtttgatatataatggaaattattttaaattgaattttagtgattttttgtggtatttatgttcaaaaagcataccgacaagtcaagcatttcagaaaaatgtttataaatgtatgaaaaagttgtttgtgtggtgctgaacttggatatatattactgcatatcaatgtgaaaacattgtgtcagcttcaaagcattgtgcatatggaagacattattgctattgttaatactgtaatagaattgcctctgcggattaaaaatgtagatgtttatgtacaaaatagcagcaataagtaaaagaagaaattatttatatggattctattaaataaaaagggagtactgttttcagtactttgtgtaatgcagattgctactcatgcc

SEQ ID NO: 28109 - DNA, 1033 bp, Homo sapiens
tctctactctcttaattttactccttttctatttagtctcttttttccatcaccctttttcttcagcttctcctatgtcttcctgcttgaatctaatgattagacctccttgcgttctagtacttttgtctgcttggaatatgcatacacaaacaaaactgttcaactttctcagttccgtttctactattttcgtaatttatgaaaccacagtagatgtaatttgcgtaaacattctcaacatacaaatttcgtttcctgtaattctcggtatcaatttggagtattgtttatctatatcctcaaatttgacaaatgttgattattagaatcttttcctacttctcaaagaagcaacagtttccatctttaaattacagatttctggcgctttatctcatatcactatgaattacttttgctttatttaaaaaatttaaaaaagatattatgtagaaaatacattctggactcagggaatatagagaggtctgagagcttaagaagaatagaaactcatctggctagatggcaccaaactgcatcacttcaggccacacaatgttcattaacacttaaaggactttttttttttgtatataaattatatagccaaaaacaaagtaaaacataacccaccaaaaatattttgttttacctcttggttggcaattttggcatcaagcacacatactttaatcatagtaatacttttcttacagagacatggaggttgctcgctaaatagagcaaagcaaaacaaaacaaaacaaaacaaaacaaaaacacacctttcagaatgaacagggcattcatacagaaactgtggaggtgaagttggcacttactcatctcaaaggacattgtcttttggccaaggctgccatcctgtctgctttgacacttggaaatggcaactgagttcgtaacacaaaactgaatgttgcccttcttaatgtgaggagagaatgaaatagaacacaaaaaaaatggcattcaagaatataatcgccatggtggctcatgcctgtaa

SEQ ID NO: 28110 - DNA, 1047 bp, Homo sapiens
cttgatttatttctgtacttgagctttttctctgcagtaaagtttataaaagataaacagtacccctgtattctatgaagaaacagataatacccccacttgaggttgtttttgaaaattattaattgaaatttaaagtgagaaaaatattaggtttctgggaataatcctacaacattgaaatgaatacataaagaaataaattggttaccacagctcacctctttattttgcacttttgtataacatacatcaaaaaccatattccattagtttccctagaccatcctatgacttctaccttttccttacatttcatattttcatatcagatctcatatttctcaacccccacttctatgtgttttgaccaatttttaagctgcatttctttacagagtactaggcatctcactattttattaatattaggcatattaataaaatgtctatcatcaatattatcaattattaatattgttaatattaactatgttaataccaatattcattatgtgcaactcttaaacatgctatatatgcataagtatttggatagacagattcgattgtaaaggaagaatggacaggataaagccatgtgtacagagtgcaatagtgaggtccagaaaagctggatatttgtctaggagagtttctaatgcatgacatattcggttggttgggataatttggcagtaatccctgtgcttttaaagtagtaactacaaaatagaagtgttgtaccttttgaatttagtatgtcacttctttaaaagtctgtaaaaattttacaagaatttcaatataagttcttttctggaaatgtaagtaacatttaaagaaatgtacagacaaaataatacactaagaattttacacacacaaaaaaaagttctaaatgtttaactctatccagtacctattattgcagtttaacaaaaattgatcacccttgaggtttgtggtactgttactcatcacagaggttgaaaaaccttaattgctagcttatttggttcaaaagaataaaaagaatcagaaaga

SEQ ID NO: 28111 - DNA, 1032 bp, Homo sapiens
gtgtgtgtgatgaggagtggggggagaaaggatgcatcattgtattttttattctaggtttgttttttatttgtatgtagttaccacaatgatattcaaattttaggggaaaatgagaatttttttacttctgcaaatatatttaatacaacccatccaaatttattctaaatacattttgatacaatttgtcaacctataattcttcaagaagtggaatcagcagttggtaataattgcacatctgtggttaattagctcagttggttgaatcatggagctaatgaggccaaagcctgggtttgatctctgcgtgggctggtgagttttgctctattcctgggtcgtagactgcagttcaaacccaggccaagtatctcatggatgcatgccactgaccataagaaactgggcaagagaaagtaacttcaacaggtccggaacacatcttcaaactatatacagcatctgcttgttaatgtatgaagagaagcattagttatgaactcagtactctcacaaaaagacacacaggaaactttctgtggcctcaaatgaaacattgaggaataagtaatattaggaattacctaacgagcacatgggaaatagctaattcataaccacaaatagaatctatttcaaatggcaagggaagcaaaatccctgtcattcccacacattgatttttccttggtagattgtaaaggtctttaaggtgttggatgaagagttctgaatcagctgtgaaataagacaaaagagggaggagagaaagcagatggaaagccaaaatgtcacattcgttttagataaagactagaggatgtagtttagacccacaggtaagtgggctccttaacactaacctcagaattagagacatttcccaccaacatagagtaagaaaacacaggtctccccagtgcgaccagcctcactttgtggcctgataacgctttttgtaggaaggtcatccccaaggagaaaaagggaagagaaagggagtgttgtcatatatggacagatcgt

SEQ ID NO: 28112 - DNA, 1025 bp, Homo sapiens
atgtcagacaaagccttgaaattcatactccatcaagtatgtgatttttgtaatactttaggaacagaataaattttaaaatatttcacaggattgtgaaatttttacccaccagtgtctaggtgtacatgaaactcttcagattttgttttcaccccttctcacccaacctcctttttacaactgctctcagttatgaccagcactttacacttttaaaagtacacatgacttaactgtcataagccatcagaggaaaaacatttggccttatgttaaagaactttttcacatgttttatcatttctacaagattttaagctttttgaagacatggaactatttctcgtgtagcactttacacatatgcagtactcattttttattaaatattaaaggagtgaaagccatcttcacactattctatgattggattatctgtatgttttttctgggccactgaagattaagttgaataaacgaggagctggcacaaaccctgacagatagtagaaagttgacatcctaacagagacaaagaaagaagtataaatgaagataatgaaactcaaaatataaataaaaaataaatataacataatataataaagaatataaaatataaagacgatgtagattaggggtaaataaattctattttttaaaaactgtatggaccttctactttgggcagtaggctacatagacattgaatattacagcaatttaaaggatcatattcttttttgtgaaagactatcttgttccattaaggagatgggacactctgttcaatcaaagtgcaaaatcaaagcctataatcatgacacctagaaaactaaatttacctagaaagctaaaattatgataatgttttctgttttgtaactccaaatatgcaatagtttctaaatatatataatatatatatttagatacatatatttagataaaataatatataatatatttaaaaacatattttttattttaaaaattattttaaatagtctttggttaagtta

SEQ ID NO: 28113 - DNA, 1021 bp, Homo sapiens
caagatcttactgttttatgagaaagttataatgttaccaattccttgaaaccagtaactaaactagttttataaaaattaaaataagcacggtctaactcatacacaattaacttaatagttaatttggttttaattataggctcgtaatactacattcatgcctcacaattatataattcatacatgcatgtatggattcttttttcttttaaaactcaattagaatagtttaattccaaaatatttactattgaaacaaaagcagttcgtgaaaaatttttcaataaactactttttaaattctcatgcatataaatttgtatttagttttgaatatttatgaaggcctttaatggagaatatgcatccttagaactcagcatttaaaacatttatactaaaggatcaatattatttttgactcttaattgcatcagatatttacaacaaattctatattaatagggggcccatgcaagatgttgcccattggcataaacccgtagatccgatcttgtggtgaagtggaccgcacaagctcgcttctatgggtctgtgtcagtgtggtaatctgacaaaatgctatacacagtgccgttcaacaatagttcagtaaaatcctgttaaactccagttgattatatacttttgaagtcattatattttcctttgtttttaatgtttattttaatcattgtctgtcttacaaggcaggcttcaattctcaacaacttggaagcgtttatatcacacccattcaagttcgattccatgtacagtaaattgcataagaaagttgaacctttatagcagggtttggaccaggatctgaatagattctgttcagaaacttcagtgcatactgtagtgcttagtgtacctcttcaacttcagtaagaaaattaaagactaccattggatttatatgtttttattgagcctatttctcctgaaaaaatgaggctgaatgcaattgacttttactattaattgcgactagaactatggcaggttagat

SEQ ID NO: 28114 - DNA, 1032 bp, Homo sapiens
ctgttagtggtgtaatttgtgtagtgaggctatcttacatagatcatctttcagacacaggattaagtagttgttgatgttagaactttaatttaagactccaaatatgaaacatggaattcattaaagagacgtttagatgcaaatatatattaaggacctcaagatactggctatgtggtgctgacctttctagaatgctcaggcatccaaaatatcttaatacctagaacttgctaacaatgtagtgaagaaggaatggctacccccaacacgtagaacatgtgagccttagaaagtgaataccagtcacttcaagcaaaataatttgattggtctacagtagtaaagactctttctctctgtgaaagaaaaatatttgcaaggactaatcaagaagcaatgaataagaggcagtagacatagacctaaaacaaacaaacaaaaagacatgaagagatgaaaaggaaagtgactcatagcaaataggaacaccattgtgtctaatgatggcagttcaacccacggatgaaagaaagggacaactaaatgggtaaacaattgtatctttataaatagttttttccttgagagcctaggatccctttcctatgtgtttctatgtatgtatctcccaatactaggtgtatttatttagaagccaaatctattgatgggccaaatagaatatgattgccaataaatgtctatttccttacagtgtaatggagttaagtgcctcacagaggtcaagtaagatgtgcagtttaaggataatcttacaaaagtactataatgaattgttagaattacagcctcttttatatactatcacctaaagtgaatgagtataatagaagaataattgaagaatggtgaagatgtctctatgattcattatgttagttatgtagaaatcataagaaaaaatctgaccaggtgtggtggctcatgcctgtaatcccagcactttgggagtctgaggcaggtggatcacttgaggtcaggagttcgagatcagcctgaccaaaa

SEQ ID NO: 28115 - DNA, 1028 bp, Homo sapiens
cccctctatgccactaaagatggtgcctactccttaccactcatacttgccatattctttacccatttttacttgactttgtaccccaaagttcctcttgtgggctatgtgtggaatgtgatggcttttaaaaacataaattggggaacaagtgtgaaaataaatatatggacaacattttaaatattctaaatattataatttaaacatcaaaagagttattgtatatgttcaagattgaaagttaaaaagtgaatataaaattctaaataataataactatttcaacatgaacctaaaactgtgcctgttgaacagtgcatagaatattaaatagaattagtaaagagttacttgagtagtgaattacatcctgcattgtcagcctatgatatctatgtccatatattttgtagcctagattcataaaatgtatattttttaaaatcttaacacttttcatcaaatggaatgatttgtttttaatttgattatggatcaatttttaatttgattctagagcctacttaatcattgctttaggttcttaaatttcttttatagaacataggtgagcagatttttagggtttccttttagatggttctgaggtttctgtccatgttcaatactatgagtttataactttacaatattcttttgtcacttgcctaaaagcaggtttgttatttttctttttctcaaggaaagctttagagagagaatctagatcttttaaatttgaaaggcattcatgatacccagttacttcctctaatgattgactactgttgtgaaacctaatgttaatatttaagaagtggaaaattatggattgtattgtaaaatagtcaattaaaagaaaagtatttttgtgtgtgggaatctagcaactttcatcccataatccttaaatcaagtttaatgtatactaaaaatatcaagttttactttgaactattaagattaatacaagactcccatgttttttcagattttcccaatcttcaatgttctaagggatttac

SEQ ID NO: 28116 - DNA, 1307 bp, Homo sapiens
aaacagtgtaaaaattgacatatcttcataaaatgattcacaccatttcttcaatgagctagcttcaattttcattaaatgttgcttttctccacgtctctacatgttaaatgtaactttatgaagtacattagcagccaataatattaacttgtatgtaatagtttacttgtaggaatttgaaagcaggtggaacttgaaggtaattgagattaagtgaatttaagattaaatagcttcattttatataaacagttaatttcatgcatattttatggacaacttaaaagtgaaaaattctgataaggtgaactaaatttttcattattgatataagtaacgtgactttaaatctgttaccttaataattaatttctaaacaaacaaaacaggtataaaaataatcatggactatattcattaggtcaagtaaataagaataaaaacttcctaggttttgtcttggccatataaggtctttgaggtgttttgggttcttttgtgttgattgatagatttaactttgcctctcttctgagaagtttctccctctttgtcaataggtgtctgatgatttgtgagcctcaagtgactactctgtggaatcatctgtccttgcctttgaattagctttccctaggccatgagtcaacattagtagtttatacatccaaattggtaggtctttatgaaattcttctatgtattcgttctagacatataagtgaagtataagaaattatagatttacattgtggttgtttttacagcttctggacatctttgagaaaatacttgggtggcattgaaacactagccaatggaagcatttgattttgtagaattttgaaatgtagtgccttactcatagtacacttcctagtcttgggggtgggaagaccagtctgtagctaacttattactgtcttatacatcatgctaaagcccagcctgggcatttgtaaacctcggggaggtttctactttagacaacagtttttgttgagggattacaccacagtcagttccctccatttctccctctcttcctggcccccctcccacccaacatggagccttttcaactcttcaaagaagtgggaaaaaaaagtagactctttattaatggcagaaaacaaactggctgctgtacttccgaggcagctctctaataataaagcagagtaggcactgcaacaaagaattcttgaatgtactaaatatatagggaagcctatttaaattcaccagaggggcttagaggacaagcagcagaaagtttagaattcaattcaagccatgccaga

SEQ ID NO: 28117 - DNA, 1032 bp, Homo sapiens
aaagtaccccatgaactgtgaaacacctttcctgctttttcttcatagtacttatcacttcctgatattatgttagacaacaagcaaataagtatatgctgttcccactaaaatataagctccatttgaacaggagccttgattattcctgagtatacccctagtgcccagaacctagtagggctttaataaatattagattcatttgttgaatgaaaaaatgaatgaataattgaataaagatatccaggtagagtgtccgggcagcccaacctatgtgaagccagtacaagaatgtttctgtgacatagtgagcgcaattattcctctaaatgatgaacttgcatgagtacacaaggataaaattaagcacgtagtttagatttctgcaagtctcttcctcagattgaggaaaaacaaagaaattgagcttattctcacctcattcttacatgaactaaatccagaataaagcatcatttaaataccaagcacatccctacctcagccactcatggaatactttatctgtaaagggacagatagatagtaaatatttttggctttggggaccgtacagtctgtgtcgccactactcagcacttctgttgaggtgtggaatcagccctagacaacacataaacaaatgggtgtggctgtgttccaataaaatgttatttataaaactaggaaatcagcagatttagtccacaggctgtagtttgctgacccttgaattagagagtcttccccaaatcctcttcccaagttattgaaagaatgcccataggaccatagctccctcacctggttctttcaagaaatgagacaaattcagggatggttggagggtggaacgcctacctgtgacatgactattgagcctgatttctttccttttatctctttaaagtgagtcaggtcttaactttaaactgtctctaaagtggcaataactgggccatgtcaaatactcccaatgacaaaatttcttcttggagaatgaatgagggttgcatacagtggtgtgtt

SEQ ID NO: 28118 - DNA, 1115 bp, Homo sapiens
aataatactttagggtcagccaacttggagaatcctgacatttaacagctgttaaaacttggaaacattagatgttccttctgaacttccagttcttcatagataacagtgttacgaataatacccacttcatattttatggaggctaaatgagatcacgtgtaaaatttttcatgcatcataggagcttgatagatattagttattttttgggacaaatactggacagtctgaatttgtgtgtgaaaagtatcttaagcactgcttgcttatcaagtcttctagactagatgtatgcatacattattaaaaacataattcaattcagttcattaaatatttatctaagttcaactgagaagtgcacagcattatgctagtgactgagagagaagaagacagtttctgcctttctggagtgatgacattttcataaatatctctgatgtaagtagattggagtaggtgttaaattcagatacaaaactagtacaacaatggaagtccaagacagaaaaaaatatctgattggggtcattggaagaatgcatctccaagaaggtactatgtccctgaaggcccagtagtgagtaactttgagaatttctgagtgaatttacttggtaaaaaagtagatttagcaacaagatataaataaattaatcatgaatatagaaataaactttaaacaaaattataacagaaataagagctctctaaaataattagcaatgttaaaaaaacaaacataacttttagccatgagtttaatctttgcatgaaaaatattttattgatttttactggaatgcaaagagatttcttctgtgcttcatgctttaaacatccaggaaactttacccaagtctgaaattgattacgtcagttttttatttcaaggaaaatatgtgtagattttatttgaggtagttttgttttgaaaactatgaaggaattaaacataaatcatttattcctcaaacaatttattcaacaaatattcattgcatgtatgctgtgtgccaggaactcttccagactctgggaaatatgtctccaagaaagcagacaatacccctgccctctgtggaagactgacaaatatacaagtgcat

SEQ ID NO: 28119 - DNA, 1044 bp, Homo sapiens
ttatcacatgtgtaggttgtatctaccaccacatcaaaatacagaactgttccttcatcacagattccttatagttcccttttatagccactctgccctccttcctgtgccctgtccctgcccagccctgacccctagcaactactggtcttttctccatttctaaatttttgtcctttaaagaattttgtgtaaatgaaatcatacagtatgtaaacttttgggattgccttttttttccttagcataattctctgaagattaatccaagtcattttaacagttcattcttctttttttgctgagtaatatcccctggtagggatgtaccacaaattttatttaactacttgcccattgaagtaccaagttggttcctgtttttgctataatcatttctgtacaggtttttgtataatcatgaattatatttgtctagtttaaaggctcaagagtccaattgctaaatcacatggtaacggcatgtttattttataagattgcctgattgttttccatggtgtctgtacccatctgttgcattttgctctttttcactgtggctattagacaatttaaaattacatacataatttttcacatttgtaataatttttcacatttcaaaagaacagcacccagacagttcttgttctcaagaacaggacttgagacagtcctgttctccagtaccaagctcttaccacctcaggctttcccaggtgcctcgatttctagctggagtgtgttctcattattcccggacagatgcacagacttctacagcacagtgagtggttaaaaaaagaatctaaaactaagcaacctgggtttggatgctgggtctgtcccttactggctctgtgatttgttaaggtatttaatgcctttgttcctcagttttcttatctgtgaacagggtgactgtagcagtactgatgtcattaggttggtttgagggttgagtgagttagtacatgtaaaattgggtcccattgaaacccttctaaccctttacccaagagtaggtttaaatcctcatat

SEQ ID NO: 28120 - DNA, 1029 bp, Homo sapiens
actagtcaagaatcatataatttaaataactaaaatcaaggcaataaaagtcaaagttaataactgttatttattaacagttatttaaggacttgtaccctataaacagaaactatacatttttcaagcatctatgatttaccaaaatagactagtattagttaagaacaagataataataataaataacagaaatttcaggaattacataaggtcacaacttaataatacaaaaaaaataatcttttcataaaaacattccccaaaaatattaaaaacaaacaacaaatcaataacaacattaaaataagcaaaccatttgcctaaataactgttgtgacaaaaggcaaactaaaccataactgtaggccatttaagaacctactaaattacagcaccacgtttcaacactgatgtattaccaaagctcttcttagagacaaattcataggctttaacagtctattaaaaagaagtataaaagaatcatgtctttatcacaggaacttaactggactacaataaagcaaagatgaaacttagaaagaacacaaatttaattgcattagagaaattggaaaatcaacaagtaaatcacagaactaatatttttaaagaaaaaaattcgttactattttaaaaggaataagcagcaggaaaaaaatgagaaagaatacaacacgcagaaaatttttaaaaaatactgagggtaatgtttaagaaggtaattgcaaatttctagaagaaatgctagcaaatgtaatttgtataggatgttaaaacaatacttaataatgcagtactacattatcttagcaatacatagatgatttcaataatcaatttataatatttgactatatatagcagcattctatctctccatgtattcaagttttcttataggactcataaatatgttttaatagacttctggcaagtttatacttttgtgaaaattagaaagatttttttccattacattttttacctggttattgctggattggaagagtcacaaaattccac

SEQ ID NO: 28121 - DNA, 1030 bp, Homo sapiens
ggtgtctgacgggttttgtctgcggcttgtcctgctatattagcaattaaaaattaactgtaccatacagtcagttgactataccatacagtgtaccaacagtatacccccctgccccctgctgacatagtgaagacttgtgggaagtatcagaaagagaactggaattaaggaggaaaatcaagatttgtgactttagccaaatgtcttgggttcacgaaacccacataaaatggctcattttgggggatattgtgagaattaaaggaatagaatatttgaaaacactttggtacatttttctaggcagaacagaattgagttttggggagggtgtcttgagttaaagatggtgatgaaaataatgagtcattgaaatagaaggaaacatcctaatttacagtcattaaggactgccatgaaattccaccccatgaaaatctgaaatgggtatatataccttcaggaatgtgtagcttgatcatcaagagattcaagtatactgccacaacacacttatagtttagaccatgatcgtgtggtagagacagttaaaaatatttaatctctcttattctcaaataatgagtataggaaacaaataagaatttaaatatttctgaagatcatcatgaaaatgtctagcatattttgtaaacaacaatttcttggattattagatactttgctgtttgcttttcagtaggcacaaacatattgtgagatgttctgtatttatgaagttacaataaactgtgaaaataacagaatgcattctgggtaagctaaagcagtagtccagatatttcattaaaattcagatccatactttgggttgtattcttattcaaaaatatttttaaaaatattattgtaagtatgtttcttatcgccaatttttaattttcatttgtaggttgtggaaaatgcactagaatcaacaaacatggggactaattcaactcggatatcatgtcttcagagaagtttctcctgccctcctctccctgtagaattaagtattcttcca

SEQ ID NO: 28122 - DNA, 1054 bp, Homo sapiens
agttaactttttcttcattaacttcaggacttttctataaggaaatacactatttgctcattttgctaataacatctgtgtctatttcttggatatcttattttctgtgatcacatctttataagacacttcatctgggtgggttttggtgttttgtttttgtttttgttttgctaaatagtcacttttcctgtctcatgttaattgaagaggaagagaagcgagctgcaagttttatatgagccaggaggcaaaggaagatttccttatatggagtgatacatattattctatgaaggtgatgaaaatattcaccatggcaactgatctgccttacccataatgcaaaataccctatttgcatttattttgccagagaattctgaaattaggatctatgtagtagagaatatgaggaaggtaatatactatttcggttgaaaaggagaataatttttcttttgactcgtcaagtgcagtagtaagaaggggggaagagaagaacaaagagttggatctgtaactgtgaacaattgattgaaataattcactacttttagaccaaccaagaagaagaatagttttgaccagaattggaatttgaacgctcccccaagttgagtatgtctgtgtgctagtggagtggggaagggttgagtcacaatccagttcagcaaatctctgccaggatgtttactttttagctccccttatctgattttccattgtaaatttgtattaaatatttctgataagcagcctcaattcttgtggaagtttgagggcaaataaataatatgtacttatgggcaaggcattgtaatagttgcttcaggagatttaaatgagtaacacaccattctagtactcttggcaagcttaaatccagagggaggagtcagacaattattcgtgcagctatggtaccaggcagagcaaggcaggaatcatagcagatatgctatctgaaaatgtaaggtattctgattattccttccatgccttaactggcatctctaaaccatttttccttccaccttgggaacccctcatc

SEQ ID NO: 28123 - DNA, 1026 bp, Homo sapiens
tacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatctttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatct

SEQ ID NO: 28124 - DNA, 1071 bp, Homo sapiens
atatttctaaagcccttcttacggattcccgctgaataggtctagggtgaaatcagtgactcttctctcccagattatttcaataattaaccaacttagggagcctctgggtgcttaggaaaccctttgcagatgactgatttccatgctgaggcactaactaacgttgttttttttcccctgggcttcacaaaattgcagacttttagtgtggttgaaaaaaaaaatacctgcttaaaatttgttgtttaattttggtatactaataatatatcttagtatcagaatttgaggtgatctgcgaaaataccgaaaacaatttcttagaagattttagctttccaaaagacctgaagagtattccgtcaaagtctttttaaatggctagtcttctgaaatgcctagtcatttacaagtcatttctatgtgtgattgtattagctgtaacaaatggctacaaattgcttgaagaacagaaatgtgttatagttctggaggtggaagtccaaaatcaaggtattggcaagattggttccttctgagggctgtgagggaaggatctgctccagacccctgtctttggcttgtaggtgaccattttctccatctctcttccctctatgcatgtctaccaccgtgtgtacatttccatttttttaaggacaccagtcactgaattaggacctacccatataagcgcatctcaactaattgcgtctgtagcaaatctgtttccaaacaaggtcacattctgagattctagggaatctgagacttcaacatagaggtgtcccatagaggatggggacacctcaacccgtaacagtaatgatgactgcacattatgagagggactaataagatagtgtgcattggtataaaacatgtacccagagggttctctgtttaactttcaatggcataataacagtatcaacacctaaataactatgccaacatagttatttcatgatcctcaactgcctctgcctaccccaggaatatactatctttatttcaaatatgggtgactttgttaacttcacatctgcttgtcaagtgaaaaagtag

SEQ ID NO: 28125 - DNA, 1005 bp, Homo sapiens
tatttttagtagagatgaggtttcaccatgctggccaggctggtcttgaactcctgacctcaggtgatccacccgcctcggcctcccaaagtgctgggtttataggcgtgagccatcacgcccagccccagctgtacttataaatgtaacatatatgctagtaattcaagtcacagatcaactagaaatttcctataaaattgactttaaccccaattaaataaaaaagggggcctgttatttatactcacaaaaatgagaactgaggcagttattgagattaaagaaaaaagatagttgttgaagaatatagaggttttgcttaaattatattgcttacttcagagtttcctaggataactactcacctctcatcttaattttttttaaggtaagatgaaaaaatcttgttattcttccaaaacatttttgaagatttttgattttttttaagttgtcaaaatatgtaacatatgctgctggttacttaaaaaaaaattctgaactgtaggaaaatagtgtaataaactcaagtaaaaccaagagtttttattcagtggacataggagaaatccacaaatctatttaaatagattgcacagtgtcaacactatcaaacaatttctagcatcaggacaaaggatattgttaagcggttcttacaaaacacatacagttagaaatgtaattaaagtgattctaagtttgaaaaaagataaaaataagtaactctaagtagaaataatgtcaagcttttgattcaatagttagctgaagttaattcatttcaagatagcactcgtctcaaattatttctgaatcagaatggttatctattataaagtaaaaggcttaactgctataaagcctttgaaaatgtacatgaggctgggtgcagtggcttacacctgtaattccagcacttcaggaggcctaggtgggcagactgcttgagcccaggaatttgagaccagtctgggtaacatggtgagaccctgtctctca

SEQ ID NO: 28126 - DNA, 1059 bp, Homo sapiens
cttttaaaaagctttaccgtggtatatctgtttcttgtggattctgtttttcttgtggtttttgtttgtgttgtttttaacctttcccaagtatctaattatttttgcccatcttttcatatttaagaattaatcactttaggccaggcacagtggctcatgcctgtaatcccagcactttgggaggctgaggcaggtgggtcacttgaggccaggagtttgagaccagcctggctaacatggtaaaacctgtttctactaaaaacacaaaaattagctgggcgtggtggtacatgcctgtaatcccagctacttgggaggctgaggcacaagaatctcttgaacctgggaggcggacgttgcagtgagccgaaattgcaccagtgcactccagcctgggcaacaaagtgagactccatctcgaaagaaaaaaaataagagtaaataactttaaagctaattaatgcgaagttctgaaggatttgataactatatgctgataaaacgaggcattgactatttcattaaaagaatttcaggccaggtgtgttggctcatgcctataatcccagcacgttgggaggctgaggtgagagggtttcttgaggccaggagtttgagaccagcctgggctatatagccagactgtctccaaaaaatagaaaaaagagctgggcatggtggcatacaccaatatcctaggaggctaagctgggaaaattgcttgagctctggagcttgaggctatagagagctttgatggcaccactatactccagcctgggtggcaaagcaagactgtctaaaaaaaaaaaaaaaaaaaaagggcaaagaaaagagtttcaaacgtgtcaatatttatagatctttttgcagatacctgtcagcagtagaagataggggtgagcatttggggtaggtgtgtatgtgaatactgtgttgtggaactggaaaaggaagtagagcagggaggaggtagagaaggtggagacggtctcactcttcagtttataggcttttattactgggaattgttctctcagtgtctgttcgtgtctc

SEQ ID NO: 28127 - DNA, 1028 bp, Homo sapiens
gcctcaagtgatacacctgcctcagcctctctaagtgctgggattacaggcgtgagccactgccactggtccttcaacagattgattctaattagccaatcaaagacaaggatccatcacatctaggcatggctttgagcttcacaggccagaagctgctctgtcagtaactcagaggggatatggtccctagacccaattcacttttaataaatcagggtgccagtcctttaattttggaagataaataaaattgcgaagtagatgggatacttacgtcaacaagttggttgggtttcatcctgtaagagtattgtgtacagaaatccaatttgctttgggagcgtggactttgaaagcagcagtactgagtgagatggccttaatgatggatgataatgaggttgatgctttcgtagccacgtttccatctgaaaaccacgtgaagagtgtcagatcatcttcatgtccgttgcatggcgcatttctcctgcggagtgtttgacaccttctgggcttagtgctgactgtccctcctgttgacatcatcgtgatggtagccacctctggttttaccagtactttattgcatctactgaaagagcaacgtgtatagggaagtaaaacaatagttagtccccatttgtattgacattgtggatcccatcaactatagccagcagtggtctctgctcccagagcttaccttcagttgtaacaaacatctacagcttcactttgctttccttctctgtatctccttcaccaatgtgtacatattcatgtcacatgctctttaacgtttctaagacacaacaatacccattattaatctcttactcaggcagtgttaattccaataagactgcaaggcagcagtgcctccagagcctgcactgtgccgggaattggcactgggattgcaagcaccgtggtcattgctaccaagggaggcacagaatcccttcaccccatagtcacgggagcattggcaacaaaatttaccatgccttggcaatttatgctga

SEQ ID NO: 28128 - DNA, 1513 bp, Homo sapiens
actgttaaatgcttccgatcaagagagtgatatgataaaaatggcataactgggagatgaatctagtactgaactcccacatcgattagagtgagttggattggaggcaagaacttgggtgctattttatgtatttatttctaaaatctataattctatataattaggtagacctgtatgtacttttagcacttttcatgttttctaagtttgaattgttgactaaaaaagtgaagatttgatgtgcagctagatttgtcaaatagccttccaaagtggttttggcaataatataataatgtaaatagttgagaatgcagttgtaatcaattttcatttagctgatacgcataggaaatcctggtgtggaaaatgtacaacagtgtatcactttttgtatttggctttgaagccattttggaaattttctaactcccttcaggaggttgttagaattatttttaatttttattagagaaattatcagtttaatttgcatagactgcagagctaagaaaggtagcttagaagggaagcaaatcagttttctgattaaagtgctgccattatttcacatgtatgtagtgaggagtcaccttcctaagagtatcaagttctgagactgttcaagatctgtgtaagatgaccaaggttctctcctgacctttacatatattgaaaacctcttaagcttgctaagaatcactttcctatgctatgaaaaacgggagataactattctatctacttgagttcctgttgaaaattagatgattatatgtgattggtctttgtaaattacaatgtgatagacatgcataatatacgtggcttagttatattactgtctcctagagaaatataagacatacttttttttttggtcaagctaactttatcttgttttctagattgttattttgtgtcagtaagtaatccataaagtgccaacatgggaaagaaacggacaaagggaaaaactgttccaatcgatgattcctctgaaactttaggtatatttcattgattgaatctttaatgtttatatctctaaatgaatatgttttaaaatgtaaaaatggtataaagctgcatattattgttatattatctgcattttaatataatgtttgtatctatatgtcatttaatagtcttctacttttttttttttttttgagaaagaatctcgctctgttgcccaggctggagtgcagtggtgcaatctcagctcactgcaacctccgcctcccaggttcaaacggttctctcgtgcctcagcctctgagtagctgggattacagacacatcccaccacagccagctaatttttttttttttttttaatagtgacggggtttccctgtgttggtcaggctggtcttgaactcctggcctcaagtgatccgcctgccttggcctccaaaagtgctaggattacacgtgagagccactgcacctgactttctacatcttttttgttttttttcctgagacggagtctggctctgtt

SEQ ID NO: 28129 - DNA, 1055 bp, Homo sapiens
gccaagactgtaagactgacaataaagtgaaagataaagctgaagaagaaacagaagaaaagccttcagtttggctgtgtcttaaatgtggccatcaggtatgcttacgttttaagatcaatatgggattttagaaaactctttgaacttactttagaaggtattacctgaaagtacagtatggataaaaggatactagtaacatagatcatgttctctggagaaccagttctgagatgtgtgtataggtggtggagtgttctctggtaccacaccagtaaaagtaagggaagcaagattaagcatagggagaagttgaatgaagaggcagtggcaacagggtctcagccaatcccacagtgatctcttgcctgaattgaggcaaggagctagacctttctacctgtgcatagaccagtcattggatgtggcctgcccctagagcaggaagtaaccttgggcaaggcagctcccttttgttgagactgattcctggggatggatggactagactgtgagctctcagccggccacattctcagcacctgggggaatgagtagtaccttgatctttggcagtgagggcatgtctggctggcacatcacagtatctactctaccagctcacagttattaccgtggtactaaagtcagggtctctcagttacccttagtggtggcaagttaagcttatatgttaggaaattgggctactaggcagtagtcatgaagtcatgaggcttcaagatcaggcagatagccagttttttgttgtttttttgagatggggtctcactctgtcacccaggctggagtgcagtggcacaatcttggctcatggcagcctccacctcccaggttcaagcagttttcctgcctcagtctccaagtagctggaattacaggtgtgtgccaccacgcctggctgagttttgtatttttagtagagacagggttttgccatgttggccaggctggtctcaaactcctgatttcaagtgatccactcaccttggctccctcaaagtgctaggaatacaggcgtgagccactgc

SEQ ID NO: 28130 - DNA, 1029 bp, Homo sapiens
ctattcagatgtgcatggttctttgtgggaaatgtcagcactccttaaatcttgaagacgttaaacagtttgatttatttcccccaacccaaagtcctcaatgttgtgtaatttttcatttcaaattttcttaagcctttgtttattttaaaacccatcccctactccccatcccacagggcagggaggatcttactatgtaacatttacagtatttacatttttacactgtcttttctgattggttaaggtctccttggttcatgaatctttccttgatttgtccctcccagttttagatgatcaggtaagactattgaatttattttattcaagtagattttttttcctgtaagattttgtggggggaagccttgttactctttttaagtttgtatattactagcccatgcagaaatttttcttaatttgaggtagaatgcattttaggatttgaataaagaacagggtaactactttaaaaacaaggatggaaaaaaagatgatgtattcagaattctgtacaagtaattagtttgattggtttccatacagtgaagtattttccttatattaaaattaatacttatttttgttatttaagactaatcacgaatcccttgcacacctaagttcataaatgttaaagagtattattttgttttaatttggttccttttaaatagtagtaggaaaaaagaagagatgttatgagtattggataaatcattcttcaacttcatatgaattatgagacccttggcttgttaacttggcaattaaagtctcaccaaattttattttctgtttttctgaaactgtcatatgcatgcaaagaaagaaaagaataaaaaagaatacaccgtggtgacttacataagtcacttagaaaatgtatttggaaatggacgtatttacagtgtgacacagcatgtatctaataaatttcgttatatttctattacacttacatgtgatgttgccttttgctgttttgttggtttgcttgttttctcattatgtgaagat

SEQ ID NO: 28131 - DNA, 1077 bp, Homo sapiens
atgtggttgaatgttaaggctggtgaacataggtcaggagtggtatacacttaacccagcatgttggtggttcaggaatggctttgtaaagtaaaccatgcctcaactatatttaaagaaggagtaaaagtatgatgaatcaagatgaaatgagttttgcaggcagaaggaacagcaggagtaaaaacagcagtgtaaaataggatggtgattgccagagactggtaacgtatgtagttctagagtttatagtacaaggttatagggagagttgagaaatgaagccagagaagtgagataggaatgaagttttggagggttctcatggtgaggaacttggacttcattaggtatacagtggggagccctgaggagtttaaagcactggggtggcatggtcagatcttcatatgacgtaggttacttgttgatgtatgaaggctgaattttaggacggaaagactagaggtggggaagtgagtttggaggctgttgtattaattcagccagtagttgatgagggcttaaagttgggcaggagatggggagatagaaggaatatttcaggaggtagaattaaccagacttaatgattgattggcactgtaaggtgaggcagaggccttttataagtggatgctgagggtggcagagaaagggttgaggatgattcctgaggcctggcacgacagatgggagtgctgtaaattgagataggatatatagggagaaaagcaggttgagaaaagcaggtagagaaaggataatgacttcagttttagatacatttgagtgtcagatacctttgagaaattaatgtgcttagtctagaaaacatttggatatacatatctgagacctatagcagagaggttaggatgggcccagggcacagatttagaaatcagtacatatgtggcagtttaaactatgagaagatgggatcccttgtgtatagagtctgaagagagaaaaaggagatggccaatgacaggaccctcctaagtatctgagtggaagaggcaggggtagaaagtgaggacaccacaaaggatctcaaagaatctccatgttgaa

SEQ ID NO: 28132 - DNA, 1054 bp, Homo sapiens
tgccttctacacccctgtactgtgagaggtgatgctcagaataacagttgcaaagcccgttaaaattaccacttgtcagattttctcttcatagtgctgatctctccatgacttacgttttaggaatcaccacctctcttctaattttctgactaatgttctgttaatgagagaattgtcttaaccctaaaacctgcattccctgagcattctagacagagggtttattttatgtggtggaacgatgatttttgagattgttttgatttaaaatatatgtcaaatgaggtaatgtaccgatggccaaggtatgggtaatttgagtgcaattcgccagaatccgtgccccttggagggagtaaacatttcaggactgcagctaaaacattgacttacactctcctgaagcccaggcacctggcttacacagtgcactaacataactgaagtctgggtttgatcactgtacagttgacaaagaagcagtaagcagaatggttaaaaagtagttctggagccagactgcttaaggtcaggttctggttgtgtcacccactttaaagccttgggcaagctcttctacctggtaactagtgcctcattgtttcctctgtaaaacaggggtggtgatagtagaatctgtatcagagaggttgttgtgaggattatatgcgttaatacggggtaagtggttagaacagtgccagctttataagaaacatcaagtgttaggtgttattatctgttgttcagaatcagggaagtacttagttacacagtagtgttttatagctgttgagagctgaattgccggcattgatcacaagtgagactggaaaaacaacccggggaacactcttatgttaagtcagtagcaccatctcaaacatacatccaacttctgagggcaacgaacacaggacatagctttttacttaaaggaatcttaacagtctcagcggagtgcttgaggtagtcactaaccagttaattgaaactggcttttacgaaataaaaacacttgccattctttggctagtcttttccacgttgt

SEQ ID NO: 28133 - DNA, 1057 bp, Homo sapiens
cccaggggcagcaaatctgtaagctagctctcaacccatgagatgatgtgttactgaaaactgcctaaacagatgttgagccaataattaattctctggaatttgaggtgagtagtcagccagctggtggcaggatgagaagcggtgggccacagatgtatgtagttgactactagcagctctagggtgaaggtgtaggaattatttgtgtggagtcaccttgagattcaaagaacctttagatttccgtttctaaggcccagagtcattctctttctgaagctcaggtccaattttttttttcttgctctctctgcggtccatatctgtattctcaagcataaccttttagtcatatccagctccccacattgctgcagtgaatctccatactgtgcgttcagctagtactaactggagacagaatgatggagtagttaaaaaaaatgtctggtggcaattctccatctttgtcttattggtcttttgatgttggccaagatacttcttactgagccttggtttccacatctgtaaaattgggatgatagaggagcatcacagggctgttttgaggcataaacgagagaaactctatctagcacttagctcagtgcctggtgaagaattacagcttaataatcttgccattgatagttaacatctttaggatagtctctggagagacttaaacgtgttcattaacaaacattatgggaaggagccagcatagagggagaggttggatatctatgagacagggtcttaagagaaggtattggatcccagagaagcaggcatggcacgggattaagagaatacattacagattgttttcaacagaagagggaacctgatggaggtggtaggaggactgttttttctgaggttgggtcccagtcatggtgatttgctaggagagatgctgatatcaggaggagaaaagtggcaaggtggaaagctattatagagaacaggagacagggacataccagaaaactggtgaacagtaccaagagcctgcgactgcacattgtaaatttataatgacaccagt

SEQ ID NO: 28134 - DNA, 2034 bp, Homo sapiens
gggaggctgaggtgggtagattgcctgagcccaggagtttgagatcagcttgggcaacatggtaaaaccccatctctacaaaaaatacaaaaattagccaggcatggtggcatgtgccagtagtcccagctacttaggaagctgaggtgagaggatcgcttgagcctaggaggttgaggctgcagtaagccatgattgtgccaccgtactcctgcatgacagagaccctgtctccaaaaaaatatgtgtagatcagtgcagatatccttttgagattgtatagaaattgggatagaggcctatgttttctttaatgtaaaataagttctctgaaaaacttagatgtataccttcatcttcctaggtttgactataattataaaatacagcaataattagtaatatttatttcatattctaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctggtaagtgtaaaagtttcttgttactatttaaattccaccactttcttttttgtcaaggaaatagtttttaaatttctaggtcagatataatgctcaattacttattttaatatgtatcaattaccattttatcatttttaccatgatatgctgtgatatgtaagtgctttttaaaaagaaggttttcaaattaagaatgactttactgtctacctaatcattagtggttgtgaatagattcaagaaattataaagcactttaggttctctgttttgtgtctatagaagttaatattccaggtgttcatttaaatgaactgtggacctgaataacttgttttggttgataccaaaaccagaccaaccaggatctttcatctaaggaaaaaaattctgatagatatggtgatatgaattgaaaatattaatatctaatgggatcctaagtgagaacaatgcttgcttttgaatcttttctttttcttttttgagatggagtcttgctttgtcgcccaggctggagtgcagtggtgcgatctcggctcactgcaagctctgcctgctgggttcatgccattctcctgcctcagcctccggagtagctgggactacaggcgcctgccactgcgcctggctaattttttttttaatttattttttgtatttttagtagagatggggtttcactgtgtgagccaggatggtctcgatctcctgacctcgtgatctgcctgtctcggcctcccaaagggatttcaggcatgagccaccgtgcctggcctgaatcttattttctattccagcatcaagacacaaattaactgaaaattgattagtttactcctctttcttttttccgttggtggaaggaagcattgtatgaaagaggacaactctgatagtacaggccagctaaagctaagatatggtaaaagatagcaaggaaacagcctagaagtagtaaaaacattgcttgaatattcaattttgtgtctattaattgttgaaagtttaaaagttgggattgtggcaagttttcaagcgtgaacattctagctatgaatggcaattaaacagcaacaatttagggaaaaaaattgtgcctccaggagaagttgaaaaataaaaaattattatttatatattgtacatatactttgtgtaaaaagataaaaaatcataactatattaaagagatgaagcataactaaataaaaaatagaggaactagatgttttacaaatagaggcatgagagatgttaaaaaaaaaaacaaaaaacccaaacaccgacatgatattgctgaatagttaaaattgttaaaaccaaggaggaaaagttttcaattctatagtacttagtacttttagagtgtgtatcagtaatacctttaataaacactggtg

SEQ ID NO: 28135 - DNA, 1032 bp, Homo sapiens
gaaaaggtgtttatttatttggtggaaaaatggatggtattgactttagcatttattttgaattttatagtatgttagaggttaagcattaatttagcattgcttttattacaagaactgaatgcgcataatgcataagccagtaacatgactttggttttttttgttattttttttattttttttatttttttttttgaggcagagtctcgctcttttcgcccaggctggaggtcggtcttggctcactgtaagctccgcctcctaggttcacaccattcacctgcctcggcctcccgagtagctgggactacaggcgctggccaccatgcctgggtaatttttttatatttttagtagagacggggtttcactgtgttagccaggatggtcttgatctcctgacctcttgatccgcccgcctcggcctcccaaagtgctgggattataggcgtgagccactgcgctcggccgacttttaaaactaacaattataaagtctttggattcagcttctgttcagtgtttaacttatgaagctcttgtctatgtagctttctttacaaggtccaagtttattcttttctggaagattaattcagaagttagaaaatatacatatctctgataaccattttaacctcagaggtaccctgaaatgaagggagcctcgctttttgcagaaaaatatttaccaaaatgtatttcttttagaaagtatcaaatattgttttcgatatcaacttgtaagtgatcagcaatcagaatattcacaaacacttgcgctcagggttgaggtgttcagacaccattttatttcattacttttgtccattatgatggcacagaagtaaaacgacctcatccgtccttagtgatttgcattttgtggtgaagattatattttattaaaaataaacctgtcctattcacaactagtcacaatttactggctgctcaaccaaagcgcaccccagtggcccttccggaacctgccctctgtcattccgtgttgtcgttgagcagcatttc

SEQ ID NO: 28136 - DNA, 1041 bp, Homo sapiens
atgtttgaacagaccaattattaggcaattttcttaactgcttctacaagagtttccttatcacttactgaatacccattgtgtcttttttccttagtagttgaggaggaaccgtatattatcctgtcctgaagggagttcctcctagatctggtcagacctttgtatggtaattaattaagatttagatcccctgttaggaaacctgctgggttaaggatttttgataggaaggctatgggttgtcagtggcttcagtgctttcgggctacgcccttgtttacactgacaacaaggtgatattggagtgttacagggttacagagaagaccttcaattatcaattataggttttaaatttaccctggcttttaatggaatagggtacactgtttttcctttactacttctatctctctctttctctctctttgacttcttctttgtctctttctttctctcttcctttctgttgcctctgccagctgcttatgttgctgttttcccctctccttccccttttgatggctttggcagtgtaagactgccacctccttgggtttttacactgcatgcaataactccatggtttctttgtgatatttaatgggcgttcccccagaggttagtaactccctttctttccatattgcagcatgggcatgtaggattagataagcatacttgctatctgtatacacatttattcttcttccctttcccagttctaaggctcgggtcagtgccactagttctgctaacggggcgctggtccctgggggaagaggcttactttcaagtactgttactgtggcataacctgcccttcgtatcccattctccacaagtgaacttccgtcggtatataggttaaggtgaggattagctacggggacttctaagagatcatgtcaggcggcctaagtctggactacaatttgttggcagtcacgctcgattggttccccatcctctgggagaaaagtggcagggttgagggccacgcatgtacatatttgaagcaccagtccctcaatgagt

SEQ ID NO: 28137 - DNA, 1048 bp, Homo sapiens
cttgaagaatgactgacagcttccctaattcttgtccccacttccaacttaggaccaaccagagaaatgcaaatatgcaacaggatgccagtttctagctaggcggcccacagcttccccatgccagctgcctgcaatcaaggcacatgagaaggcttcccccttttccactgtagggcttttccactctgcctgcctttgagttcttggccaaaatgcaactgatggtggccgactcccttgttatagcaagccctgaataagtagacttttcttttctcctttggtttatattcatttagtttccacagaaataaattcaattacatttagataatcaaaataatagtaaaggccgttagcaaaatggcaaaatggagaggaaaaataagaatcttgtattccgtaaaagtttaagaggagtttgtttttcaggatgctttgaatctcctccatagatcacttctccaatttttcctgtcaccacagaaatttacaatattaataaaacaactcgttaaaattttgaactttgctactttcaaactgaaaactttttgaagcttaaggcagttatttctgcaaaagatggcttcaggtttattaatttaaaagaatgcaggcagtttttgaaatattatcatctaagtgacttttttctacatttataaatactctactgtcccatcataattaaaagaatatgaaaagagtttgaaatatacttatagcttaaaacatggaaataattctttttaacatgaataattatcccaccagttttataatctaataaaaatcaaagtaaaagaaaaatgctaggcattttaattatgagaaatcatatgtattctgggaacttagaaacgttacccacatatttgtactccagaatcctcattctagaaattctttcctcaaagatgttgcaaagaagtggagcgcgtatgtgtttttgtcaacatgacctaaaacttataaagctctatatgaagcatacctgttttcaatccaaatttaacggtaatttacttcacatttgaactgg

SEQ ID NO: 28138 - DNA, 1045 bp, Homo sapiens
ttatcagcctaagaagcttttgggctgcccaagcccccttttttttccctccttagtcataaaggaaaaaacgatctagatttggcatcttccatagaaaagaggaataggtatgtttgcctttctcacatggacagtcgaaggcgagtctttgtgggtagtcccatctaaagtgtctaggaagctcctgtggacatggtgctggcgtactgaagtgggatcttctactcctgcttgattttctgaccttctgagagtgagatggtaaaaactgaaatctccagcatggtctgccactagaaccttcattcttgccctgcctgccccacagtgcttaaaatattagaacaatattgctattgctcaagaaagaaccacttctgctagtgccagtgactcgctgtttcttgaaggagttacaagctttgaaaacatgcaggaaaatgatgaggtagaaacattctgatcacctcaaaacagtacctgttcagtagtgaagccacagcttttttttttttttggttattagctagggcagactgatatggacattcaagatgccattcactttatttggacaaagctgggtggactacagattgattttcacaattccactccacctaattcatgatgagaaattctaaagccaggtatggtggctcacacctgtaatcccagcactttaggaggctgaggcaggagaaccacttgagcccaggagtttgagaccagtctgtgcaatatagcacgacctagactctaccagaaaatcaaaaaattagctgggtgtggtggtgtgtgcctgtagtcttagctacttgggaggctgaggcaggaggatcctttgagcccagaaggttgaggttgcagtgagccctgatcatgccactgcggtccagcctcagtgacagagcaagaccttgtctcaaaaaaaaaaaaatttttttaagtaattagggtgttattttttgcctgtataaagtgttttagcaagactttggagggggtgctgtagggggtgttaactgggtaccctttaaac

SEQ ID NO: 28139 - DNA, 1035 bp, Homo sapiens
gctggagtgcaatggcatgatctcggctcaccacaacctctgcctcccaggttcaagcaattctcttgcctcagcctccaaaatagctgggattataggcatgcaccaccacaccaggctaattttgtatttttagtggacatggagcttctccgtgttggtcaggcttgtcttgaactcccgacctcaggtgatccgcccgtctcagcctccgaaagtgctgggattacaggcatgagccactatgcctggcagaaaggactttctaataactttctattgtctttaattttggagaagtggctcttcctcattgctataatttaaatgcatttgttacagagcaagttttctactcataggctgcctcttttaagggaggcaaagggagcttcctttaatcatcccattatgagacaattcttttgacttaaaatttgctgcaacctgtgacctgggaagagaccatctaggcaccactgtttatcttctaccatctcatttctagtccagccacccgggagtgaagtgatctgaatctctcaaatgccagttgcttctttttaatcttgtcttctaggaaaacaatttatcctcctattagcaatataaattccagtgatctatccttggaaaagcctattcaaacataaaaatactgactttgatctgataacaacttcataagtatatactaggattccaatttaaattttggcttgtgactttttgaatcagttccttcctcctctatttcttaattagtagacccatgagaaatcaaaatggatgaaaggaaggggagatatgtacagttgctgaatgataggataacttaatagttcttcttgcattaggggcagaggagctgtgaaagagaagggcacactttccttaaatgcctgctctgtgtcaggaactatattagatataactagttggttccacttcagaacactgctagacctgaaccaggacctactgactcataaaagtttagagttggaaagaatctcaaaggtcatttagtccagc

SEQ ID NO: 28140 - DNA, 1036 bp, Homo sapiens
cttcagaactttactccaatgacacttttcctatgaagctttctgtgattcttccatttaaaattgcaccctccccacactttgtttcatttccctactttattttttgtcattacacttatcaccatttggtattcaatatatatttgttgatcatctactgtgtgctaaggatcattctaggtcccagggatgaaaattaaatggaacagtcaaaactctatcatgatagaatttgcacatatattactaatttatcttgcttctcaattgtttcccattcactagaataaaagcgttgtgataacagggatgctattggttttgttcagtgctgcatcgctagtgcctagaatgcctggcaaatagtaggctcttaacaaacaccaagctgttgtctctttttttttcctttttttttccaaataaaaaaaagcaatccttgctccaagtgtggaatagattgctgcagtgtcatactttagaccttgagggaatctgcagcctgtgaaaactgaagacacaattgaattgctaattaaagatcggaaccagttcaattctatgatcctctaaggaaaggattttaagtggtgaagtagtattaatctcactttccagactacttatcatggcagagcaaagttctccttagccccttccaagacctttagaccagcctgagagctgagtgatgaggctggctgctccaccaattgccccttccttaggggacatgtcttttaacacttctttctagaccagtgcttcccgaaatatagtctcttgactacctgcattagcattgatcaacttaaccactgaataagaatctctggaggtgggcttctaaaaatcttcattttttacaaactctggaggtagttggttagaatttgaagcttgcaattatttgttttaaaatctgagttagtgcgtctggatccaggaggattaaattactgtacttgatggcagtatggcaggaagcatccgggggtaaattacaatgtccaggagaggattagaagctttc

SEQ ID NO: 28141 - DNA, 1040 bp, Homo sapiens
tgggagggacctggtgggaagtaatcaaatcatgggggtggttagccccatgctgttgtcctcatgatagtgagttctcatgagatctgatggttttataaggggcttttcccccttttgcttggtgcttctccttgctgccaccatgtgaagaaggacgtgtttgcttccccttctgccgtgattgtaagtttcctgaggcatgcccagacatgctgaactgtgagtcaattaaacctctttcctttataaattacccagtctcaggtatgtctttattagcagcatgagaagggactaatacagtaaattggtaccaggtagtgggatgctgctgtaaagtgcctgaaaatgtggaagtaaccttggaattgggtaacaggcagaggttgtgaaacaggagagttccctgacctccttcacaggacatgtgacaagggtgtggctctctgttcagccactgtgagggagggggagcacacagaggggcagaggcaggaactagggtgagcacttttgggctctagccccgtggcagtgtctaggggtggttgtctgtgactcccaaagaccagtggacacatgttacagtgtactcttttagccttgctctccaccgatagcttaagtgttaaccagctcagtggactctatgcctttttgcaagggcagagggccagtgtgatagccttctggatcctgagctcttgtctagcatcctggaagaattgggtcacacacagacttgaaggatgaatgtgggggttttattgagtggtagaggtggctctcagtgggatgtatggggagctggacaggggatagagtaggaagatgatgttcccctggattatggctgtccagttgccaatctcctctctgaccatacccagctgaactccttttgatgttcagatattccttctcttctctccttctctgctgtgctattctgccactcttctgctcctctgttcatctggttatggagtctggggtttgggatttatatgggtacagaatatggggatgtggtgagc

SEQ ID NO: 28142 - DNA, 1033 bp, Homo sapiens
ctagcttatccatgtcatgctctccagagagcaattccaccgtatccttctttagggacttaagaattgctgcaactgcttagcaagcccccagctgagcgtgagatactgttatgggttgaactgtgtttccccaaaattcatatgttgaattcctaacccttagtacctcagcaggtgactgtatttggagatagggtctgttaaaagaaaaaagtgattaaattaaaatgagcttattagggtaggacctaatccatgtgattggtacgcctctaagaacaggatattgggtccctgggaagaccaagtgaagacacagggagaagaggaatacctgccaggcaaggagagaggtctcaggagaaacaaaccctgctagtctcccgatctcggacttctagcttccggaattgtgagaaaatacatttctgttgcttaaaccacctagtttgtgctattttttttatggtatccctggtaaactgatacagatactattttctattctgtatgggcaccctcatttccacaaattgggaagtgtccgctggtttcttggtttcatgcttcgtgacgcttattgtactcagcttggagcttcacctgaaaatccgagaccagaggagacattctactccgtcatttcttctttttcttcccttttttttttttttttttttttaagatggagtctttctctgtcgcccaggctggagtgcggtggcgccatctcggctcactgtaacctctgcctccccagttcaagtgattctcctgcctcagcctctgtagtagctgggattacaggtgcgcaccaccatgccaggctaatttttgtatttttagtagagacggggtttcaccattttggccgggctggtcttgaactcctggcctcaggtgatccgcccacctcggccccccaaagtgttgggattacaggcgtgagccactgcacttggctccatagtttcttttaaccagcttacataaagatgtgagtgcaaaaacttgtgatttaccatgactg

SEQ ID NO: 28143 - DNA, 1297 bp, Homo sapiens
ctgaggagtttaaacccatagaagtgtattgtcacagacactgaaagattctttgagattcttctgtaactcttgaaatgtgaagaaggaaagaagacaagggcagtacagggttctttgaacagtgggattgtgggtaatttgacattgccttctccccttcagctctgacactgcaaacacgcaactcctgtacatccctctttctgctgttttcaccatgtgctgaatgccaccagccattcgaattaactattgcattccagctaggatctctgaggcaatgtcctcatagttatcacactggatagaattccaggtggaatctctgagaaaatatcctaatggttattgcgttggatagaatgtcatgatttcatgattgttttgctttgaaaacaaaaacttttaatctgcataagagcaggctcagggaggtgacaaagctgttgcctaatatgcagagagtgatgtatggttgagagcagagacttcaaattttggccctgctactcactgggtttgtggtcttaggctggttacttaacttctctgaacttgaatttatcctgtaaaatggaacaaaatattaatacctgctgattgaggctgttaggtggatcaaatgaggagtgcctatagagtttttagcagagtgtccagtacatgaataaaggaccaagacattaataagcatggggatgataatgatgatgcaaagaaatttagtgttttctgtgtggtctcagaaggtggagacagacctggtgtttgggtgaatagaactagctgagattggaatacttcccatgtggtgggtccccagcagagcttggcatcacttctctctcttagtcaggatattagaagggatttaagagaggggcgggattttcaaaagaagacatttatgtggccaaaaagcatatgaaaaaagatcatcatcactggtcattagagaaatgcaaatcaaaactgcaatgagataccatgtcacgccagttaggatggtgatcattaaaaagccaggaaacatgctggagaggatgtagagaaataggaacacttttacactgttggtgggggtgtaaattagttcaatcattgtggaagacagagtggcgattcctcaaggatctagaactagaaataccatttgacccagccatcccattactgggtatatacccaaaggattataaatcatgctactataaagacacatgcacgcatatgtttactgcagcactattcacaatagcaaagacttggagccaacccaaatgcccatcaatgt

SEQ ID NO: 28144 - DNA, 1050 bp, Homo sapiens
tagaacttaaagtataattaaaaaaaaaagaacttaaagtataataataatactaaaaaaaagaaattgtggtatatatataccatggaatactactcagccataaaaaggaacaaactaatggcatttgcagcagcctggatggaactgaagactattcttctgagggaagtcactcaggaatggaaaaccaaatattgtatattctcactcataagtgagagttaagctatgaggatacaaaggcataagaatgataaaaaagacttggggactcaggggaaaggctgggaggggcgtgagggataaaagacttcaaattgggttcagtgtatactactctgttgatgggtgcactaaaatctcacaaattactgctgaagaacttattcatgtaaccaaagaccacctgttccccaaaaacctatggaaataaaaaaatttttaaaaaggaattccgactcgtttccctgccctaaaaatcctctgaactctcccttttcatgtttccctctccaataacctatgccaatctctgatctttgtctccatatttgcttttcagaatgtcatatggttggaatgtcatatggtaagtcatcttttcagactggcttctttcacttagtcatatgcatttgagattcctctttgtcttttcgtggcacaatagctcatttcttattggtgttgaatcttattctactgtttgtatgtaccaaagtgtaataactcctacgcctactaaagggcttctcagttgcttcccagttttgacaactttccatcaagctgctatgaatatctatgtccacattttttatggaaataaaattttaactaatttgggtcaaagtcaaggagcacacttactggaatttatagtgacaatatgctcactttagtaataacctgccatactgtcttccaaattgttgtaccattgacattcccaccagtcaatgaatgacagttcctattgctcctcaacttgccagcatttggagttgtcagtataggatctttttttaaaaggaaaagaagaaaaaa

SEQ ID NO: 28145 - DNA, 1074 bp, Homo sapiens
aaggagaactacaaaccactgctcaaggaaataaaagaggatacaaacaaatggaagaacattccatgctcatgggtaggaagaatcaatatcgtgaaaatggccatactgcccaaggtaatttacagatttaatgccatccccattaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagttgtttattttttaaagaataagaaactgacaagtctaaaaaactgcccagttacatggtttaaaagtagctctctcattttgcattcctgccaccaaggtatgacagttctagtttctccacatccttaccagcatttggtggtgttactattttttatttttattgttctgataggggtgtattgacatctctacatctcttcttggccttataaatattctttgaaaatgttttttaatagctggtgctatctactactagactttatttgaaacctaaataggtgagtttttaaactaccaccataaccaataacagttattacctgttgaatgacctttcaacaattctgttttcactgtactcacttactgagctttatgaactggccagggaaaatagcttacaggttgtctctttatttaaaataagtcattcatattttgcccttgtcttatccactctctcataggcttgcagagagagagagagagagagagagagagagggatttaattaaaaatgagtacatctgaggctcctgctcagagatcccagctgaagtggctgtgttgatttt

SEQ ID NO: 28146 - DNA, 1051 bp, Homo sapiens
gacttcggcagcaatgcaagtttaccacatatactggctttctggtctatctcaacatgtcttcccaccactcactttttttttttcttcatttttggcccatactgaggggttgccagaatattttctcttatttttttaaacaaattcggttttatgtcaagattactaaaattaattttgacatggtattgcccatggtaattttgtgtatgttacaattcataataaattaaccagagtattttttcacaggctcctacccactgcatatttttatcatctaacacatagaaaatgtgtcagtctgttagattcaatgcaagtgctcagagaagtctttgtaactgtactttagattttgagaattcattcatggttccaatacatggcattttacatgtaacatcgcaaatgggtttcattttaagcattctttaaatatggagcttgtgaattacaaaagaatcttttattttacaccagaatacttcacatcttatggaaactcatcattgattttatttaaaagaactagtttttcaagaacacctaaacatttaattatcattaaatcaattaacttgtaacctcaggattatctaactatcaatctggaatgtccagtcaagacaatgaaatattaaacatatttaaggggttataaatatgtggagggaggaactaagtgacagtattgaaaactttaaatatatggggattacattatattaatgtatttaattggtatgtttattatatatggattatgatatattattagaagtttaaataaacacaaaaaatattaaattttataaaagggtaaataatgaggctaaatataagttaaacataaaatatttgattagcttttcttcataaccctataagtacttaggttacatagtataataaaatagaatgtccatgtgcataaatagcacaaatctgcaattagtagaaatgacctgaataggccaggcccagtggctcatgcctgtaaccccagcactctgggaggctgaggtggacagatcacttggggcca

SEQ ID NO: 28147 - DNA, 1653 bp, Homo sapiens
gaataaagaaaatcatttcatcaagtgttaacattgatattgttttggttagtgggagtacggttgattttttgtctccctttttttcctgttgttttccctaatgagcatatatcactttgagaatggacaaaacaagaaagttttgaaacgtagtatactcacacataatggtttccctgtattgatctacataaatgtgtgattttattaagcggaagtctattagtacaaaaatctacttcctattacagtttgtcacttcaggcagttattaaggtctttcccaccttaaagaatataaacctatttctttagttctgcagcctaagttaaaaggtgaagtaagtgctaacatttctttttttaagaaagagcatcaatttcagcacagactttccacctagcactgaaaatgtcactgggaaattgtagtccttaacctaaaagcttaaaatctcaattatacggatgaatcagttgagactcatgaataatatgaaaaggtcttttaatcataaaaaggcctggacaatgaaatgaatcactttgaggttagctatttttatagaaaatgagatttttttttttcaaatagttgaaagcgtgaatggtgcaactggaaatcattccaacagtgcaggaaaaaatagagctataaataaaatgaagaaacaagtaagcaactaggaaacggaagagcaagctgaagcagcaatagaggctgaaaaaccagcagtgaattcaagacaggaatctgtaagtgcactcaaaagatgacataaacagagagaaaagaccctcttcgtaatgtgtggacccatgtgattttcagaatctggttttatgtactgtaaaagaggattataagttagggcctttggaaagaaataattttttgccactatttctattttattgtattttgatatggggtctcactctgttaccgaggctggagtcagtggctagatactggttcattgcaacctcaacttcccctggctcaagtgatcctcctgcctccgcctcctgagaagctaaaactacaggtgcaggccaccaggcctggctaatttttaaaagtttttgtacagatggggtttcaccatgttgcccaggctggtctcaaacttttgagctcaagtaatcctccgaccttggactcccaaagtgcttggattacaggtatgagccagcatgcctggctgctattatttccaaaataataacacaaataattattagaagtaataataatcatataatttccagattctaataactcattttgaaaaatatggttttcatagctgattgaagaactacagattgttagacaggtattaaccctagtaaaggtgtgataccttcatggagtcaacctaaaaacgcagacaagagagcaaaaatcccagtcttatgggaatttctaaaactggattgtcctttagttttctaaaagtgctttttcatgcaacatctacaaaattcaactcattctacaagtttgatgtgcagaggaaaacaattatttttttctatcattgatctctccttcctcttgggaactcacctgctggttagagggggatatgtgcagccagtttaaagcatgcaccaatctgatgagttaggccttcaaagcagcat

SEQ ID NO: 28148 - DNA, 1032 bp, Homo sapiens
tgagtgttgtcttccctgaggtttctttctcttactcttctctccttgctcaaatttcagagttgtcatccacaattctgggaaaggtgatgtttcacttgcttcattcaataaagatggggtttaggggggtgacacaaggtatggctaccaatgtctaatgctggtattatatcctttatccagtatgctggggagaaagtacaatcattttgctttacttcatagctatctggttcattaaatcccatgagtcttggtaaattatgaagcaattattgattttgttgtggtcaacatcaagatatatattgattttcccaccagtcaatagtttccagaggcataatcaatattgatgtttgctgaacatgtgtgttaatgtcagtgtgggtatatgtacttagatctctacactcagatatttattttatactctttctgaacgtttttgtaaaaaactattttctcccaaagatcctattattttttggctgatttattcagttcttcctttttgctttacatttttaatctcatttattcttccccggattgataatggaaaggaaaactaaggctttggaagaagtctatttgcctttaatgaaccggttgggggtgagtcttcctgatgagattgtgattaattgcaaagtgagtattacttcttgtctccatcctgtcggttcgatagaatgacaaaaaaagttgaagactttcactctccattccagcatctaccagaccaacataactcagtaagcacatctgagaatccccctcatttactcccagtacttttttcaattatgtggaacatagacgaacaggtcaaacttggatttagacaaagttaaatgatcaactacatgatgcaatttaatgggcacaaaaataaaaaaaaaaaaaacctcttactgtcttacataatagcctaaagtctaccagtaggaatttattataaatatcctcttagaaaattcagattgctcctgagtaaattagaatatcaggaaactcacccttagc

SEQ ID NO: 28149 - DNA, 1465 bp, Homo sapiens
taattgatggccataagtcccagtaggcttaccagattcttccttgggagcaggaagtaaatatgacaacagaccaagactaaagtgataccaacatggaacttcagtctgttcaaataggaagatgggccaggacccatcttagagttgtggtgtccagtatggtagccatgaactccatttggctctttaaattaatgaaaatgataaataatttaaaaactggtttctccctcacaccagccacagttcaagtggtcagtagccacatgtggctggtggacatcatattggagagtgcagattattatacaatgttgtatgtacgcattattgtcatcgtggaaagttcttttggacaggactggcttacagtcagagctttcactgttagaaagtgaccagtctaactgattagaaagcaaggggtcactagcagcattggttagttagattgaaggtcaataactacagtttagctaggtttagaaatacaagcagaacatgatctggataataactctttgctgcttaattgctaaccaaaaacagccagatagtgaccgttttggaggtgaaggggatgggagattagattggcttgtctttcatatgaaaccactcttgactttgatgtgaagtttaaagatttgatcccttcctaggtcttctgcatcctattttaatatgctaccacttactttagaaattctcatatctggattttatgatgattggtctggtgctccacagacctcaccagaaactttaacgctacgtgccttgggctttcttgctggaaaatatcctgtgtagaacactctgtctgcctctaggtaagtgtcattttcggggagggaatctccctgaggacttctgccatttcagatgagaaagcccagaattattcttacagcataagatgccacatagtggttatgatatgaatataagaaatgacttagaggagatgcggggggggtgctgctgcaaatatacattcaattgcttgagtaaaaatcaaggcaagaaaggtgggcttaaattatagaaaggaaaatgtggggtggatttctgaaaaatgtgagtggcttgtaggatttcgccgtgggaagtttttaatcagaaaaattgaatacttgatgaacatctcttacctggtcaattgcaactatcttccaaatagactttttgtcattagcattcaccatgactgcctcttccccacctcacacacacacaacagatatgtccatgttctaatccttggaaggtgtgaatgtgaccttatttggaaaagatgttttgcacatataattaagctcagaatgctgagatgagatcatcctgaattacttgagtgggccctaaatccaatggcaagtgtccctgtaagaaacagaagaggagaagacacgcataggagaaaaggtgaggtgaagatgagggcagagattggcataat

SEQ ID NO: 28150 - DNA, 1032 bp, Homo sapiens
gaggtgtcttaagaagattcctagagaagggtttggaagagaatctttagggacaactgttggttggggataaacaaggggatgcttcctccctttcctcaagtcactagtgaggttgtaatagggttgtccagagaaacaaccagtaggatatatagacacgcgcgcgcgcgcacacacacacacacacacacacacacaccacagaaagagagattggctcacacaattgtagaggttggcaagtccaaaatctgcagggtggagggtaggccaaagatccagggaagagctgattttgcagctcaagtctgaaggcagactgctggcagaattctcccttctctagaggaggtcattctttttcgattaatgcctttaactaattagatgaggtctacccacattatggagggttaatctgtttttcttaaagtctgctgatttaaatgttaatctcatctgaaaatgactttcaaaacaatatctagactgttttgaccaaatatctgggtactgtggtgtagccaagttgacacatgaaattaaccatgacatggggctttaaggagtttgctgggaggactttctctatgtacctggaattttggtgggcacacagtggattatctgacttttacggggcaaattaaaaagacgagaggcagctggccagtcactcttagggcagaagtaaaaagaaattgcagttcccttagggttggcctctgtcgctttgttttaagacaaacattgcaggggtgtttctcatggtccagctatgggctatgtcagcaaaggctggcttggaattctcttggggttttgtccaagaaggctacctgcagaggcaaaaaggtctcagcagagaggatctgcctgtatcagtgcattcctggggctgatgaggaatgagggtacatgatacctacagtcagaataaagacatgttcatccagtgtcttagtgtgcttgggctaccccagcaaaataccaaagaacaggcatattgcttgataggtagaacaacaa

SEQ ID NO: 28151 - DNA, 1045 bp, Homo sapiens
agtccactgactcaaatgttaatctcctctgggaacacactcatagacacacccagaacaatactttgcatccttcaatccaatcaagttgactctcaatattaaccatgacagcggaggagctgttgttgatacaggagggtgtaatgagtttatacattgaaaatagccctgttgctgtagaaatagcacatggaagtgaagtggtgcccaggatgccacaggagcaaaaaggtggccatgcaaatcctggcacaagagagaggaacttggatgagaggacaagggcctggagactagtggccagattcaagagacaggtgggacctaaaatggacggaactttgggaggaattgggtaggaaggggtggttaagggaagacagcatcatgggtcattctggctggagtaacaatgtttgatggtctcttcagcaagtgaggggacacagactgaagacagggtcaaggttagaacatgacttggctgcttaaacgcaaggacaaaggttgggatctccacagatggacacaatggaaagagggagaaagacaaaagagtttggagtattagcaagtcatacaaataaaatgtttctaaaatgctgctttacacatcattaggagtttaattatggttattttcattctctgatctgcttcttctgttctttttctcttccttctttctttttccttcctttctttacagaattttatctcagcttgctcaagtttaattgcagaaagtctcacatttttctaccttatgaatctctaagatcttttccagagtttttacaaagggtttatacaaattttggtaaaattgagtaacttttccaaaagaccagatacctggaccagctggtaatttgtcataatttaaaattatttttattttaatgcacctttcactctatggttttgtattttaatgcatctcttaactatacatggttgatttatagtgtgactttggataagttatgtgacccttctttgcttttgtttcctaatttgaagaatagattagtaaaaagat

SEQ ID NO: 28152 - DNA, 1298 bp, Homo sapiens
cggcctcccaaagtgctgggattagaagtgtgaggcaccgcacttggccaagtttctatactttaatgagtgaagaaatggatgaattcaaatatattggtaatgacagagataataaacatagttgcataatcaaaccactgtctccaacggccagttgctagaagtaggaaagacatctaagtgaaggaagacagagcaatcagattctgaccttccatattttgcaacttatttttttattcattcaatataaacttagtaagctcctactatggtccaggccctgtgttttgcttttatatcagaatctcggtcatcaagatgcttatagcttcatggaggagagatgtaggaaaataaaaaagcctgctaaagcacacggataacagagggttttcacagaaatatataaaaaatgttgtggggacagagatatgaactcacctcgttcatatccaggtgagtaagtcaacagtgatgaggaatacgagaaagtcccagtagattttggcggcaacaaattattagcaataaaaatataagaactagtctttggctctgtagagtgaagagaaggacaattttgaggaaaaaggaagaaactccgtgagagtacttagtattaggttggtgcaaaagtaattgcggttttgccactaaaataatggcaaaagtaatggcaaaaccacagttacatttgcatcaacctaatatgctggattaaagtttgatgctggaatttcctctttcctgggtctcttaagtcacaacagatgtggaatcatagcaaaaactctgtaaccaaacttaacgcataagaccaacgcacaattacagacaagagtaatcagaggacagacacaaaagggtggaagtttacatatttctcactcccgcaggcagtgttctgttgacaatttctaactctgttttgattctgtagtgacaatagctgcttccccacccccccccctttttttttttgagacagggtctcactgtgtcacctaggctggagtgccgtggaatgatcacagctcactgcagtctcaacctcctgggctcaagtgattctcccacctcagcctcccaagtagctgggactacaggcatgcaccaccatgcccggctaatttttttattgttttgtagagatgggatttcgccgtgttgcccaggctggtctaaaactcctgagctcaagtgatctgcctgccttggcctctcaaagtgctgggattacagatgtgagccaccagcctgcttccccttttatttgtcctttttataactgc

SEQ ID NO: 28153 - DNA, 1646 bp, Homo sapiens
tcccaagattcaattatctcctgccaggtccctcccacaacacgtggaaattatgggggctacaattccaggtgagattggggtggggacacagccaaaccatatcacctgtgatctccagagacttccagggcgtggctcatttccactgacacatttacagagatgttgttagtggtgtcataccaaacatagctgccttttttttttttttttaagacggagtctcgctctgtcgcccaggctggagtgcagtggcgcaatctcggctcactgcaagctccgcctcccaggttcaccccattctcctgcctcagcctctccaagtagctgggactacaggtgcccgccaccgcgcccggctaatattttgtatttttagtagagacgggctttcaccgtgttagccaggatggtctcgatctcctgacctcatgatcctctgcctcggcctcccaaagtgctgtgattacaaccatgagccaccgcgcccagccaaacatacctgactttctctttgcctttcttctgctggactcccaccttgtcctgtagctattctagggttctagagaaattttatacaagggacagtctttgctcctggctatgacttcttccccagatccgtcttgtgctcctctctagtaaacttgaccgtaccatgaagaagcacaaatgatgaccctatgatctcacctcgtctggtaaagcccagcgacagtccagcctgcacctttcttcttctccacctggacctctttgattctcctgagctgtggactttctaatctgaaaatcctaccaacctaccttctaaaattccagagggagatgactcaagatagtgtctatgcaattttcttctggtttttctttagtgaccaaagctgtaggttagttatttaagttatactttatgccctgaatagacatattggcaaatgaaaatgttacctgtccagactttccagcttccctccagcaggtcttgtcacttggtcttttttctttccatcatgcggaaggcttgttcttccaacagtttcttgcctgcttcaccttgggactcactgtgtgcctttagaacttgtctaatcagaaattagattgctattcttggccagaaagcagagccagagaaattcggacctagcctcattagaacaggactttaatcagttgagcctaccagccacacacaggctaaacatatatattctatataaataactacacaaacatatttatatatctttttaatgtgtgtgtatgcactgaagtttgcaaagaactgggatagaaaagcaaatgcatatgatgattaatgaaaccagaattttaagtggttccttgttgtatatttgctgacaacatattattttcctttttggagtggagtgtgtaaacctctgggcaggaaagaactatgaattattctttcccttctaatctacataaataagagattctaaaactgtgcttttagccatttaccatgcaaatagtcaccagggatagaactgttgtagatctagaatatttatttaatggcagctgctacaggacacatgctttttgagttcaatggcctagaatctcctcacccttaccaacccctcccttttaaggttcatttcttgtga

SEQ ID NO: 28154 - DNA, 1020 bp, Homo sapiens
tgtatttatttctgggagagaatgttttagtaacagggagctgtgaggtgggggagaagtggttggaattataataatcagcttggtttattgaatcacaataatgaatctctccctttgtcgacgtatggctagttatcctcagattatcttaatgatatcaggcagagtgtgccgttgatccgtgcttgaaaagtaaaaatagttgacagtcaaactgatctaatcttgaatgctgtttgtgacagagggaacgattttgtgaaaaaagacgaggtggtttttatgtcgtgcaaaaggctgaaataatgctttacattattgctgatatcagttccatttaaaaagtttaacaaagtgagttgtgtttaaatgattcctctggggtgcgctcctattaactctattaaatagcatagatacttctggaagaaggctgtttgtactctatgcactggcagaagtgaagttaatttctgcaccataatctcacacttctcctgacaaacacacaaacacctaatgaccaccagccaaagtctagcaaaccaaaacctagtcccagatactgcacagataacatggctgaatctacaggagatgtattttaaatcacaatcttagggtgagaatattagcaagttgtagacagagacactttaattttcccttctcatatttacagaggcttatagagcacctttcttaagataggcatgttaagggaatgaatatgtgaatgattgcatgcctgcatgacggaagccattctggaggattggaccagggacacatcttgaagggactcttggtattttaacgtgggtgggatgtgattcaaagaaatattaaatactcttgctaaaatggagccaataataataataatacaaataacatggagctaataatattacagtagctagctagctagtcaggcatgagcaaggcaggagagggctcctctgtgcccatcaggaatgtcaggtgactatcaggtatggtcaggtggttgttaac

SEQ ID NO: 28155 - DNA, 1035 bp, Homo sapiens
gccctcagtatctgacacatgttgagttcagagtaggtgcacaagaattgaggggagaagtctggaagggatggacatttaggaagatggaggatctgtaaaaccctcttgtccatttttcaccagttgtccttgttttcaccagtttttatttcatcaaatatcccccctagatttaaaactctctgtttagctcttttaaatccaataaaacactaaacagaggataaatttagctcctggtagagggtctgcaaatgcagatgtagagcatgtgggaagatttccaggagctttagcagaaagtaccatatattgggcattagctttggaggctgattataaaagtcattttctgtttgtgattttgtaatcttactctcaggtgagctgtggtcattgctgacaggcaggtccatgcacaacaaccgtatcatggtgccttttttcatcaatcatgaatatttttgtgggggggggctttttttttaaagaaatcaattgaaagaaaaggtaaaataggatgatctgtgctagtttgagaaacagattaaagaatactagaatactttcaaaaatttattcaaagagattctaagaagaagacaaaaaggtttctcttttcttgttgtaaagattctaaactcctttgggaggctgaggcgggtggattacctgaggtcaggagtttgagaccagcctgaccaacatggtgaaaccccgtctctactaaaatacaaaaaaattaggtgggcatggtggtgggtgcctgtaatctcagctacttgggaggctgaggcaggagaatcacttgaacccaggaggcggaggttgcaatgagctgtgatcgcgccattgcaccccagcctgggcaacaagagagaagctctgtctcaaaaaaccaaaccaaaccaaacaaacaaacaaacaaaaatattctaaactcaccaaggcattatcttgagggctgctctcataagacagaaggatgcccctggacacctgtgaagtgtatgggtgtgtgtgtgtgtgaat

SEQ ID NO: 28156 - DNA, 1737 bp, Homo sapiens
ttatgaggttttgttgaaattagcgtctacatttcaatagctctacgttcccacctgcttgatggcggcactaaagggagcccctcaaaacctcctctgctattccaggcattccaaggtggccttgcaggacagcaaggaagaaatttgctcctggactatgatttcaacctcgcctgctgtccattgcctgtcatgaagaaggcatcgtgatgaggtattgctttcacaccctctgagagaataggactgccacatactaccataagcttgatggcttaaaacaacagaaatgcattctctcatggttctggaagtgagaagtcctaaatcaaggtgtctgcagggccacactccctctgagggctctaggggagaatctttccttgccccctccagcttctgatggctcctggtgtttcttgcttgtggtagcatcactccaatctctgtcttcatcttcagcattgctctaatctctgtctccatcttcctatggccttcttccttcctgtgtctagaatctctttctcctttctcttgtaaggacaccagtcattggatttagggtgcaactgaaatccaggatgatctcattctaagatccttaactatatctgtgaagacctacaaaagacctattttcatatggtcacattcatgtgtactggaggttagcaattggatatatctttaaaaattatttatttttaatgtttgtgtgtacatagtatgtgtgtgtatatatatatatatatatatatatggtatatgagatattttgatacaggtatgcaatgtgtaacaatcacatccgagtaaatagggtatccattgcctcaagcatttgtcctttctttgtgttacagacaatccaattatacttagttattttcaaatgtacagtaaaatattgttgactgtagttagcctgtggtactatcaaatactagatcttattcgttctatctaattatatttttatacccattaaccatccccactccttaccccagctacccttgccagtctctggtaaccatcattctactctctatctctatgagatcaatttaaaaaaaatttttagctctcacaaataagtgagaacattcgaagtttgtctttctacgcctggcttatttcatttaacataatgacctccagttccatctatgttgttatgagtgataggatctcatttttttatgactgaatagtactccattgggtatatgcaccgcattttctttattcatttgtctattgatcagcacttacattgctttggatatatcttttgagaagacaccattcatcccattgtagggacaaaggcaactggagaaaagagaaagaagagaataaataagggtacggaaggagtgggggcacttgtgtcctactccctttctagagtatggcagagccaattctcaaccctagtaagggagtaggttaagtcagaagcctaaggacttgcgaatccagcatgaacagagcaacttcagggcttaagtggaaaaggtgactgcgaccatgatcctagtattattgaggcggcctgtgaccttggggtggctaccaaatagtacccaaagttgtagtggagagatccatgacccctattctctcagaggatctgaaagccatggagcaatatctcatcaaggtgccttctgtggtacaggcagtggacagcagatgaggttgaaatcaaagtccaggagcagattt

SEQ ID NO: 28157 - DNA, 1791 bp, Homo sapiens
cttgggcataagaatagcttcatggctccaagtctgatcatttgtgcataggtcagtatattgtgaccaatctccttaaaggctgttcatcccgtggtagaaataataaagtatccaacactgagagtgttctcgacattgttactccagccttgggaagaggtcttcgatgcatggctgaggccaattgcacctgggtgaaagtggcaggtgcaaaatgaaagtgaggagggttgtgacaaagtgtctcagaggtgccatgtttgaacccgttcactctcaaggtgaacaatgcttcgacaccgaggccaagtgtttacagaatgttgaactaccgctgggaatgttgggaatttcttgctatttttcactgagtgggagcccaagtgtctgcgtttgtgttcaggctaaagacattgctgtagaactcggagaaaatggagtgggagatcaaggaaactgatcagcctctcccagaaagtgaaagcaggggatgtactaaaaatgctctgatggaccctatgtttcctagattcttccagttactggtctggcaaagggaggtggtggtttgaattaatgagaaggggttactgggatgaaaacaaggtcttttatccttactgtaactatagagtttggttaagaaaaatagaagtcttaacacagccctgcaggaattaatgaaagagccagacccttgggcaaaggggcagagttggaaaaaggctaaaagaagaattcttagagctgaggggccaatgagcacatgtagacacctagaaaaatcaactttagtgtttcattctgcagtggtggattatttaacctctttaagtctcattttcattgacaataaaacggaagtaaatggtagtaccaacttcccagaatcttggtttcataaagcccttaacagtgtgctaagcactcaggaaatgttatctcttgttattattacttgtcacactgactaatatcagaaaatcatgaaggagttgtgaattcaagatatctttcctctctcctcgtctttgcctcagttgaaaagcctcaacctagtttaaggatctagcctctaagactgatgaatcatgctgtagcaaaagtgaatagacgtgattggcattcactggtgctagccagagaattaggttccccatgataaaaatggaatggattgggctggcctcatctgattagagaaatctgcccttattgctgctatgtgattatgaggctggacttcttggacagcctggtggaggtcttgggagatgtgggtaggagtaagagctaaaattcgttgaagtacttggtgtgtgctgggcacaatactccttgtggggttcagtgaggcctcagatgcaacatgaaaggggattccaaaaactcagtcatcaagaaaaatatgattttgatgcaatattaaaaaatagaaattaatacaaaaagtctatggtgagcaaagtagcaaaatttaaagtaacaacaaaatcactgaaagtgccatgttgagcagtgttggagtctgagacaaaaggaaaaatcagttacattattcctgtctttatttataattttgatattttgttcagtaacattttttgcactgtgatttaaaaaaaatgtgcactcacatactgcctttgttactgagtttttcacatctgcttaaattttatgcctaaggagagtgcctcccttgccttctcctactcccactgcttccctatataagaatttattggccaggtgtgttggctcacacctgtaatccctgcagtttgg

SEQ ID NO: 28158 - DNA, 1008 bp, Homo sapiens
ttgctatggatcagtgtttgttgtgcatatcccattttccttcttttgaatgtgtctgttggaatatcctatgcatatatcaccattgtatgtggaatatgggatgaaggagttgagaatttgtctctttagttcacagatattcatactgagagaaaccgtactcaatgtgccgcttctgaggaaatacaccccaggagactcacttacccctggacatgactaaaatgatgggatcttgaaccttgagcttgagctgaatgccataataggtgagacttctgagaatatcttagaggtcttaaaaggacatgagtgtatttttcacatgggaagaatataaatcaacttatttattttagctgtatatggtaagataaagatagtgataaattagttataagtgatgtttattttcaatcaaaattcagaagacaaataaaagattcaggcttattgaatttaaaaataaacctgcttcttatcctttccagatggcaaagaattctaacattaaatccaacctcagggcccctgcttggtgctcacacatttcaaattggaagtgtagggaagttattgtttcgtagaagagaactttagccattgaggggaggaaaccaatagataaattcttctctttttcttggctaacaaaaaaataatcccgagatgtggatgcagtgtttattacagctttcagccacaatcccaacaaggtgtgcaatcagtcacatttagtgacgtccaggtcagtcacacatctcctactcctttcttacttgctttcttctccttctccctcactcttcactcccattccttaagcttggatacctttatagcacatacaccctctacttcaagctttatttcctggtggtcaaggctaagaaagaggccatttgtagagatttgggatatctagcagtgaagggagaatatatatctccccacaagtccaccacacacatgctttgaactataaaaacttgtggacctgctcca

SEQ ID NO: 28159 - DNA, 1048 bp, Homo sapiens
atacagcaaacacacctttgccaatgggagcaagtaatggggaacaaaccaagctcaacttgttctggaaaaaaaccctgttgttttattattatttagaaagcacacacaacaatttattggggaaaaagaaaaaatgcaaaataattgagcatacaaatttattttaaaagaactggtgtcacttcccaagtcatatctatgtgagctttttaaacttttgtatttcttatatctgtattcataatcagagttatggatatagatatatggaaacacatcacacactcctcagaaatcctttctccaaaaatctgtagggaatgcatcctttttcttcctacaggcgtttccttggatcacgccacagtctcttttctctgagttcgtctctgatgacaagtaaggatacttgtgaaggaagatttccccttagttcttgactttttctttatttttttctgattcttcagtgagattcccagttcttccatgatagcgttgaaagagagacactagggaacatgagatacagaccatcagcttaattaagcctatcgcatgtgccgttgacctgcctcttgcctaggtatttatgaacacaagatattggcttgaaggcagctctgtcacaattggccagttcccatcacctcctcctccacccgctggccacccaccttttctaatcggggaaactgagatggcaagttagctgggcaaactttgggatttcattcacaaatgcagtagtataaaactacccagttaaagcaaactcagggctctcaaaatagataacttacctttgctgagacaccaaaatagagttaaattaagtcatttcccccactgagatgatccaaacattgataggattatcaaggcatacggacacttcagtaatgctatagaaaatgaacaaaccttctctacaccaaggctttgtttttttctcccatgaaaccttactttgttcctaaaataaaatctaattcttgatgactttcctttctgataaaaaaaaaagaaaaaaaaacaattttaa

SEQ ID NO: 28160 - DNA, 1049 bp, Homo sapiens
gatatgagccagcacaggaggacaaaggcagcatgattccacttatatgaaacatctaaaatagtcaaagtcatgaaaacagagaggagaatggtagttgccaaaggctgggaggaagggaaatgggggcagttgctgctcaaggggatataaggtttcaattatgcaagataaataagttctggagatcttctgtacaacattgtgcctatagttaatatcgtcttgaacacttagacatttttaagcggttagatctcaagtgtttttatcacaataaaaaaaaaatcctctaaaaaccatagcctttggtaaaggttatagaagtgcaagcatacttttttaaccttagcacacaaaatggatatggttgaaagtcaaatgacagtgtgccaccaggtaatgtgtctaagttgtaactgccttacgggaagaaatttgtgttctatgtttgcaaagtactaaacatctagtgtgtttcttgtgtatcagcatgcaacatgtgtatttgaaaatgttcgttttgttccaaaaataacttgatgtagtttagagaagtagtagttttaatttttctatttttaaattttttctacttgatttcaaaaccaggcctagaatttaggttctaggtgtaaactattggcctatcagatgtatgtctcttaaaaaactggttctttgaataaaactttttatctcttttaagcataagtgtttataggatttgaatttcacttccattttcctgtaatacagaaacataaaaactcatgtcatgtgtgctaattttctttcaaacagtaagttgtggcttcagtgaattgggaggggtgtcatgccacacaaagaaaaacgtcagaaagttttttatgaactatacttaaaaaatgttatagcaagtacagatgcttctcacttactatggggttgtgtctcaatacacacaatgtatgctgaagatattaaggagaaattgcatttaatacacctaacttacagtttagcctagcttaccttatacacacatggaacacttacactagcct

SEQ ID NO: 28161 - DNA, 1050 bp, Homo sapiens
tttctatgccatgattttatttaattatcatagtaaatgtataaagtccataatattaccttcattttacaagtaagaaaattgaggcttagaaatttactctaaagaatacataattatttattgagtggctactatgtgccaagcacaatgcaagatgtcttgtacactattatgggatgagattcacatgatcatacctgtgttcccttgaggatgatctgtggaacactggtctgtcaagatgctgtggggaaaaaaatctgcaatctaataggcttcagaagtgctgaatacttttctactttgttgaaaattctcaatgcgcaaaaacttgtgacgcacactgagatagcatgtagtaaaggaacatttagagtgacgctctatgggttatttaactatgaaaattctatttgagaaacatttgccaattgaacacattttgaaaaacacccctacaaaactttgtgttccagaaattttgtcccactgctacatattaagaaattgagactgagaagtttggtaacttgcctgcagtcattcagcatgtggctctgctagaacctgaatctaagtttggctgttttagaaaattttcttctgcttctaaaatctataactacaggtcgatgatggatatctacttctctgttagtaaagctgaatttaaattgttgaaaggatcaaatgtaatgtatgtgaaaacattttgaaaactataaaataatacataaatgtcagaattaggtagtatacagtctaaagtagtatagaaatattaacttttgaaagagatcatttctttatccaaatctctgaattacacttttaagtaatagtctctgcagaaagttaagttttgtcagttattgttaattttgattgtcaatacttcatcaatcacacttgaactcttttggtagcatttttggtttattaaattgtctttgggagagtaaacttaggaaatttgtggtttctatatactgaatccatgaaatatgaaactaagaataatgtcatattcatcccaacatctgattc

SEQ ID NO: 28162 - DNA, 1037 bp, Homo sapiens
taaagaagcaagaaggtagctgtaaatcttctagcccaatcattctgcaggaaagttatttggaggacataaatgataacaataataataaagttaatttctccatagcacatatttctaacaccaggtagttagcaggaagtcacattggctgtgtattcatggtaaatatggaagatagttgaactttatctgattagttatattcatattaattaaaagttgaatatataaaatgcagctttttcttttttaatgaatttgttgctaaataaaaacattaggacaattcacctaaaatctggattttttttattttcttagaaaatggaatattccacaatcttgttctcaaattcctacatgtctacaactctctgacttgaaaggcagctgtctcttttaggtatgtcatgtggtctgtaattttccataattgccaccgttccctactacctcctggcacaagcatgctttgctcacttatggtatctgcttggcctctgtaagcattttagtttgtgatccctgcatgatgtggagagtcatattggatcatccctttcaaatgacaaaaatactaataccaacaagcaaatcaaacctacctggggtccttaacgatatggcttgactgttagctatgatttctggacttgcccagtagtctagacagtccctgattcttctcctttggaatgcttactaacaaattaccaagggctcacttgggaagagcaggttcccactataccaggaccttatatgatacagttttctttctttctttctttctttctttctttctttctttctttctttctttctttctttctttctttctttctttctttttctttcttccttccttccttccttccttccttccttccttcctttctttctttctttctttctttctttctttctttctttttctttctccctttctttccttcctttcctttctctctctccctttctttctttctttccttccttccttccttccttcctttctttctttctttctttct

SEQ ID NO: 28163 - DNA, 1025 bp, Homo sapiens
tgacctctcccagggagctacaggggaagtctagttggcatggacacctttgagcagggagggcagaactttctctctgacagaaaactgttacttggtaggggacttggtaagttgaaggtataggaagtgttataaattcctttgaccccttgctattctcactagagcacagtaatagtaaacataatgggagcaagaagagcagcattttgctgttatttagagctctctttcgtcgtttaaaaagtttgctgttgtggggctttattgtgtttcacagttagagttctaggctacttgggatgctagggaaattagagtttgcaggaagacccaaaatgtggctaaggaataactttttttaataggtagaaatatctgcagacagcttcagcaccttaaaggtgtagtgagctttcttttttattttttgagacgttgtttcactcttgttccccaggttagagtgcaatggcacgatctcggctcactacaacctctgactcgtgggttcaaatgattctccggcctcagcctcctgagtagctgggattacaggcacctgctaccatgcccagctaattttttgtatttttagtaaagacagggtttcaccatgttggccaggctggtctcgaactgctgacctcatgtgatccacctgcctcggcctcccaaagtgctgggattataggcatgagccaccatgcccagccggtatagtgagttttctatcactaggcaactgcaaggagtatgtcatgcttagacgagtttcacataaggagatgcttcaaccaccacgttctactctctagaccaaccccttcctatcacatatgcaggtcctgaggtcagggacagcaaatgacacacagaaggtggcagagggttagtggaagagacagcacagaattgagggctctttcttctttactgcagagttctgtccgctgcatgccacgctcagtaatgtttattttttgttagataaaaaagtagaatgttgggagtaaattaca

SEQ ID NO: 28164 - DNA, 1065 bp, Homo sapiens
tccagcactttgggaggccgagacaggtggatcacttgaggtcaggagtttgagaccagcctggccaacatggtgaaaccccaactctattaaaataaaaaaattagccaggcatggtagcatgcacctgtaatcccagctactcggggggctgaggcaggagaatcgcttgaacccgggaggaggaggttgcagtgagccaagactgcgccactgcactccacccagcctgggcgacagagcaagactccgtctggaaaaaaaaaaaaaaaaaaagtgacactttgtcatttaaaggacactttgtaaatctgggttgagcatctctattctgaaaaatcccaaatctgaaactttttgagcactgacatgttgtcccatgtggaaagttccacacttgacctcatggcatgggttgcagtcaaaacttttttcatgtacgaaattatttaaaatactgtataaacttacctttaggctatatgcataaggtatatatgatgaataaataaattttgtttagacttgggtcccatccccaggttttctcattatgtatgtgcaaacattctaaaacctgaaaatatccaaaattctaaaaacatctggtctgaaacatttcagataagggatccacagcctgtgcatagatcctgtgtacagtggcaaagtcaggtctattgctttttcaaagaacggcacagcctctttcccttacatttgtgctgaacatcttgaaggaagtagaatcttctctgccttctgctagcccatttcccagtactttaaaactctttgatattgctgaatgagataaatcatttcagatattttttcagatataccaaattctatcttgccagtgcccctctgtcctgtgagccttgcaagtgaccttccttgtttctgacaaggaccatgatgaatcactagcttggggtatcttgtgtctcttcacactattgattttaggaaaatactttctgcagcttgcaaagccgtaatgtcatttgtctttagaacatcactgtccaaagaagaaacaatcaccatgctttacacata

SEQ ID NO: 28165 - DNA, 1030 bp, Homo sapiens
cttgcaattccaggactttgggaggctgaggcaggcagatcacaaggtcaggagttcaagaccagcctggccaatatggtgaaaccctgtctctactaaaaatacaaaaattagccaggtgtggtggcaggcacctgtcgtcccagctacttgggaggctgaggcaggagaatcatttgaacccggagggtggaggttgcagcgagccaagatcgcgccactggactccagcctgggcgacagagcgagactccatctcaaaacaaaaaacaaaacaaaaaaacagctgccccccaaaagaaacaaacaaacaaaaaaccccaaacagtccactcaatgctgaggtgacaactccatttttggtaatctgaatatgaatctttgacaagggtgtttttagagattattttgtttacaactgttgttttccttttattcacatgcacatttaccaccattaatacttttttttttcccaaaaaaaactttagccccttctctgttatagactaggtatttgacttggagcaggtaatttagcttctgaaggttttgttcttttcataagtagagtgaagagttgaacttcatgatctttacacctattggatctattaaaatctatttttcactggaattagagtatttgagatttgataataaaagtactaaggcttcctccaaaagcgaggcagaaatcagtttcattactatgggtaagtaattaaaaagacctcaacaatgaaatgcccttgacactaaaactaaactcatccaacttaattctcctgcggtgcctccgaagacattttgaaaagcttcaggcatggctgggaacactgtccttcatcaatgcggactcagtattagaccagagtctcctgggatttttttgttcttaattctctaactaaattccaatatcaacacgttttcttgtcatctgtttctatctcatcaagtacaggaccgaaagaacaaaataatgatattcaagtattctggttaccagaattcttgattaaggaac

SEQ ID NO: 28166 - DNA, 2071 bp, Homo sapiens
tcttttgtctgagcaagattatgtctcaggttcactggaaatgacaaccaacctttctgtcctcctgagttattgtgttctatgtttcctttcaagacatggctaaggttatagaaccaaaactgcaaccctcaatagctgcctatctctggaaattaaaaaaaaaaaaaagccttttcacctcattgtgtatgaataaaaccttgtgaaataaggattttctgtttttattatttatagatttgattacttatatcaatattctcaggattctcatgttgcagagaaactgaagtttaaatacattgtattgctacccttgaaaaagttcacagaaattgcttgtatgtaaaaatgcaagttcatgtaaccaaagtgcatatttgaccacatttaattgatttttttaaaaattagcttaaatagcattacatatctctcccttaatattatcactctgaattatagagttctgatgtacttttttgttttacagatttgtttttggtttcctgaaaagaggctagttaatctgaactccttaaaacttcttatactggtttaccaatgagacaagatagcattgacacataatgtttaaaatgaagatttaaaattatatgtaattatgttgagttagaattttggcaaaatttttatataaacagtttttacactttataaggtatcagttgacatggaatttccatgtttctattacgtttcagatcgtgagctaatgtaaaatcaagaagttaactggtggataatcttgggatatctgggttgcttctcattaagagataatattggcatgatgattaccattagtgtgtgtatgtctgcttatacctataaatgtctatatacgtcttattatttctatatgttacagagaaactgtaacttagagtcatgttaatgagcattttggttttgccactttgaagatgatgttcaaagaatgtatgtgtctctagggggttgttttatgcaagctcatgtgtataaggtaatggggtatatttttgtttacaaagtgaaaagaaaatatgttccaaagtatgaaacagtatagtgaatggcaaagcatgagtgtgtgtggagtatagaaggttggaggaaacagaattttatttacctcggagtataatatatgcacgtaatgagtctgaataaaaacaaggaaatgtgttaaaattttggcgaagtttacccagctttaattggttcattaataagatagatattttaagttttgtgaatctttttttctgccaaatactgcattaatgtaacactatagttttattttctctcttttaaaatggaatatttagcctgctcttaacaagaagataaattatcacttaccttctatgtcatcgtctcagacactttcattcccatcatcaacacgtggtttctgctttactctcatgtttttctgaaggttttgctataaactacagtctggaaatagcctttgtcagagaatggcagtatcagagcctcatggaaacatggtgccaaaaaatactcttaacctattggcacttcaaacagtcattggtatagactttggatattaaggtgtcacttagatgactaactgtactagaggatggaatcaggattttcaggactctttttaatagtccaggagcagaagacctttgaaaaccaggtgttgatccaacatccactagttataagacaagtaggattaagtgaactgctgaggggaatctaattgtggttatatggctttaatatcttattataagatatcttgggatacctgggtcatttcttttattcttttaataagatatggtcttttaataagatattattaaataataataaataagataaaaaggtattattaaataataagataataatatattatcttttaataagatatagctttacatatcttattaaaagaataaaaagattcattctcttcctgatctctttaactctctctttggtaacctataaatgacacattctttatatggcaccttattctccctgaccactcagaattcacagacaactt

SEQ ID NO: 28167 - DNA, 1025 bp, Homo sapiens
aaaagaacaacgactgtatttcgtttcaaagtcacatgggatcattgcctaacaggtccacccaaggatgatttaatcctctagaggattgtacttttgtttgttttactattttctattgtctaaggtcaagactatgaaattacatgtggacttagatattttttgttcaacagagacctaactgatgcaagtctagtacagaagatgacctcaaaggttatggttttattgcttgttgaacaataatcaattttgtctttaactcagatattcatttccattagcttctcctgttggactatataaccactctttctgtgattcttttttgaactagatttaccatccagatggttccttcattaaggagttaagtgtatttttggcacatgcttacattatgtttgcatgagagtcgtgttgataactttataaaattatatactgacaaatgcaaagtggcataaatgtaatcacatttggtccttacagcatctagataaggtaagtaggatggtccccagtttattgagaggaaagagatcctaaagttagtaagatgtacccagaggggttcagaaccagtctatctcatgttctttttcttcaccaaactgcatttccatcaatgagatgatgtgaaagaaatgaaagcatgtgggcttatttctccattttacatcctaactctagactttatatgggtcataaggagaaaacattctcaagcccaaaataaaaggagaaataatttaaaaattttctatcatcactaaaatcctgatttctcactcatttagtggcatgtttgaagtgtgagttgcccaagtggatccctcttggatctgctgggttccatttacaaagacaaagagcctctgctctggcttccaggatcctatttctcagtttctctggttcacctagcatggagcagcttctcctgcaagtcaatgtcacaaggctagaatgggctgtctgcaggagtagaaacaaaataagccttcagcgttttttgtgca

SEQ ID NO: 28168 - DNA, 1043 bp, Homo sapiens
gacatttattgagcacttatgatatgtcgcatgctgttctaaatcccttgcaaacattaaattttcactataacctttattcttttacagataaagaaaaaagatgttaaatgggatccccaaactcatggggggacaggcaatattcaaacccacaaagttggtgctagagtatatgccgttaaccataaagctgtgctgcttctacaccaagttattggtctgatgatttaatagtcacaataatagttcaataaaggttaatattcactgataatttactatgtgccaggcactataagcattttacatatgtcatcttttttaattactgaaattaaacttttgaaataggtatacagacagggaaattgaggcttgtagagaggtagaataacttgcctaaaattttgtagacattaagggaaagagtgagaattctaattcgtgatgcaaactcagatttcacctcatgaccatagccacatgctacagtgacttggactgtttcttatcaataggatatacttttttgaaaattcgtatgtgttttcattaattcgctgaatgaccaatttgatagagaagtataaggactggaattctaataatctgacttttccataaacttagtttagaaaggatgggcattctttctcaaggcgggctccatattgggaaaggcaataaaatgattcaaaattataggtctaatttgtgcccttcaacccaaagaagaaaactatttgttcgaaaaaatatgctaccccttgaaatacaatgttttcttagatggagaaaatgtttacattaactatattatagcactaataaactaccactgattttcctccccctttcagttttgtgctcgaggcctgcttactgaatgactgtcatcattttaggtaataggtaatgtaatagaaactggcctgtgttcaaattttcttcttccaaatgtgtttctgttcacattttatgtatatctaaagcctggatgaaatcacattgctcaatgaccctaagaaaatctttttacc

SEQ ID NO: 28169 - DNA, 1098 bp, Homo sapiens
tctatgtcaggtttacgacaggtagcagattataaacataaataagataaaattaggatgcttagaaatttccagtcttacagacatgtaaacagatatttgaaatataacttgggattcagtgcttttgcttccaaagtgctagtgaaccctctggtggtctcagagagctttaaggaagagggaaatttgcgtgcggtcgtggagaatgagggagttcaccaccgtgaaggtcgtgcaaaggatcatccaaagtgaggtgccagcctcagaaaacaggagtcaggagaacatggggatattgaagaaatgatagattcttcatcataactcatgtgagagtacaggcagtgagggaagctagtgcctgagttaatgaaaatgaaaatggctggatgatgaagagttttgaattagaagaaattcaactttattatgtggacaatggagggtcactgcctgactttaaataaaaaggggcctgaatttttgaaaaattctggacaataagcagaaagcagaggggggtggtgccagtaaaagaaagttcaaatgggggcgggtcagagatagtggctgatgaggactggactccaagcaggcatatttccatcctgcaccctgaacaagcacatggagcaagctttattaagcactcatcaatggggattcatagtccctttcccatgacataatccactctattggtacaacctctaaatgaattcctctttgttaacttacgttagaaacttttctaaacatttacatagctacttatcaagttggaatcatattccatggtcattttcaattgtggtcatagtcttattagagctggaaaaatgaaaatacatgtttaatattgtgattggattataacatatactgataagatgatatttcttttaaaaaaaagttcccatatatttgatgataaaaggatcgttagaaaggatcaacaaacaaaaagaaatgtgaattatatacacatgcattattaaattacttcagaatattcagttagctttatataaaagagcatttttatgctccatctgatgagtttaatgactatttgatactttcgttctgttt

SEQ ID NO: 28170 - DNA, 1047 bp, Homo sapiens
cagagtgctgggattacaggtgtgagccaccgcacctggcctgggtatctttcttgacctcgcaaacctaaaaagctactgcaggcttcagtgctgtttcttgtctccgccctacacggtacatcgctacttcacactggcaaagagaatggggcattttgattaaaatacagacaaatgccatctggccgagtattctgacatcttatctcctgagggcactgttgacatctaaagagaacatggaattggcattaaaggaaaaaatggggtggtcaaaggcagaatcaaggtttagggcaggagaatgagcacaagttacatttctagtacatgaccctagctgcaactaagagtcaacattttcttccccactggttattgaaaggctgactaaacaatcgtagctgagttacaacaaatggtcttccccagtacgaagatacctacacatgcgctctgggcagccctgcctcacttgtgttcctgagctggtctttctctctaacagatgctccctcagggttagactttggcctgtttaattcactgctctattcataaagtgtctcgaacagtgccaagcacatagtatgtgctcaataaatatctattggatgaatgaagtttagccttccgcactctacgaggagtttggcactgaattattttcttttctgtcatctatttgtggatgccctctttaaagaaaggacaggaggcagcttatacaaaaatagatcttgggctaggcgtggtggctcacacctgtaatcccagcactttgggaggccgaggcagatggatcacctgaggtcaggagttcgagaccagcctggccaacaaggcaaaactccatctctactaaaaatacaaaagtcagccaggcgtggtggcaggtgcctgtattcccagcttcttgggggtctgaggcaggagaatcacttgaacctgggaggcggaggttgcagtgagccatgatcacaccactgcactccagcctggcaacaaagcaagactgcatctctatatatatatattttttta

SEQ ID NO: 28171 - DNA, 1185 bp, Homo sapiens
tttgttgaacaaaattcaaaatactgttgcttaaagtattaagattttttaggattataccttacttataggcccgtcattcatttggcatgaaattttgagttttattcactttcactttcctttttttccaaagcaattaaaaaaactgccaaagtaagagtgactgcggaactaaggttactgtaacttaccatggaggattaagggtagcgtgtggtggtctacaacatagttatttgggttttagtatttcatttagacagcaacacttacctaatgtttaaaggtaatgtctttgcaacaccaagaaaaagctttgagtagtagtttctacttttaaactactaaatattagtatatctctctactaggattaatgttatttttctaatattatgaggttcttaaacatcttttgggtattgttgggaggaggtagtgattacttgacagcccaaagttatcttcttaaaattttttacaggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaattagctctgatacttatttatataaacagcttcagtggaacagatttagtaatactaacagtgatagcattttattttgaaagtgttttgagaccatcaaaatgcatactttaaaacagcaggtcttttagctaaaactaacacaactctgcttagacaaataggctgtcctttgaaagctttagggaaatgttcctgcttagtcattttagcattttgattcataaagtacctcct

SEQ ID NO: 28172 - DNA, 1050 bp, Homo sapiens
ttgatcaagctggtcttgaactcctgacctcgtgatccacccgtctcagcctcccaaaatgctgggattacagactatagacgtgagccaccacgcttggcctatgttcccttttgataaggacaccagttcaaattggatcagggcccaccttaatgacctcactttaacttgattacttctctaaagacctcatattcagggggctaggcgcagtggctcacgcctataatcttagctctttgggaagctgaggcaggcagatcacctgaggtcaggagtttgagaccagtctggccaacacagtgaaaccctgtctctatgaaaaatacaaaaattatctgggtgtggtggtgcacacctgtaaatccagctactcgggaagctgaggcatgagaatcacatgaacctggctgggaggcggacgttgcagcgagccgagattgcgccattgtactccaaactgggagacagaatgagactgtctcaaaaaaaaaaaaaaagacccctcatattcaaataaagtactgaggtactggggttaggactccaacagatgaattctggggggacataattaaacctttaacatcacctgatcccatggaatatatttagagttgatgtgtttgtctccccactagagtgtaagccccatgaggaagagaccactgctctattccccgtgccaagaatagtttctggtacagagaatatgctcagaaaatactttttttttttttgagacagttccgctcttgttgcccaggctggatcttggctcactgcaacctccgcctcccgggttcaagcgattctcctgcttcagcctctcgagtagctgagattacaggtgcacaccaccacgcccagctaatttttgtatttttagtagaaacggagtcaggctggtcaggctggtctcgaactcctgacctcaggtgatccacctgccttggcctcccaaagtgctgggtggcatgagccaccgtgcccggccagaaaatattttatgaatggatccaagcatggtttgatcttcccaagaca

SEQ ID NO: 28173 - DNA, 1051 bp, Homo sapiens
gtgaagctccggctctactaaaaatagaaaaattagcctggtgtggtggcaggcacctgtaatcccagctacttgggaggctgaggcaggagaatttctttcttgggaggcagaggttgaagtgagctgagatctcgtcattgcactccagcctgggcaacaagagtgaaactccatctcaaaaacaaacaaacagaaaaaatgtgctttgtccgaactgagatgtgctccaattgtaaaacacacaccagatctcaagacgtcatagtatgaaaaaaaaatgcaaaatatctccttaagaatttcaaaatattggtcacatgctgagatgataatattttagataaatggggttataggaaatagagtgttagttaatttcacctgtgtccttttacgtactgtggctactaggaaatgtaacatgacttatgtggcttacagatcttggttggatggcactggacatgtggctgaggcgaggatgtctcctgtggattctcttgtgccattctgagattgctcagaggtaccggttgttccctctgaaccaagagtgatagtgcccaggtggggaccattgatgagttggacatgtgagaagcagggagccagcacggggcatacctggaagatataaaaagtagagaggagtcacaaccacgtgaacatatttcacacctctgatctgtgcacttaaaagtggtgaggatgggccgggcgtgctggctcacacctgtaatcccagcactctgggaggccgaggcaggcggatcacttgaggtcaggagtttgagaccagcctggccaacatggagaaaccttgtctctactaaaaatacaaaaattagccaggcgtggtggtgggcacctgtagtcccagctactagggaggctgaggtgggaggatcacttgaacccgggagacggaggttgcagtgagctgagatcgcgccactgcaactccagcctgggtgacagagcgagtctccatctcaaaagaaaaaaaaaatggtgaggacagtaacttttatttaggtgtttttaccgc

SEQ ID NO: 28174 - DNA, 1099 bp, Homo sapiens
ggattacaggcgtgagccaccacgcccggcatagaaatcatttttaattggtgcttattttaaaaagcaagattgaggcatgacatatttatgtgtgtgtatatatataaacatgcacacacgtgtgcacatgtatgtttaaatatttttaaattaataaatttatatactataaaagtcaccatttaaaagtgtataatctagtgttttttagtgtattcacagagttgtgcaaccatcaccaccttctaattttagaatatttttattaccccccgcaaaagaaaccctgtacccattaccagtcactccccatttccctcttcccccagccctggcaactactaatttactttccgtgtctatggatttgcctattctggccatttcatataaatggaattatataatacccggtcttttgtgattgctttctgtcatgtagcattatgtttttcaggtttgtctaagttatagcatgtgtcagtgtctccttcctttttatgactgcataatactccatgtatggatataccacaattggctgatccatttgagttgttcccacactttggctagtaatactgctatgagcgctgttttcacttctcagaaaactccactcttaggagtggaattgctgggtcatatgtcagctttctttatccttttgaggaaatatatattttaaaaaaattcaacatttaatgataaatctaattttaattttaataatgataatctagctctatttgaaggccattattctttctttctttcctttttctttctttcttcctttctttctttctctctctctctttcttttttctttcttatttctttatttcttttttgttttttgtttttttgagatggagtctcactctgtcgcccagactggagtgcagtggcacaatctcggctcactgcaacttccgccttccgggttcaagagattctactgcctcagcttcccaagttgctgggattacaggcacgtgccatcatgcctaactattttttgtatttttagtagagatggggtttcaccatgttgcccaggctggtctcaaactcctgacctcaaatgatccac

SEQ ID NO: 28175 - DNA, 1044 bp, Homo sapiens
taactggaaaacttctttaaaatagtgaaagatagtttggcttagaaatgcttcccatagcttcgccatatctcattccacttcttggtgaatgcagggatgcctaaagtaagggagaatgcaattgaccttctctttttaatacaatctttattcaggcttgttggtacaatgggagctgtgcagagaagtccccacaaagggataattagaagtctgaaccaatcagaaggaagctacaagatggggcatcataattggttcataattcatggtccatagcaaattcactgcacaactcgttttctagacgaattcaggtggttctgttgttgttattttctccctctgtggtcgctctgggcagaattcagggcatcatttttatatccagatattagatggcaccatcttttattcccctcttttcttttttctcccacctcagatgcaagtaatttcttttacctcaatggcttgaaaagactttatatgaggggaaaagagaaggatcaataggactttgtgaatttaacttttatgcccaagaaggaacttttgtttgacaaatgctgaaagtcatcacaagattctccaaaacacatcattaaaatgacttattagatattttgggattacagtcagctcccaattcagtactgggcaagaggatgcacagactctggataattaaacaccactgataggtgttgatggatacacttattactagagagttaatcgtgaagaggaaaccaatttttccccaaaagcatttagaagaatctattcttagaagattcttagataattcaaaggattttcttttcttttctctctctcttttttttttttcctgagatggagtctccctctgttgcccaggctggagtgcagtggtgcaatcttggctcactgcagcctctgcctcccgggttcaagcgattctcctgtctcagcctcccgagtagctgggattacaggcacccagcaccacgcctggctaatttttgtatttttagtagagatggggtttcaccatgt

SEQ ID NO: 28176 - DNA, 1035 bp, Homo sapiens
aaaaccaaaattgaatttaatgtagaaggctgtttaaaatgagagtgaaaatggaaccgattttcttgctgggttagacactgttattataaaatggcttctctctttatggctcagaaacaaaaacagaatgaagagttcacttccaaaaaagcaaactcccctccctggaggctttggacctgatggatggcagagactttatccacaacttctgagatagatttaggaagaaaatcagcctgtcattgaaagaaaccttgggaaagaaagctcttccctacaaatagggcccccaggaccctccgctagtgaagccataattaacaatggaaatgggaaatggcgcgctttcttgggggtttgtatttcttgggggttttccattattttcaatggtggttattttcaagaccgtaaagaatagctgtaaaataattcacttctttcctttaccccagattatatgtataaatatatatatatatataaaaataacatatagatgtgtgtgtctccaatgaactttgaggtttcagacacaaaaaccaaaaatattcattctggtgcattgaacttttattactgtgaattgacttttcctcagagtgacatatatgctaatttataacaactttaatgcagatgtgctttttaattgaaaagaatcaaaattaactttatcttcagaatattacaatactcatgtgcaaccttcagtgaatccctactggtaaggaaaacagaaattgagagttctataccgagaagattgagaatgcaacgttgttggactaaagctgtcctttgctctcatgggggtccctgggatggatgggtgaagtatttgcgtgagggcctggtgcctcctggagagtcacacacaacacactcagtccaccttcctagctcagtgaatctgttttcacatagtggaaaaaaaaatccctgtctccagtgctgtacctgtgggtggacaactcggccaagaggcaccatgtctccaaatagctctcctgtctccatatagaactg

SEQ ID NO: 28177 - DNA, 1041 bp, Homo sapiens
agattccatgtataagtgagattgtacactatttgtctttctgtgcctggcttatttcacttagcataatgtcctctaggttcatccatattgtcaaaaatgacagaatttctgtctttttaaaggttgaatagtattccattatatataggtaccacacactttctttattcattcatccgttgatggacacaatagccatttcctggctattgtaaataatgctgcattgaacatggggtgggggtgcatatgtgtcttcaacatactgatttcatctcctttgaatatagacccagaagtggaattgctggatcacatggtagttctacttttaattttttgaggatccatactgatttccataatggttgtactaatttacattcccaccgacagtgtgcaaaggttctttcttctccacatcctctccaacatgtggtatcttccatctttatgataaaagctgttcttacagatgtgaggcagtatctcattgtagctttaatttgcatttcccttatgattggtgatgttgagcatacctattggccatttctttttttttttttgagagggagtctcgctatgtcaccaggctggagtgcagtggcgtgatctcggctcactgcaacctctgcttactgcaacctctgcctcctggattcaagcaattctcctgcctcagtctcctgagtagctgggactacaggtgcacaccaccatgcccagctaatttttgtatttttagtagagacggggtttcaccatgttggccaggatggtctcaatctcttgaccttgtgatctgcctgcctcggcctcccaaagtgctgggattacaggtgtgagccaccgcgcccggcccctattggccatttctatgtcttcttttgagaaatgtcttcagatcctatgtgcactttttaattgggttgttttctggctattgagttgtttgcattcttttttttttttttttttttttttttttgagatggagtcttgctctgtcacccaggctggcgtgatctcagctca

SEQ ID NO: 28178 - DNA, 1030 bp, Homo sapiens
gcagccccatcctccccagcagtgcaaggaagaaacccaagagtccttgactttgaccctccccttacccccagagccaacccatcaccacattctgccaatttgaccgctaaacccctccaacccctgcactctctctgtctccatccccacacctggtcccagccacatcacctctgtcctggacttctgctatgccctcctaaccgactctcttgcttccgggatggtggcccgccactctctcctgcctggccgtcagagcgagcttttcaccctcgcaccgcatcatgtcactttcctgcttgagaccttcggaggtttccttcatttgccaggcagactccgtgcatggtcgccctgtgtggttcagccccagcttgcttctcctgccttgtctcctagccacatggcccacacacacagcgctgcatccctccctgtgctcagtccacagccttcgggcttgctgtgctctctctgcctgtgggggctgtgcacatgctgctccctcttccagagtgttttccctgctcctctttgctgaacctaagtgtcttcagatcccagagcaagatcacctccccatgggcacctgctgttccctgacctctgccatccagtcttatcctatcgatcctatctgcctaccacgttctacatcctggggcctgtcccatttgcagctgtttatttgttttggggttgtttgattaacatctctccctctgggctgtgagttccagaagagtgggctctgagtcccttttgctcctcacaatattcccagaggccacacgatgcctggcatgtaggtgctcaataaatatttgctcaataaacaaatgaaaagatcaagtgggccctgatcagagtctcagaaaatggataggtctgggataagcaaccggaataggtagaacattccaggtgggatacctggctggattaaaggcagggggatacctgcagcctagcacacatatgacgttatcatcaccaaatggccgtgccttacggcagggaggga

SEQ ID NO: 28179 - DNA, 1030 bp, Homo sapiens
ttctacttatgttactctcagttcttatattctggctgttcagcattggtgtaagttctgattccaacagtgtttcactagtgaaattgaactcccttttctaatcatagaagattcaaattgtgcctgatcagcctccagacacctgagccaagagaaagatttgcagtaaaataattagggtagaggtagcaaagacaaggtccagaagccaaatatgttattatggtggcctgaaatttcaaaaatttctcccagtgtaaaagtggtgattggatatggatagagggaagagtacctctcattttaaagtaagccacaatacaatcacttgtcacttgacggggatacattctgagaaatatgccattaggcaatttcatcacatacttacacaaacctagtggtgtagcctactacatacctaggctgtatggcatagcttattgcttctaggctacaaacctatacggcatgttactgtactgaatactgtagcacttgtaacacaatggtatctgtatctaaacatagaaaagatacagtaaaaatacagcataaaagctttaaaaatggtgcacctgtataggacacttaccaggaatggagcttacaggactggaggttgctctgggtgagtcagtgagtgagtggtaagtgaatatgaaggcctaggttattactgtacactgctgtagattttataaacaactgtacacttaggctacactaaatgtttaaacatatttctttcttcaataataaatagcttactataacttttttactttataagctttcttattttttaaaacttttttgttgttattgttttgttttgtttttgttttttgagatggagtctcactctgtcacccagtctggagtgcagtggcgcgatctcagctcactgcaacctccacctcccaggttcaagcaatgagacagagtctcactctatccccaggctggagtgcagtggcgtgatctcagctcactgcaacctctgcctcccaggttcaagcaatcc

SEQ ID NO: 28180 - DNA, 1058 bp, Homo sapiens
ctttgttgaatacatgtattttaaatatattctcccactctgtggcttaacttttcactcttaacactgtcttttgatgaacaaaagtttttaatcttttttattttttgagacagagtttcactcttgttgcctggggtggagtgcaatggagtgatctcagctcaccacaaactctgcctcccaggttcaagtgattctcctgcctcagcctcctgagtagctaggattacaggcgtgcgccatcatgctcggctaattttgtgtttttagtagagatggagtttttccatgttggtcaggatggtctcaaactcccgacctcaggtgatccacctcccttggcctcccaaagtgctgggattacaggcatgagctgctgcgcctggccgaaagtttttaatattaatgtgttttaatttacttattttttctctatgattatcacattttttgtgttggttaaatagacctttggctacttcagtttcatgaaaatattttcccatgctctatcacaaaagttttactgttttattaagttaaaccatatgaaattactaatagtcaacataaaaaataggagtttcatatggtttaacccaatacatttaatctatgatctgtctggaattgattttcatctttggtgtgagtcaggggtcaagattttaaacaaatttaattgtctgattgtcaatttcttatgaattggatgactgtatatatgtgggtctgtttctcaactcaccattctgttctattgttttttttcattcttgtaccgataccttactgtcttggccactagagttttatgataggtcttttataaattttaatagctccgaagtgttcttcaagattgccttagctactcttagcccactatgtttccatttaattttagaatctcttgttttagaattattgctttatatatatttaagttgacatgtaataattgtacacatttatggggcacatagtgatgttttggtacatataaagtatagtgatcagaataacaagaattagcatatccatcatttcaaaca

SEQ ID NO: 28181 - DNA, 1072 bp, Homo sapiens
aaaatattaaatacataaatatatatttatatctaagatataattataatagatattaaatatacgtaagtacatatatatgcattcaattatggaataaagagtgtttgacctggccgggcgtggtggctcatgcctgtaatttcagcactttgggaggccgaggcaggtggatcacgaggtcaggagtttgaaaccagcccggccaacatggtgaaaccctgtctctactaaaaatacaaaaaattagccaggcatggtggctggcgcctgtaattccagctactcgggaggctgaagcgggagaatcacttgacctgggaggtggagtttgcggtgagccgagatcgcaccattgcactctaatcggggcgacaagagtgaaactccatctaaaaaaaaaaaagtgtttgactttaatgagttattacttcctggcttaaccccttttactttacagaaaagacataaaaaagtgaaattacttgtctaagttcacaataatggctgactgtgacaatgctgggcctagacttcagatctaatcattctaagtgtagtggactcggagatagctgagatagaggaggtggcgggggagaagtgctaactgctttattctctcatctgaaagctttaagtctgttaaaaatagaacttgcctagtcaaagtaatactctcagctattattattcaattataccttggtgtgaatgagtgtgacatccttttctgagaaataacccattaaagaaccacagaggagaaaagagtagaggctggagaaagtgcaggacttgaaagacaaggagtctaaccatacattttatctactcaaaatgtagagcagatgcaccagaaaatattaacagtggctatctctgggtgttaggataagagttgcttttgttttgttttagtttttttatattttccaagttttctgcctaatacacatattacttttatcattcattctttgttatctaacacagattttttttttttttttttttttttttgagacagagtcttcctcttgtcacccaggctggagtgcagtggcacaat

SEQ ID NO: 28182 - DNA, 1040 bp, Homo sapiens
cctgggtctctgccccaaccgaaggttctagaaagagatatgctgctctttgtcaccatcttttcctcactcaggaatgccagatttagcaagtaaacatacaggatgcccagctacatttggatttcagaacaacaagtactaagccgtgatgtgctgtttccccaaaagccaattttcactgagtgtcttgcacgttatctgacaatgctactcccacgccaccaggcttcctggtccagccacccacctcccctcacctgtggcgggtgggcaggggggcggtgatcaacagcctcctctgcctgcatctcaggatgttaagaggataatgagagaatagatgggtagctgctttccagaaaggtcattaattagccctgctggttagcatgtggttccagtgccccagctgtgctaaaggccttcctcttagcatccagttcaaaccaggagacatgaccaatgagactagagagagtttggtgtcatttcctcctggtgcccagagccccttctctgatgggtttcacataattttgtttcgaccctcttttagaatcaaaccaggctgggtgcagtgactcacccctataatcccagtactttgggaggccaagacaggaggattgctcgaggccagcagttcaagaccagcctgggcaacatagtgaaaccccatctctacaaaaaacttaaaaattatctgggtgtgatggtgcatgcctgtagtcccaactacttgggaggctgaagtgggagggctgcttgagcccaaaagttcaaggttatagtgagccatgattgtgccactgtactactccagcatgggtgacagaatgagacctgtctccaaaaagataacaataaattgaaataaaactccccagttcagcacctcttgcttttactagaggcaaatatagtgtttaatggaagatgtggggagaaagccacatcctttctaatcaagtgctcctactcccggggatattggattgctacctttgagtacagtgcttgctaagaagctggtaaca

SEQ ID NO: 28183 - DNA, 1054 bp, Homo sapiens
gccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgccttagcctcccaagtagacgggattacaggcacccgccaccatgcccggctaatttttgtatttttagtagagacaaggtttca

SEQ ID NO: 28184 - DNA, 1081 bp, Homo sapiens
cagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcagtgatctttaaaaatttaaccgtataaggcagaatttggcaagtctggctttaatgtctcatttatcactgccacttcccacc

SEQ ID NO: 28185 - DNA, 1022 bp, Homo sapiens
tgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatctctactaaaa

SEQ ID NO: 28186 - DNA, 1044 bp, Homo sapiens
gatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaattcagagcgagtccgtaaagtgaaagcaagtttattaggaaagtaaaggagtaaagaatgactactctatagacagagcagccccgagggctgctggttgcccatttttatgattatttcttgatgatatgctaaacaaggggtggattattcatgcctcccctttttagaccatgtagggtaacttcctcacattgccatggcatttgtaaactcatggtgctggtgagagtgtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaatac

SEQ ID NO: 28187 - DNA, 1019 bp, Homo sapiens
gtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatg

SEQ ID NO: 28188 - DNA, 1029 bp, Homo sapiens
tctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggag

SEQ ID NO: 28189 - DNA, 1060 bp, Homo sapiens
cagaattcttgcttgttattcttttgatgtatgtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcacctagggcatcgctccttctccagccttcactgcccaaagccccaggtccctgaggagcaaaggtgatggttctagggcaggaggggaaaaacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagaaatgaaactctggatagtcactgacactagagaatgaaaagattccaagcccggacccaaaggaactatctttggtctcatttcccagga

SEQ ID NO: 28190 - DNA, 1026 bp, Homo sapiens
tttggacgtaacaccattgtaagtcaagaagcatctctatctatctatgaacatacaatgtgaaatcaaattgaggccataaaacagttgaacctcatcataagagtgactcatcggtgtcacttctaagaccaagaaaaattctatttttatgcagagaccatttgttttttaattaaaagacaactctatttcaaagaggaaaaaaaatcaactcttttttcagctctctcagatgcagaaatgtaattatcagcatccctgtgctgggagcaatcattagtttttttagatttttaaaatatacttcattatgtttcactgtattcattctttaatcagggatgtgagggatagaataacatttagaatatctgtacagtttgtatataatgttcttatttcttgttgcttttataggtggaaaaaatctaaaatctcctcaaaaagtagaggtcgacatcatagatgacaactttatcctgaggtggaacaggagcgatgagtctgtcgggaatgtgactttttcattcgattatcaaaagtatgtgactctacttactgatttgtcagaatgacctgaataatttttacaagtttaacaacaccataatttttagatttggaaagtgtttggtttttctattttttagaaatgttacgcctattttacataatatttttaactttgtttctgtagagacttagtcaaatacatctttgggtgttgaagcaaaaaattggggatgagggtggtagacagcgtctctaacccatagccattccttctttcttctgggtgttccagcttcttttttttttttttttaattattatactttaagttttagggtacatgtgcacaatgtgcaggttagttacgtatgtatacatgtgccatgctggtgcgctgcacccactaactcgtcatctagcattaggtatatctcccaatgctatccctcccccctccccccatcccacaacaggccccagagtgtgatgttccccttcctgtgtccatgt

SEQ ID NO: 28191 - DNA, 1041 bp, Homo sapiens
aaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagacctctgattcaaaacttattagaacagtagcttctgctggaatttgcaatcactgaagtcatagaaaataggtaactatctaattagagaaataattgttgtattttaagatctgagagtgtgtacaagttttagtatacatgccatgccagaagatagtgtatgcaagaagtcttgggaccagaaaatggcaatgataggagactgacatagaagaagaatgcttccctaggaaaaaggtcgctggctttggtgcaagaggaagaagaatgttccactggaagcctgagcacctaatcagctctcagtgatcaacccactcttgttatgggtggtctctgtca

SEQ ID NO: 28192 - DNA, 1029 bp, Homo sapiens
ttgtaactaaaaattagaacagctccctagaattgtgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtattgcatagccttgctttcttgaactaaactgtttgcccttcacaagtagttcttctttcaggattagttcgttccaagga

SEQ ID NO: 28193 - DNA, 1035 bp, Homo sapiens
ttacatagcacaggaagaggctggccatcccaccctcatctgttattatgcaaatggcacctctacctagcccaggccttgttgcctgcttttttactgcacacgtggcaacaaagaaaagggaaaagggaacttcaatattgaatatacctgacttccaagtatccctttcctattggcacagctgctggcattcgcctatgcaagcttccagtttgcttatctatgtttgcagcttgagttttcaggctctttttgttagaaaagaaatgatttggggcttctttttattaaaaggcaaaccttactgaggactcttttatcctcactaactgcctaaataaattttgtttaggtgttgtatcaggatctgatgctatctccaggtagacagtgtcagaattaaataggaggatacccaaccagtgtctgctgcagaattgattgccttcttgttaatggggagaaatcactacgcatttggtcacagaagtcttctgtgtttattgttgtggcatgagagcagaggaaaaacggtttgagatttttcccctcaaaaacataggggaaatcttcatgatattggacttggcaatgatttattggctatgacaccaaaagcacagacaacaaaaacaaaagtagacaaatgggactacatcaaacttaaaaacttctgcatataaaaggaaataatcaatggaaaagacaacctttggaattggaaaaattatttgcaaaatatttgctttgatagattagcagataaaatgtggtgttcacatgccacggaatattattcagcctttaaaaagaaggaaattctgaggccgggcgtggtggctcacgcctgtaatcccaggactttgggaggccgaggcgggcagatcacgaggtcaggagatcgagaccatcctggctaacacggtgaaaccccgtctctactaaaaatacaaaaaattagccgggcgtggtggagggtgcctgtagtcccagctactcgggaggctgaggcaggagaatggcgtgaacccg

SEQ ID NO: 28194 - DNA, 1063 bp, Homo sapiens
cagaagggcaggtctgagccctgtgttttcagccgtgcagtggccagctgtggctggtgtccacactcccatgtgctaatggagatgcccaaagaatgtgtccaaagccagtccctgcaggtgcttctgcaacgcacttctgcacactctgctcacttagctgggacaagggaagctggagaacgtgtgtgctggtgtccctgggcaggctgagtggaagagcattttgtcactagcagtcaatccacaaacatcactatggctggtggtgggccaggcctgacctcacttctgccactgggagttgtctggacttagcacctccaccagaacaaatgagggggcacaactacaaactcagcagttcttttgcacagagagaagcttggccagatcatacacctaaccctcaccaacctggagtgcccaggggagagaatccagccctgctgttgtgaacacacagtgacaggattgtctccttgtgtaaaatgtgcagacattggtctcttagaacttcgaggacccaaactgtactttgatctgagtttctctggtgaattatacaatgtgcatgcttacttaataaatgcttgataacccctcattgatagcacatcatgagtcacagtcctagcctgacctgtgaattatatgaaaagcctgaacaaatagacttacatggcaacacttctcagttattgtgtttaaatatagtatgggcatggtgctcacgcctgtaatcccagcactttgggaggccaaggcaggcggatcacctgaggtcaggagtttgaaaccagcctggccaacatagtgaaaccctgtctctactaaaaatacaaaaattagccgggtatggtggcgtgtgcctgtaatcccagctacatgagaggctgaggcaggagaatcgcttgaacctggaaggcggaggttgcagtgagttgagattgcaccactgcactccagcctgggtgatatgtgcgagattccatctcaaaaatgaataaataaataaataggccaggcgcggtggctcacacctgtaatctcagcactttgg

SEQ ID NO: 28195 - DNA, 1037 bp, Homo sapiens
tagcgtatgccaaaattccgactcccagaaggaaaacagatgttcctcataaagaaaacacattgtgcaaacagtgtagggacggtaagccaccttaccagtttgggaatgggagggataaacttgaaatccaaattcccaggctgggcgcggtggcttacgcctgtaatcccagcactttgggaggccgaggcaggcagatcacttgaggtcaggggttcgagacaggcctggctagcatggtgaaaacccatctctactaaaaatacaaaaattagccaggcgtggtggtgggcacctgtgatcccagttactcaggaggctgaggcaggagaattgcttgaacctgggaggcagaggttgcagtgagtcgagatcacactactgcactccagcctgggcaacggagcaagactccgtctcaaaaaacaaacaaacaaaaaacgcacacaaattcccagatgtcagctaagggttgacctggaaatcaggcccttcaaagggcattagtgttaggcctgttacgttagctcttctgcagtctgtgactctaaattttaggaattccaattgaatgctgaaataaacccaaagggaatttttgtccttaaaatcgtgtcttcctctgccctggcagtccaacaccattaaacagaagaaaagaaaatgtaaaaccatcaagtaatactattattcatagatcatacaattacttttatatttttattttttaattttaatttttcagagacaatttcactctgtcacccaggctggagtgcagtggtgcagtcatagctcactgtagcctccaattcacaggctcaagccatcctcccactttggccttccgagtagctgggacttataggcatgcaccaccatgaccagcttatttttttattattattttctgtagagacggagggagggggtctcactatgttacccaagctcaaactcctggactcaagtgatcctcccacctcagcctcccaaagtgctggaattacaggcatgagccaccatgcctggcc

SEQ ID NO: 28196 - DNA, 1961 bp, Homo sapiens
ctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctc

SEQ ID NO: 28197 - DNA, 1467 bp, Homo sapiens
gatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctc

SEQ ID NO: 28198 - DNA, 1029 bp, Homo sapiens
ctaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataacc

SEQ ID NO: 28199 - DNA, 1035 bp, Homo sapiens
tgcttcaaggctctatagctctagattttggtggtagcaaatttatcgggtggagggattgatcggagagggcagatcctcaggttcaacacaagaactggattggaaaaggtcattgtaggttgatgtgagcatcttgggtacatagcccattgcccttaatgatggtttcttactgtttctctgggttgtttgtcagatagcctttaattttaattatttttccttccctttgctaccttggcccttttaaattcttgtgtttaacctaatgctcagccttggtactccattcccttctccttcccctctttgctactattaaaagtcggagaagtggaattcaaacgttgaaatttccacggggctatagttgtatcttaataatgccaagtgtcaaaacaaccccattaaaatgccgcctgattaaataatgtgctgctaaatatagtgcacatgaaaacagcaagactgtatatatatgtaaatatatatatatatctgtatctttgtatgtatctctgtatctgtacctttgctgtatcttttaataaacagtttacttttatttaacttgttgtgcaaaatcacgcttgggggatgtgggagggtggagtcttaataggggggtgggagttttaattactatagattagttgtcatcgcctcttgcccttggtttccaaagcccagacttttgccaaggactggactaggtatctgatgcccatctggacatttttcttgcagttcttggatatgtagatcagagacacctgtactcttcactgtaggttcccttccttggcttggccatatcatcatcttccagtaaacacctccaattctacaaataaatcctgtttataaaatcagaaagtgaacagaacccaaatcagaaactttttgatagcagtacttttctccccaagctattcacagctgacattttcactttttttttgtttgtttgacctgcagcattttgagagaacaagttctgtacaatgaagctggacatgataactagccagt

SEQ ID NO: 28200 - DNA, 1171 bp, Homo sapiens
atttattatttatacaattagtgttatatataccaatgttgtgaaatacttttggtaacacttcgtgggagcattaacccttttgattccttgttagagtttgaaataaaggcttctagagtaaaaggagatagttcttttaaatggtcaacctttgaactgaatagtaatttttatctatgcctttttcattttaataaatataaatggagtttgtggttctttgttgttgagcataaaacatttaggcaaagatcacagattttatctccataagagggctgaattagctttgctgtaatccctaatcccaccaattgtcttgcatatgaatgctctttgacatgagtatgaatggatagacattgtggatgaagcagcataaattcatttcttatggaaaaacaactcatcagactgtgtgcggtactgccatagcatcgtcttcatactcagaaaccagccagcatcatcctcagtaaggagtgactacagaactttgactgtatttgtgtgaatttgatttataaacaatgaaataaaatgttggaaaactaatattttaaaaatagtcctcaggggcattaattcttggtaataaagttagtagaggtttattgagtagaagattaggatgtaatctttgacataagtggagtagtaactactcaactattagtgtggagttttcatggatttagtatcaatcaaatgttttaggggtccagaggtagtattgttaaggtctagtgaatgcttagatgttaagatcatctttatgttaagcagtttactggtttgtatttatcaaatcatatttccacatcccaatggaattacaatttttttaaatttataagctctaaatgtataggaaaacttggagaaaaatgaaaattttaattggaaattaaacacataggtcccggcactgctagaatgtgtaatatacagccttgttattctttccttcctagattctcttatgtggttaacgctgaatttctctgaaccatttagtaggttatctatttgttttcccgttgtacttcatttagtctattatacactagagaattttgtatgatacaataaaaagattcgtaattcactttttaaagccaaccaaacacataactgggacattctgtggcttttatttttgtagttg

SEQ ID NO: 28201 - DNA, 1044 bp, Homo sapiens
tcttgtatgcattaacctctttatattttaatatttgctaaatattctaaaatcatgttttatatacaggccagatgcttttaccttaggtctattttcttataattaaagttttccttttatgcctgcttttgagatatctgtgattaccaataatagaaaataattttctggttataggtattttccttatctgactcaccccatcctaacaattatctttagctcttttatatcctttcactgatattctaagaagtctcttaaaatattgttctttttatgtcaacagttgtgttaacaaaaggagtaaatggatttagaagaatttcctaaatgagaaataaaaatgtaaaaggctcacttaaatgtattaatataggtcatgaaatgcatgttatatggtgccagttgcattatggtaatttcattatgcctcagacacctttgtaggttttataagaagtagttgtctgctttcttgctgagggagagagagtgaagaatttgggcagtttttatttacctgagatttgtaattcaggacactttttatgtaaatttcaccttttagagcaaaggtgaaaagtcagtaaacatttcccccattatcatacctagaatattactacagaattatttttatacactaggtaacatgctagtcttatagtgtattggtagaaactaaggcttgttggtgacagcttggtaatagtattctacagattaaagattctctttttcccagtttttggaggggccttttaccatcattttggtgcctttcttatatttccagtttctgaatattaaacgacagttaagattctaaagctctattgtccaatacagcagttaccagcccctgaaaaatcaggtttttaatcacactagttacatttcaagtgctcagtagtgatcactgtaagaagttgtactgggcaatgctgctctaaagggtagctgtggtattatgagtgtttcaatactgataagtaacatcgggtttgacccttaaacattgctgctttggggattgta

SEQ ID NO: 28202 - DNA, 1847 bp, Homo sapiens
ttttttagtagctgtgcttttagatacatttcaaaatcttattaatgggattcactaaatgttgtcaaactgcttctttagaaagtttaggcaaacatttaatgttaaatatgttttaaaagttaaatatttaagtctgcttttcagccatttttagtgaattattaccagtgatgttttaatcaggtaattttacttagttaactgagactacttcttttcttcagattgatgcctgggctcagctgaactctattcctggccagttcacaggaagtacaggagtacaggttttgacacaagaacagttggccaatactggtgcccaagcctggattaaaaaggtacacagtatatgcacatatgaaagtgtcgaacaaaaagtttaaattttttggaaactgtttattaaaactgcatgaaaagaccagtgactctaaccaaagttccaagtaaatttgctatgtgtatatgctccagggcggacactgaagacggactggattcatgagaaaatggcaaatgtataaatgtggctcaagagccactaacttataaggttattttaaaaattgttactgctgcttttgaaggggtgatttaactttattttgaacgctaatagtgtatcaggtgctgttcagaatattccacagttcctgctggactactaacctaatcatttcaaagcagtggttctcaaatttttcttcatcatgggatactttattacaggtttatttttagtggatcactgcccccaagagccctctaccaccttaattttccattcctctattcctttgccctcgcaccccacccgcttcattagtgcctgtgccttcttgtaagatctcttggcccccgttcctcactcctcttgtgacctgtagccccaggaccttttggttgtcagctgctggttacagcaagtggttgggaggccctagtattagctctgcatgtggtgatcttgccatgggactggaagcctgagggaggatggctggagtggggtgggctgtggtgaaggggatgggatggagattaatctgtggaccaccatttaggccctagtggcctctggtgatccacaggctcaatttgagaaccactaatttcatgacaaaacagatatgtaagacctaaaatcaagggagagaatggacgcctcgtgctacgaagatgtaggtgcatctggtttcagattctgcagtgagacctgtgaactccacctacggctgcctcatcattgggggagtcttaggtggctaagaagggcattctgaagaaacgcgttgtggtgaagggacaaagcttggttggatgggtgatgggaaatttgttacaggagtactggcagcatagcagtgctgaaactgggaggccgcgtggtctaatggattgggaaggtttctttatcctgttgtactcctgactccttgtgtaatcatgggcaagtaactctttggaatttcaaagtctctgaggtgtctagtggtaatcagtaacgtgatggttacctatagagagttgctatgagtgccagtgaatgagctgaatttctgaaaaatgagacattggttgctttgtgtattttaatcttgtaacatttatttcaattttgatagctttatctttgttgatcttactaacaaattaatatgaaacatcatgtatactcattatgcctgcctttttttgggaagtagttgcactgatgtgtatagtgagtacacagttagattcattaagaaattacaatttctgcagtttgctgagggttggtgttagaataaagggtgaaaatgtatatagcaaaatattttaaagattggattaatctt

SEQ ID NO: 28203 - DNA, 1030 bp, Homo sapiens
aaataaagcttatgggtgttaaaataggcacataatacagagtcatgtacactgctaggtagaaacttctgaatgtgcttccattacaaaattttggtctttatctaatgatgtgctgatccataatgtttgtatacttataaatgtgttaataacttaaataacttttaaaaagtgaatcttttactgactcaattggttttcccctaaaataatttcttctggtatttgcagtcttgtaggcagttaacagactttaataactttaaaatgtttagtagcaccttgaaaaaaggcttcaactttatattttatgtaagatatactttgggaagcaaattattttgataaattatgagataaagatatgttcagaccaaattttaaattatagataaaagtagcacttaaaggaaaagattcatttgtatagaattactgaagaatatttgatgctagtatcaactaaaaaagaaacttttgaaaattaaaaatgggccacaacatgtagaagtcattaggcagctgaaaatttaggatgtatgatccatgttaaatatcacaaatattgtctactcattaaatgtttagttgtgtttagaaaacctgtcaaacgatcattttggctcttctttagtatagtccagcatctgccttatgtgttaaaaaacacatggaataccaacatcctccgtgttctttttagtttgttgcagtgtatttttagattacaaaaaaagcaaagttttatcagtagtctcattaatcagtaaaacatttaaagtagttcgtttaaaagaaattttatttctagaatggaatgatttggatgtgacctgataaatacagtttgttattgtggtctcattaaattaatcagctttttcacactggggtaaagaaacagatgatgatactagggaatggaaacaaaattggaaacctgggttatttggggatttatattgtactctgcacagttgcccttttttttaggcgtgttccctggaaaagagggacggatgaacct

SEQ ID NO: 28204 - DNA, 1050 bp, Homo sapiens
gcctcagcctcctgagtagctgggactgcaggcatgtgccaccatgcccagctaatttttatattttcagtggagacggggtttcgccatgttggccaggctgatctcgaactcctcacttcagatgatctgccctcctcagcctcccaaagtgctgggattacaggcgtgagccaccgcacccagccgtgattgggaagttctgagtttagttagctgttcagtgaatgtttgagtacacgctgtatatgcctggcattgctctaggtgagtagccttgaaccaagatagaatctcagccctctaagacttctatgcttttttaaaaattctcgagtttttcatacagaccatcatgtttataaaggaccattttcattcctagaatttataatttatttttaacttgtatttctttcttttttttcttttttgagacagagtctcgctctgttgcccaggctggagtgcagtggcacgatctcagctcactgcaagctccacctcccgggatcatgccattctcctgcctcagcctcccgagtagctgggactacaggcatcagccaccacgcccagctaattttttgtatttttagtagagacggggtttcaccgtgttagccaagatggcctcgatctcctgacctcgtgatccgcccgtctcggcctcccacagttctggaattacaggcgtgagccactgcgcccggccaatgtctttcttttttttgagatgatgtcttgttatatcgcccaggatggtcttgaactgctgggttccagcagttctcctgtcgcagcctcccaaagtgctgagattataggcatgagccaccataacttgtatttgtttattggcatggaacttctaaaacagtgatgaatgcttgttaccctttaattccttccttctttccttcctctttctctttctttctctctttgtctcttctttctctcttttgtctcactctgtcacccaggctgagtgcagtggcatgaccatgattcactgtatccccaaccttccaggttcaaggaatcctc

SEQ ID NO: 28205 - DNA, 1165 bp, Homo sapiens
actttcagccctccgccaccaccagctccagggaagagagagggactggaaattgagttcagtcacgtggtcagtgatctacttaatcatgcctatgcaatgaaattgcaaacgaaagccctggaactgtgaggttcggagagctgggttggtgaacccatgatgtgcagaaaggtgagtgcctatattgcacagaggaggagagggcatggaagctctgtacttcctctcccccatgctttgtgcagtgagtctcttccatttggctgttcctgagttgcacagagcttttccatgttcggtgagttgttctagtcaattacttaacttgaagtggagttaggggaacccctaaatttgtagtcagcctggcagaagtgcaagacttgaggctggcatctgaagtggggaagtcttatgggaccaagcccttgatttggggagtctgcactaactccggtagtgtcagaattgaaatgaatggtaggacacccagttagtgttggagaacattttttagaactcagtctgcctatagtatttttgaatactgtgtctatacacagtatagacttagtacctgcccttaagctagataggtgaacaagcaattataatttagctttgtaagctattcatggactaagtcagcagcctgtactttttttttttttttttttttttttgagataaaatcttgctgtgtcacccaggctggagtgcagtgagatgatcattgatcatggctaactgcagcctcaacctcccaggctcaggcaatcctctcacctcagcctcccgagtggctaggaccacagttgtacaccaccacacctggctaatttaaaaaaaaatttttgtagagatgggatctcactggtctcaaactcctaggctcaagcagccctcccacctcagcctcccaaagtgctgggattagaggtgtgagccactgcacccagcctggattctatctgatgctgaagtcggtggcttgattctgtcaattcagcctctgaaaggtcgtttgaattcaccctttctagccccactgctctggtcttagtccaggcctttatatattttttcactttactactttgctcttaatggttgctgcttcctgactcgtctggcttctctgttccacttcattttacactca

SEQ ID NO: 28206 - DNA, 1076 bp, Homo sapiens
tgttatgtgctgctcccacaataagatctttccccgtgcttttatctcctaaggtggtggacctcaagccttttggtatcaaaacccttgtgtcctcttaagtgattgaggtccccaaggaacttttcttcatgtggatttttgtcttatcattgtctgccagattagaaattaaaaccaagaaatttacacttaaaatagctgtaataaacctattacatgttaacataaataacatttttatgaaaactgttcacaaaacaaaaaaatttagtgaaaagtggccttgttttacattttttgcagatctctttcatgcctcactgaataaaaagatggctgaattccataactgctcctgtagtcagtttgttgtgaaacgttgttttggttgaaatagttgaagaaaatctggccttatacagatatgtagttggaaagaacaggagtcttttagtggcatttccagaaaattgtggttattttgtgatactgtaccaaaacttgacactgggtagtttcttaaggattggttgcagtgtagaatctgaagtcatataagtgaactttttatcctctgttacaataaaatctgttgatccatcctatactttgaatggctattttacccctgtttgatttgaccaatacatacaacatcatgtattggtcatttggaaaatactgggtcactgagttatgtaaatcttacaaatgttgacacatttcattaaacaatatcacaaaatcgtgtttgttatcaccacccatcttattagaaaattctttaaatgttgagaagcagtctagctcataatggcagatacaagttttccaaaattctaattttcaccccaaattcaaattttatcatgaacagcaagtactgtcagttgtttttcttgcagcatcaggcttgctttatttttgagaaactgtgccagatacccaaatctgaataatcatagttttttttggttgttgttttgccaaataaaaatcgagttcctgtaaaaaaaaaatggctagtttagctcacaactcaaatgattgcacagtgattttcttggacattg

SEQ ID NO: 28207 - DNA, 1059 bp, Homo sapiens
catctttactgcttcagaggttactagatttggaaccaaagtgtactttttgggatgcggtaggtttctggttttaaaaaaggatgtctggtattgattaaatctatagttttgaactttctaatccagcagctctgtggagtaggtactgatacttggattttataaccagggcacaaaatggttaagtaacttatctgtggtccgacggctagtaagtggcaggtctggtgtttggatccatgaagtctgtttcctgagtctgcactgttcacagtatgcgatctatgtaataccgctccttatgtacattgtataataatagctccctgggaatgtatgtgtgaagttcccatttggaaggctggcatcgtagtactgcactgatagtggtggcagtgattgtgaggtgggttgggttctggtgcctatggcaggggctccagcaagcagatggttagaagacagatagggagcaaggataggaggatgggctgctataggggccagacctcctgcccaggatatttctggtccagttcgaaagttggacctttccttcctagagattggctccacttatggctttataataggacctcttccccttctggagtcctttggagcaagatgcattttcacagttttctcccaacctctttacttgagtctagcacttactgcctttgaacttctctgagggtttttactaccaactagaaatgaaagaaaaagttgaagagggagatggtattcaaaagataagtgatacaaattggagtcttttaggattcatattattgaaacgcaatttgtcaacctccctaagagggtcacatcactgtggtgtgggcccccccaaggcatgtcatcactgaggttaggatgggctctctgccatgaggagtaagccagtgcctccagctactggctagaaacagggagtgttgtcaggagatctgcactggggctgaaggacatccccgcctacttcccttttgctcttcttactatcagtctttactaccgcagatccctttctagggtccacgacctttg

SEQ ID NO: 28208 - DNA, 1050 bp, Homo sapiens
gatgaacctggagagcatgctgctaagtgaaataaactagaaaaagaaaagaaaaatattgcaagatctcacttatatgtggaatctgaaataaagctgaatatgtaagaatagagtggctgagtggttatcgggggaaggggaagtgggagatgtaggtcaaagttgcagttacataggatgaataaaactagagatctaatatttagcatgatgactctggctaatattgtattggaaaatttgctgagagtagatttcaggtactcttaacacacacacgtagctatgtgaggagatggatgtattacttctgactgtagtagccatttcactgtgtatatgtataacaaaacatcgtgtcatgtaccttaaattatacaataaacaaagaagaggtgccggtttgaaggggcgaggacagagcgtggacttgcggaaagttaggtggccttggtgatttaatctctcaaaccttcggttttcttatctgtaacacgtattagagaaactgtgtcttgtcggaacctacccctcagtgggggtaatcccagctgtttgtcctcagctcatttctaactgaactgcaggcttctcaagagcagccaggatgtcaccttttcatcacctagcaccagctcaggacctggctcattaatttattgaacaaatgaatgtggcagaaaatttgctattggtgttggactgtgtttaaactttgtttcatgtttatcatggttaaacctccatcagaggtaaacaactatgttaattattacatcaaacttctgtacatcttgccccaaatgggatcatttatttgttcaggataaaatgtttttgaagtttttagcacacctgatagttgtatttcttctagattgggcttggatattgttattactcaggaatctggttgaatgtttgattgtataactctgcctttgacatatgtaattaaatgagtttgtatttaatgtgttccttgaggcagccaggtgtatttacctcagaactgttgaaggcttgccatgtctctaggactcattg

SEQ ID NO: 28209 - DNA, 1082 bp, Homo sapiens
aaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcacagtactgagtcacttggccacattaaattctttcttagaacaaaatggaatagagaaaaaataaacattgttatcctgattaaaaacctaattccagccgggcatggtggcttacacctctaatcccagcactttgggaggctgaggcaggtggatcacctgaggtcaggagttcgagaccagcctggtcaacatggcgaaatcccatctctactgaaaatataaaaaattagccaggtgtggtggtgcgcacctgtaatcccagctactcggagaggctgaggcaggagaacctgggaggcagtggctgcagtgagccaaaattgtgccactgtactccagcctgtgcgacagagcaagacttcgtctcaaaacaaacgtgattccataaaaaattatctttcaaccaggtatttttcttataagctaattgattaattagttgactgagatcagtagttctgatttctgttctcattctagactttaggttaatttgaagatcacagtaataaaatctaacatctgattcatggggaggttctttaacagtttaaaacaaaacatgaaaattgtggctagagtttcttttcatctcttcatcctcagatagctgatgataggtgataaagtgaaatagatttcggagggggcagtcaacagtaattcagggtgtctctgatataattaatgataagctaagatacagaaatactctggttttacttactaggtttcctattaaaaacaatgtattgcctttcttttagtaagttttagccacaaggctggtttttgtaaggggaaaggttttggaagatttttaggcaaataggatagtggtccaagaaaagaaagaaaaa

SEQ ID NO: 28210 - DNA, 1837 bp, Homo sapiens
aattaagtctcttttaagccatctcagaacttttgggccgggtgtggtggctcacacctgtaatcccagcactctgagaggctgaggcaggaggatcgcttgagctcatgagtttgagaccagcctgggcaacatagggagaccttgtcgatacaaaaatttaaaaatgagatgggaggatggctggagccagggagatcgaggctgcagtaagctgtgattgtgccactgcactcttgcctgggtgagcctgcctaaaaaaaaaaaaaaagcttttggaatttatcctgtcttatgtcaatcctcactagaaattgttaagtgaatcaagtcattttcccactttcaagagaaaagcatgttgaatataattcagtgatgccttcattaccttttaaaaatgatttaaagaaaatccataaactgaaaagcactgtgccaaaagctttacattaactcattcttccccatgagatgattctgttactctctgttatagatgagggacaagctcagagacattatgttactcgtgcaacagaacgtaactcataagtgacagagctgagtcaaactgagatgtctgattttaaggcgtgtgttcttaactatgcaagttttctctaaaaaacttaattgtaggatacaggtatttatttgtgttccatttaattgcggttttacccttaagatgcctcaatatgtattgggcatctactttgccaggcacatcattaatcctattcaaccccatagctacctatgcagtagatgtctcaagatggtgcatgaggaagcacacccagagaagctctagtcctcacccatagtttacagcttagtgcatggtggagctgagagttaaacctatatcatcttacactaagttcctttttaaaaaaaattctcctgggctgggtgcagtggctcacgcctgtaatcccagcactttggtaggccaaggtgggcagatcacaaggtcaggagttcgagaccagcctggccaacatggtgaaaccccgtctctactaaaaatacaaaaaattagctgggcgtggtggcgggcacctgtaatcccagctactcgggaggctgaggcaagagaattgcttgaatccaggaggtggaggttgcagtgagctgagatcgcggcattgcattccagcctgggtgacacggcaagtctctttcttaaaaaaaaaaaaaaaaaaaaaaaaaaaattctcctataccatgctgaagttttgagtttattatgactttgcagaagcaattttgaaatctgctttattgatttgtgacattagaatgaactatcagtattagtgaacattagtgctattgaaacaactgttttatgttgtcacctttttaataacttaaatttctagccaatttttgcaatgcagtattgaacttttgggtacatcttcatgagtttttagtctatttaaattctcaggaatttggcagaaaactctgatgtgataagtgtaatctgggacaacttgtgtatgtaacacccaacattcctggcgtgtagcaactagatagttagcttcttgacaaataggtgggagttggaatcagcaaaatattagttagttaacatgagagggttggtgcagaagtacccacagcagaatagatcatggtaagtgttttttattaagaaattcataaaaattgaaaaaggtgaattcatataagtacttctcgagtgtttgggaggtatttcctatacttgaactgtatataatagatataagtgcatagataacacatggaaatgatgattaaaaagttcagtatttcagtaagattgtgcttttacatg

SEQ ID NO: 28211 - DNA, 1052 bp, Homo sapiens
agtaataatttctcttttggtggagtaaaatcaactcttgtttgtttttgttcaggggtgttttagtttgattttactacataaattttccttcttggcgtgtcagtaaataagaaggagcatttttagttagcacatcaagcattcttgaaggcataaagaatggaattctaatggggaaataatcctgtcatcttacgtaaatatagtattatgtaaatataatacccagttctgtgtattccctttattcccatagaaggaatactgtatttttatgtaattttttgttttctaatgtgatttcttgtaatgtttaatatttcatccctaaaaggaaagacttcctagatgccatttttgtgaaaagacattgtgtagtgtaagaactgaaaaattagtaatttgtctctgtaaatgtcacaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctagtgagtgaagtttggttatactttgaaaatatactaagatggaaccattaaaaacagtaataatttttattatctttcatttgttcaagaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggtgaggaaatatgcctcttaaaagctattatattaaactggcatccttttctctaattcatttcatttacttacttattcagtaaacattaagcaactgtcttgtactaggcactgggaagcaaaaatgaagtagacagggtccttgtgtgaaaagtagcctgtcaaggagacaaactcagcaaatatttactgagcactgcttcgggccaggtgcttttgcagtttctgaggctacagcagggac

SEQ ID NO: 28212 - DNA, 1045 bp, Homo sapiens
aattctcgttccctctgccccagaaattctatttttctccttcctctcattcttctccttcctcttttgggcacatgcacaaatatgtgtgtacatggatgttcactgcagtggtgttggtaaaagcaaataaacagcccaatgtccatcagtaaagggatggcttaaataaattatgatacagctaaaaaatacaatgaagattaaaacttatgtagatcacatatacacataagatttccatcaaaaaagcagaatatgtgcagcataattgcattttggttcgaaataaaactatatatgtattcatgtgtttatgtatagttaacagttttgaaatatatatatcaaactgttaacaatggttaccactgggcagtaaagaaggggctttcgtgttgaattttatagacttctatgttattttcatttttataaatgtatctaatttgtaatttttaataaaacaaaataaattcaaggacaagtatattagagagtatctactcaggactgtaataatgtttattatatctcagacctcccaaatatgtaatgaaatgtagaatgtactactaggcataattcgttggcttgcagaagggacagcagtgtttcgattttgtactacaaaatgcattgtgatactccaggtgccattcagctgtgttatctttgtgaggataacagtcaatgcaaaaagatagatattgacatctaatagcaacaggtttgtatttttttaatttcatgaattttgcagttaacaaatgatgagcatgagacatgtagtacaacattactgtcagtctccctaggttgaaaaatccggggttcacttatacttttgtgggcacagtcatcagattctcagattcctcaaacgtctttgggacatagcttactataatatgttcgatttttagaagtctaacattgtgacagtgttttttaatgtaggcagtcttagccttaaaaatattttgtttttagaaaaacttagcctggttttatccaaaactataatttttcatgtttaacaaaa

SEQ ID NO: 28213 - DNA, 1065 bp, Homo sapiens
tagaacataagaaatgagaagacctatgctcactgctgttttgttgaagtttatcttgagaacacaggctgagtgtctaaatcagtacaatcttttggctttcatgggccacattgcaagaattgtcttaggctgcacataaaatacactaacactaataatagctgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaaatgcttatccttggactggtacaggcctgaatgcatccagattgctgagggagcttccaaaaaataaccatgccagggctcatccccagagattctgagaactctactgcatatacagccttcagaagtctgaccaggtggttctgttaggtagtcaatttcaggaaccgctgatctaacctaatctctttttcacgtcaggactaatcctaaatcatttctagaaaatatcctcttaaaaatatccaaagaagaatggacttctttagtagttatcagtcattagccagtcagttcattctggaaattgtttgtcttagtgttactcttataacaatttttaactcattcttttccttttcttctcctgacagacatttttttaaatgtagccaacaatacctttttcctctaccttccatagatttccatagattaaacatcagaaagtatctcatttagtaacaactggccataatatcactgcagttttgagggaccagtatacacgattacagggttggctcaaatctggcccaatcactgcctgttttataataaagttttattggaacacagccaggctccttcattcacatattgtgtgctacagtggcggatttgagtagttgcaacagaggtgaaatttgccagcctccaggttggagctttagaaagagtttttttgtttgtttattttttgtttttgagacggagtctctctctgtcgcccaggctggagtgcagtggcgcgatctcggt

SEQ ID NO: 28214 - DNA, 1096 bp, Homo sapiens
ctcatttaactattgttattacaaatgataatgatcatgtgaggatgtttctccggggctttgcagttacagagtatttccctagcctgtatttcatgtaccctcacaactaaccttaagtggcacagtattgttcccattttatcaatgaggaaatcaaatgccttttcctctcctccttgttcttttatttatttttctttttgagacagagtcttgctctgtcacccaggctggagtgcagtggcgtgatctcagcagctcactgcaacttccacctcccaggttcaagcaattcttgtgtctcagcctcccaagtagctgggattacagactcaatgccaccacacccagctaacttttttttttttctttttgagacagagtctcactctgtcatccagtccagagtacagtgatgcgatcctggctcactgcaacctctgcctccgaggttgaagcatttctccttcctcagcctccttagtagcttggattacaggggtgcgccaccacacccagctaatttttgtatttttagtagagatggggtttcaccatgttggtcagactggtctcgaactcttgacctcaggttatccagccacctcggcctcccacagtgctgggattacaggcatgagccactgtgcccagcctcctccttgttctttcactgtagaaagccacattaagtatactaggtttgtgttgcacaggctcattggttgccatctttttcttttttctttttttcctcttttatttatttatttatttttttggtactttactgtgggtaaaaagctggcatattagggagtgcttgcttttttttttttttggtactttactgtgggtaaaaagctggtatattagggagtgcttgttattcatggtgttgtgcttttccctccaggtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtga

SEQ ID NO: 28215 - DNA, 1006 bp, Homo sapiens
agcataatccagatagggcctatttccctgggtctacctaatctaaaatgccagttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaaggtatttttgtatttatctgcttgtatttgatgaaaacaatattaggcgttatattactgtttgcactagttaagattcacagacaggagttgcgggattagtttgtcttctagatcttttaactgcaaaagttatagtatatagagtaccaaaagggagcctcttatagataagtgcattctttcttctctcatgaaaacctatgtgccttgtttttcattgccttatgcaagaaggaattcagctctgagacctggaacactcttgtgcattagttggagattatgactctctttatgcttattacccagtgctg

SEQ ID NO: 28216 - DNA, 1080 bp, Homo sapiens
tttggttaccaagaaagatggtgactggtggacaggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcagaatgccatcagggctaagtggaggctgagtgtgatggggctggtccgcatcagctgggaggataatgttcagtattaagctctcttcctgcctgtaactgacttacgctttggagtaaactttcttgattagatcattatggtcattgatttttaaatgcccaagaatggtagcaatattttgcctgtataaacagaagtattctggtgataatcgccccagaatattggatattattagaaagtttttagaatttctggttttgcccacacagtagaaagacacaagatctaagggatgggtacacttttggctaggccttagaatctccgttgatcaggactgaatttaagtgctgttatccgtatgaattggaagtgctctcactgttgttaaatagagccctaaaaatttgatcacataaactgtggtcttaagatagtgcaagttgaatggaatggtggggtggacctaccacagagcatgggagtcagtcttgtaggagccacttgcacgttagtggagagtttcagggtataaatggagtcatttaacagatccaatgcacatttaaaaaaaccaacaagaattaactccttttttttttaagtgttgacagtcaattcacagttattttctttttctcctcatacctcctaggtactgagagagaaaaggctggcagggagcctgtaggggccgctttctcaggagtgagcaagtggacaaagttctctctctctttcaaatgccagtagtagagtgtatactgggctcttacatgtgcggct

SEQ ID NO: 28217 - DNA, 1188 bp, Homo sapiens
taggagcagtgaaaacaaagcattattaaaagggaagatttttaattaggtggaagttgtttaagccctcccttcaacttacgtgttttagggaatgtggaacctgggaaattcgttactgaaattccttttgtttactttccttgtcttggggaggtagcaggtgacactgaaagaggcaacctgtaggcaataatatttgctcattctgtaaccctttgaaacctttgaaatgaagacttgccctcccctttgtttttgccatagttgccaagtatcttggttaacatggctgcaagtattaagtgtatttcttttaccatttttttttatgtcctgtaataacatagcctttggatgtggagcacccatttttcactctagttcagatcaacagagcgtaatttggttaaaataataaataaccttccttgaaatcttcgcatgagggaaggggggcaaaaaaaagaaaaaaagccctagaaagtagataataaaggtgaactgcctcttggagaaagaggccccatggcagtagatagaaggttgtaacagtggtgacttatgtacaatggcgaagttatgttgaggagatccttgacctaaataaagtaatattaaacaatagcttctcagttatttgttcaaaaacctatctgtagcttgtaaatgtggcacaaacacaaagacttccaggttttagaccagtttgcttgctttcagtttaggaaaataggattctaaaataggatgaatgtttggggggaaacgaatttaaaaagttaactctaggcttatgaaatgaaaaatgcgactgtgagcttgcacaccggtagcaggccttggagaaaccacagttctaacccgaggcactttgtgcttctgttgcaagaagggtattgaagctcctcagttcaaagttgcgtatcttccacgtttttagattcttaagtgtatacctctttacccctttaatatgatgtattttcctttcctccccaaatcatttgtgcatcttggaattgaggaaaatgctgtgttaggcaactttaacagcggatatggaagttaagaaactatagttttccagcctttggactcccagagctgctctcctgttttttctccgcagtactcagcctggagagcattcttagtctgtttggagaatattaactcctccctgtc

SEQ ID NO: 28218 - DNA, 1188 bp, Homo sapiens; identical to SEQ ID NO: 28217

SEQ ID NO: 28219 - DNA, 1188 bp, Homo sapiens; identical to SEQ ID NO: 28217

SEQ ID NO: 28220 - DNA, 1050 bp, Homo sapiens
atttgtagattgtacagctaattcctttaacttaatgttttaaagttgtgggagttgataaagattggcttagatagaatctatagctgtgatgactgggtcaagtatagaatacacttaagacttactatttttccccttctggtggaatgactaattaacactgataaaaagaatgaaggcagaaagcgttgaacttggatggtgagaacatagatacgtctggtcttacagctgacccatcagggctttgctgtatgtgaagcctatgcctgggacttctttttacttttaatctctgcattttatccatacacatccattcacatgatcacacaaagatttcaactggtttttatcttacgtgctgtttgcagtcttactttgttaacagttgttacatatccatcttgtgtattttcaagcacaactttttaaacacgcatgatcttttatcaatatcgttaatgtttcttcctgtcagtaatgtccttttcactgaaggtagtattgcatagtgattaagggcaaaagctgtttagacatatagatgtgaggcaacatcctggctgtaacacagacagctgtggcctggggtgagttatactacctcatggcttcagttttctcatctgtaaaatggtcataataattgtacttatctcatgattgttataaggattaaagtaatgcacataaaactagacacagtacctagatggtgttaggacttaggttagtgtaagatttttttttttttttaaatttccattatttataactcacttatctttgataaacagtcttttacaagcagatagtgttgagcctcttgaattcttattgagttacacaaatgtttggttaagattacatagtaataggcattgctgctctgttatttcatatttccttttctttttgagacagtctcgctctgttgcccaggctggagtgcagaggtgtgatctcggctcactgcaacctccacctctctgggttcaagcgatcctcttgccacagcctcctgagtagctgggattacaggcg

SEQ ID NO: 28221 - DNA, 1384 bp, Homo sapiens
taaataatgtttactagtcatctgattagattttattaaaaatttagatgattcgtcctacataatgtcaaagcatttgtttaaaaacttggaagcttttgggggtggggaaggtggtcatagaaatatgatcatcttcaggatttggcaggtatgaagtgatacaaacctcaacttttaagatttttttttttttttttgcttttctctggcaatcaatcttatttatgccagccgttgacacttagaaaggatttaaatcacttttcatagcataattattgtattgcttaatgctttaaaaaggcacgcagatgggattgagacatttctatccaggcagttttttctgcattagacctaagaacctaattttgtagggcagtagtctctaggcattatgtttagctccttttgtcagtgagaagtgtgttgtaaagtttctaatactgtggtctgttttgaacggttttgagaagaggtagctttagtataatttataggacttaaaaggaaaatgcctagaatcatcagaaaaagcatggaaaaacattcttctctgaggttgccttattggaaaaggagaaatcatttagaagttaatgtgtggaaggcattaggttgaataaaattgttgttcgtattgatctgtcagctgcaattacaattaactgaaaatttagtatttgtctctttttcaggagagaagccgtcaaattttaatacatttaattttaggtatatttaaatgtctgttttgcagagtgattatcttaatccagaactgaaaaattcctgatggtcctactgaagatttatctaatggtccacaaatgtctgttttgttgaggtttggcggacataataataaatcattttttagtcttctgaaaacttttctcctcctccctcttttctctgcttcttatacccttcaacaaaaagcattaaaaggaaaacataaaatcacgcctttagtcagtgccgttatcctctcagaggttgttttggaaatactgcctgatgaaaaggaagagaaggaaattgcttcttttaaagtttgctttttatcttcttgcagcatcttctaactggcagaaataatacaatttttgagttgttttgtaagttggatatttttagttttgtgtggaatgtcgtgtttcccattagggcagggggcgtctcacaagatctaggttactgtatgacaactatatccatttactggagtttaagaagctttataacaatacatttccagagactaggcagtacttggttttctgtatttaaattttctgagggtagatgataacatctagtaaacaccacctgcctgttccatccaggaccctaactggccataaagttacccccaaac

SEQ ID NO: 28222 - DNA, 1038 bp, Homo sapiens
aatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggcttgtatttagggaaattactttcataaatacttttgtagattttgaatcaaaactcagtctttttaatttttttgtagtctataaactagtttcattatgatggacttgattagtccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacattactgtgtaattcactgataattgacatattggctgggcagcctatctcttccatatccagcgtaaatgaataggaggtgtttgtgattttttttttctccctttatttaacattgagtcctagtagt

SEQ ID NO: 28223 - DNA, 1032 bp, Homo sapiens
ctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttatatttctgtgactaagtattttcagtatgaacactgccacaatgtagtgttctgggtctcagagttgaagaagagtttgtacctcagtttcttttgcccttggcccatgaatggtttccagtgaatttccccctactaatttttgtcatttttaatctttgtaaacactgactcacaggtattgactgagaataggattatgtgtaaaacatagagtaaattaaaatatt

SEQ ID NO: 28224 - DNA, 1391 bp, Homo sapiens
tgcttagagccccttttgtttagctcttggacctcctggactggtacacttggtttcatgcctttgctcttaattttcatctctttgctctttctagggcagtttctaaactttatcttccaacccttctgttgaaaaagaataaaatttctgttgagtttttcaattttaagagctcttttgttcctgaaatctttttttatagtctcttattcttgtcttatatcttgtatcttctcatctctgaaggtactgtcgtcttccactcccgctttatttacttcaagatagttttttttctgtgttaatcttccatgttaaaggcttttctccgatatatgctgatctgcttatttttaatagggtggagcacgctggcatcacgattgggcctgcaacggcctggctgtttgttgggttaagtcctgcgatatctttagaataagtcaagctttccaaagaaagttttgagttttaaactgaaggataaaaggccttttgccatgactgtgagagccaagtggggaaagaacacaggggccccatcattcacagcctgcattttttccttaatctctttggtacagtactaccatttagagctgtgcctgtgccctccaatgcagagccctcttttttatctgccgcagagtataaaccttcaaatatgcatctcaggatccaactagtccttaaacttttgaccaattgtatttattttagtgtcacttcacccccacttcccagaggtgcccagtgttggtatggttgattcttagtttttcccattgttgattttctgcttctacttcctttcttccagaatgttattgctaatgtttcttctcgtattcttgtaaggttgtacctgaaaaaaaaaaatcctgcacaatatgtgcatcaaaacatcacattgtttaccttgaatatatatcatttttatttgacaatcatacctccataaagctgaaaaaaatctctttacagtagttctagtaggttttcaggtgggagcataattaggtgcttgtgttgaatcctctggcttgcctggaaattctggtactcaccctttaaccttttgaaggttgaaatttcagagcctattgcccatttctgcccttccctgagataacatgttgcctaccagaagcacagttggagttttaaagttctgcttatttctaagtgctaagcgatgaaaattgttcacatttcaaaggggccttaaaagctgcgtagttggctgggcacagtggctcatgcctgtaattccagcacttttgggaggctgaggctggtggatcacttgagcccaggagttcgagaccagcttgggcaacataacgaaaccccatatctacaaaatacacaaaagttagccacatgtg

SEQ ID NO: 28225 - DNA, 1024 bp, Homo sapiens
cgcctggctaatttttatattttcagtagagatggggtttcgccatgttggccaggctggtctcaaactcctggcctcaagtgatctgcccgccttggcatcccaaagtgctgggattacaggaaagaaccactgtgcccagcctactccatgtttcttaaaaatggcctatataatatgattcataagcaaaggagtacagcatttaaattttaataagtgttttctatctttgacctttacaaagcctataaaggttacttttctagtcacttcaagttataacttcaggttcaggcctgtagaggtaagtaatcacatttgaacatgtacttaggcatctttatgtttcttagtgttctagacttgtccttattgaattttattctaatttaaaaagtagtttctgtgttcgataatttttattccttaattacctagaggactgaaactcctgattcaataaattgttgggcaaaagaggttctctacaatgaagaatatttgatcaaacagttcctgtggaatcaatttcatagttgggctttgcttatgtcattaggcaaggctggcacttcacatatttttatgtagatggttctcccaaggtctgctagaacttcagccactttccatgacacccatttgactgttgaaaagttagggctcacagattttcagattgctgtgagaatgtcaatgcagaattcacagggacagcctttctatttgaaaatttaaattgcaaggaaattttttaaaggaagtaagatttggaattaagattcagcaaagaatgggaaagacttttacatgtacattttcacaggttttgacagttctgtgtcttggctctaccttccctgagtcctgcctgctcttgagtgttgtataactctttgtaacgtgaggcgggcagggtgtaggtagatgctgcatgctgttgaatgttgtggattctatgtgtgctttattttctggggaactagggtgtggtagtgctagctgggtatattggaggcca

SEQ ID NO: 28226 - DNA, 1047 bp, Homo sapiens
atccgttcattaattcactgtatttgattatgctacattttatttctataatactcgtgaacattctccacagtgacttttgggaaatgaggatgtgagaggcaagtgtagtttgaagttacccgaataaagatttggaattgggcgataacgtttatgtgtctgcagtgtggagcttaaggttagtctgatattctcttggcttcaggcagtggccccataatcactaaccctaaccatggcagtaccaggtattttgttcatttggcaaattctttatgtgcattaatccatagccacagaaagtgttagaaacatgtaataagtggattatgtactgggagacttgcttttctgaagtggttgagaagaaacagtggttttattggttacacgtttagcattcaaagttttggctctttttgaacagccctagaggctatgacacgtatccgaaattacggcaaggcgctgatttgaaacctgacagtggtgtgcgagagccagcttttggctggctaatggagtgagcctagatgtttctgagagtccacattctatcatggtactgttggtatcgtgtgtttgttgcttttacgttttgtggggagaaatggtatgtcctagtggtgtccacaggtctcaggttgattctcacaattgtcgtggttcctggtctcaaggagttttcagtctaatcagagagttggctgcataatgctaacctaggcaccggctgagggagtgtgtgtgaaagtgcccagcacagcaggagtaaagctaagcctggggctgacgggtaggtatctctgttccaatgacttcactgtgtattgggcaattgcctctactgttctcccatgcccagccccctccgccccccaaatcaaccgccttatcacgtacatgcccagtaggctggaagaaaagagtaggtaagggagagcctgttgctttagggttatctgggaaatctgcccagaggaggaggagagtatactttggaaatgatacctgatgtttattattatatcaagactgtttcca

SEQ ID NO: 28227 - DNA, 1032 bp, Homo sapiens
gacctgctctgtttgaatcctggcagtgaccacttcatagctgagtgaccttgggctaatgacttaacctttttgagtctctcttcttaactacattaaattgtacgactcaaaggaggcaacgtgtaggaaaccactttgaagactcctagaggagtattgttgctggggagagggctgctggaccccaaccaacactcggcaccactttctcttcttccctttcctcaattgccacacggagtggagctgccacttctctttcatcctcttcctcaaaagttgtctgaaagctgtgaaagtactttgaaaattagagtcttatgaaagacacttcttttttaagttcagaaatatgaggtttctgatatatctggcttcctgtttccatccttgggtattctttttacccttatcacatcatagaatccaaaagctttgggtgtatttcttaggattattgagtgagtgctgagtatatggagaacactttcaggagggctggatgagaattgattagtgggcagttgagttggttgttggcatctgtaaacacactttctcttagaacatgttgagactcctaggctagctcacaagcttctaaccctgtgaagcagttgaatggaaaatggaagaaagcagtgcttgctatgaacaatatcataagtaagaccaagacagccccagaggtgctatttgaataagttgaatacttgactgtaaggaagggcaggcttggacttcctgtggactctctggagggaggggcatggagcactcggcagtggtggtgtctgggttacttgatggccagagcatgtcatgctcttgctagagcctccctcctgatgcatggcatttcagcagcacattactctaagcacagggcttcaaatggaatgaagcaagagaggaaggcttctagggaaactggacaaggccaaggaagaggcgggagctcagagaaaaactacctgctatagacttcagtgtgttgggaatgttggcagacagggtgaggtcataact

SEQ ID NO: 28228 - DNA, 1055 bp, Homo sapiens
tgggattacaggcgtgagccaccacatccatggaatgctagtttttcttacatccctgccaacacttggtgtggtcagcctttttaattttatggcactttagtaggtatctctttgtggttttaatttgcatttctctcatgactaatggctttaggcatcttttcatgtgctgctttgccatcgtatgtcttctgtgaaatgtctgttcaaatcttatgaccattgtttaaaagtttttttaaattaagttttgagagttatttgtattctagatacaagtcctttatcagacttctaattcgcaaatcttagtggctttttattcaaagagcagtttttaattttgatgaaatctaatttatcaattttttctattatggattttggttttggtgttgtgtctaaggaaactttgcttaatccaaatttacaaaagcttctaagttttatagctttatattttacatttaaatctgtcccattttgagttaattttttaaatggtacaagtagggaagaaagttcggtttttttgcgtgtggatactggattattttagcaccatttgttgtaaatctctatttttgtactccattctagtcttttgatctctctgtgtatctgtacatgaatatcatactgtcttgatggccatagctttataataagtcttgaaatcaggtggtgttagtccttcaacttacattctctatcagagttgttttggctgttttagatccattatgaactttctaatcaatattctagggttttgattgaggttctactgaatgtcaatagattttatttcagtaaaataaataatagatctcaatttttgtttaacttggagagggttgacatctaaattttgagtcttcttacccgtgaacaagatatacctgatagattttgtttctttcagcagcgttttgtagttttgcataccttttgtctgatttctctgcaagtattgaatgtttaattcaaggtctgattatttgttactagtatatagaaataacattgatttttgtatcttgcaatcctgc

SEQ ID NO: 28229 - DNA, 2081 bp, Homo sapiens
gtgcatgtatatttaagattgttacatcttggtggacccattattatgtattgtctctttttattcctggtaattttctttgctctgaagtctgctttgtctgatattactgtagccacttgagcttgcttttgattagtgtttttggttggtatatatttttctgtccttttatttaattatatgtttacttgaataattattccactaggcttggctttaagagtaaatggtcacttggtaaatttacttacaagttttgaacctctttgccctttgtctggaattacacaaaatgccatcccttttctcataagttccttccttgctgaatttgttccttttcaacttgatcttcccagcttcctgtgagagctccacatttcatgctaacaccatcacggtcaaagatttactctggacctgctccgtgttcgtctctattcggagtgctagggttaacaccagagcctttcttcctatggcaactgtgctttagtggagtgaggcagacagtaagcaaatgcatactgtgccagtggtgagaacgtactttgtggaacaaaacaaagccttgagtgagggcaatggagagtgaggggccttggtggagctaggagggtgctgctttaggagagtgggcacagaaggtctctctgagagggtgacatttggacagagacatgatagaagcaagagatgagctatgtggaagttgggcggagaacatttccaacagaaggaccagcgagtacaaaggcctgggaggggaatgtgcttgggagtcctgagaaccacatgtatgcctagaacaaggcaagcgatgacgaaaatttcatagttttaaccagctagaacattgcaggattttgaaatactgccctgaaaactgacctttagtcacataatggtccaaatcagacagtacaagggaggcttaaccttttaggtctgagaggagccaggagtgggtagggatgggctctttccttgcactgtcagccagcaggctgctgaggaccttgtcaatctttgaagaccagtgagccgtgcgggatgcccgtcgacattagtctggtttgagtgatgagtggtaaattctttttcttacttaaggttccagtaattttctttttgttccttgtccgtattgaacatagttgtagaccagtcccatgcctttcttaatcttttcccatgtttgtgggctcatggttctcttaggtgtgttagttcacagggaaaatcctttgaaaagttagaagagtatctaatagatgttttcacacacacacacaacattaatgaatagtttggaaaattcagtctcgtcaatggattagaagttttcccccatgctttctagtacttcacaccatctgtaatgtcacagtgtgtttttgctgccataaagctggtttggattcatattttcacaagagtgtaatgggaaagaccatagaaaaagggagattgggcttaacactgcaattctgtttagctggtcagctggtagtttctattttgacaaggttatgtgtgtgtatgtgtgtgtttgtgtgtagttgatgtctgtctaggaagagtaaaatggaaacactgaccaaaatagtagaattattacaattcaaatgcagacactcacaagtttttattttattgcaggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcgttcttg

SEQ ID NO: 28230 - DNA, 1026 bp, Homo sapiens
gacattattcagagtcctaatttcaaacatcccgctcttccctcctagctcactccctcttataccctggctccaatcccattccctcaaccctacagggccccacttatcctactggctatccattgtctctcctcatgccctcactgccctcctcaccctccttaaatttcaagtctactgctgcaaccaactctccaggcctctcttgatgatactcagactctaccacagcctgcacctatgggctggatgtgcctggggaaaagcatatctctgctgactggtctcatgaccacaaccacacaggggcctgtggtgctcctgggggcagcatggctccccagacctctaccttcccaggaaactaggtccttctttcccttctcaaccttccagtacctttgggccctcattttacctctgctaattggctttgttccctattttactgaaaaaatggaggaatcagaagaaatattccacaaatgtttgaaccacttccgctgttctgtgtctgtgactgcaccctccagccccgctccggggaatgttcctgatgctgcgtctcattgaggtgggggtcaggggaggggtgctcccatctcctgtgcccaaggtccggtcccctcggacctgcttgggggcttcgctccgcaaacttcccctcaccctgctgcatcatcaaaatggtcatgcagtttgatggtcattcccaccagcaaaaaacttgatttttcctggaaaaaaaagaggccaggcaccctggctcacacctgtaactttgggcggctaagacaggtggattacttgaggtcaggagttcgaaaccagcctgggcaaaatgttgaaacccctctctactaaaaatacaaaaattagccgggcgtagtggcatgcgcctgcaatcccagctactcgggaggctgaggcaggagaatcgcttgaacccgggagatggagaaggttgcagtgagccgagatggcgccattgcactccagcttgggtaacagagcgaaactctg

SEQ ID NO: 28231 - DNA, 1078 bp, Homo sapiens
cctgacctcaggtgttccacccgcttcaacctcccaaagtgctgggattacaggggtgagccaccgtgcccagaccatgactcacattttctatgctctggttgttttctggcttgtaaacatggcttttgcctgctgagaacacttttcctcccctgctcactgggaagccttcctgaacccaaactagcctaggtcctcttcaagctctcttcaggagcttccaaaaatccttgctccttctcctgagcatgtacttgtttgcaagtgattgttgatatgtctcttccttacttttggctaagggttctttctgtgccgtggaccatcctaggcagctgatgaagtctatggatcttttgccagagttatgttttaaatgcataaaataaaacacactgggttctagttcagggcaagttggagtaagcacactccaccctgactcccggtgaatgttgctataaaacccatacaagaatgtatggaatagctacttaaagactctgaaaagcaaagggtagccagcaaattggtaaagaagacagaactcaagtaccgctgaactggtggtgagttaccatttttcccccctccagaatcacctggtctggattcagtgcagtctgaaaacccagaagtgggcactggtgcagacagagagccccagaggagccccctagtctggcttgaaggagcagaaaggaagtctcctaatacttagaaggagtgaagaaaccccctgttttgttttgctttttcttttcttcattctcttgtgtcccagcgcccaggcactcctgtggtagtaggggcacaagagctcacaggagcccaaaactctgaggcaggagaatctttcctgaatcagaggagctgctgtcccaagagagtgaagaaaatccctaatgctttttttccccactctgttatcctactgcttttccctggacacagatacagttgtgggaagtatatagcagaacaggctaagtaaagccccggctttctggccagatgaccaaaaaattgagctcctgggaacaggaaagtactaggaagtgggaagagctgggaa

SEQ ID NO: 28232 - DNA, 1083 bp, Homo sapiens
ttatataccaataggagaggaaaaacactgccaacacactgtgacagatgcctttaatgacagtcctgaatgacatatgaatcaatgacatcagattccttttaagttaatcttcatctcttctagagatttggcaatgaaacaagtaactcggcaatagaaagtaacacagcttgtccgactggtgggtatcttcctttgcgaggtttctggtgcacttgattgtttctttgcaagaaaatatggactcctgatcattctttctgtgataaatgtcgttcactaataccacctttgcatcctactgcttggtttctgtacctttctgactacaaaatagcttgttatttcagtgctgaatcgtagtgaaatttctttggggagattcctacacagtagttaaactctgaggttaagctaacaaatgcacagatctcaatcaaagtgataacaatgtgaacagctacagctgggtggatgcacatggccgatggcttttgaaagatactcctgattaagatgtatctggatctcagcaatgttagcctgtgaaaaactgtgcctcttaaaatctgtggaatacagtaattctgtccaattcagtaatttgggagggagagttcttctgcacttatgacatgtttcgtgaacatcctttgtctgctggggaatgttctagggcttcagtgggaaacaggctgactcccctgcccacatggagctcacactgagtaaggagaacagacaataagggaataaacagaacaatgttcatgttattttaagtgcaaggaaggaaataaacaggaggctgagatggagcctcacagtgggacgggtacaggatgtacatgagcatttgtgatgagccttctgatttccaactaagtcaacacttggatttttgtctctaagagtcactggcagcctgcagggcgatcacctgtccctaggtttgcccagaactgaggggtttcacgggatatgagccttgaactcctataatgggcagacccaagcatactagtacagttcgtccccctatggagattctaactcaagtttccttgtagtttaatattt

SEQ ID NO: 28233 - DNA, 1049 bp, Homo sapiens
gtcacatccaaaagtgctaaattatttctaagtgtataatgagattctctgtccctgaagccgaattttggttgcagcttgtcagagtttcattcatagatatggctggtcaattgagaacattctagagaacacttttgtgatggttccttcctcttgaggttctgagctccatatccttccacctcagaccccacatccaggacctaccatcttgaatttaagtttttgccccttggcccagagtctaaggaaattatgagatccatagacccaatccatacagtgcttttgcttttgaatgccagcgttggcgtttcttgggtgctattttcaaggcggatttctaggttggatgttaaagtcatcgtttctcttctccagttgacttcaatgacctgttgccggtgggcccgggacaaaaagttttgggaaggcaaaactggggtctgatttggtaggcatggcatggattatgtaagtgtacaggtctgcatttcaaaatgaaaaataacaataataattagggtttctctgggctcctcatgtccaagccactcttgcaaaaccacctttggatgagcctgaagtgtcagcaaatcagaaacatgtggatttaatttcctttgaaatacaccagggggagagggagctgtgggacttggcaacctgcttcttcgggtttgccaaaccccaaatatctcacactctgtgagagctctacgctggcccccagcagtctcgtctggccagcccagcctctgcatttcttgctgtaccgtctaggtctcctctaaccatgattcccttctctgggtccatttcagctgccagagggatgctaacaccgcccacgtgctgcagcaggactttggaaggggaaccagcactgtaatgaagtgttgggttggctcaagtcttgtctggaccacaaaccatttttcaaccactagtgtgcctttaaaacccaaaccaactgtgagagtggttttctactttgattctagatgggaaaatattttgcttttttggtggatgacagtgtcagg

SEQ ID NO: 28234 - DNA, 1061 bp, Homo sapiens
tcataagtcaaaatgagtttaacattacctgacctactgaacattataacagcacagcctaccttaaacttgctcagaacactaacattagcctacagttgtgtaaaatcatctaatacaaaggctattttataataaagtgttaaatattttatgtaatttattgaatactctcctgaaagtgaaaaacaggatggttgtatgggtatacttgaagcattttatctaccgaatgtgtattgctttcacaccattgtaagttaaggaccatctgtataatttcacatttttctggtagccatattttaaaagtttttaaaaagcagatgaaattattttaaataatattttattgaaccaaatgtatctaacatattataatttcaacatgtaatcaattgaaatttttaatgaaaaactcttttttgctttattaaatcttcgaaatttagtggcattttgtgcttacaacacatctcagtttatactaattccattttaagtgttcaattttcacatttggctagtggctactgtattgaacagctcaattctgggacattgtcctttttatccatatatttgaagatttatttttattatgttgaaaaaagtaattctgtataatttatttaatttccatgatttctctggttgtttgaatttatttaatctcattttatatatttactttcttccttcttcttgattttgttagccagaagtttatatattgcattgttattttgtttttcaatgaaacagctgttgcattatttatcagttaggtctatagtcttctattttataatttctttttttttttttttttttagtttcactctgtcgcctaggctggagtgcagtggcatgatctcactgcaacctctgcctctccagttcaagcagttcttgtgcctcagcctccaagtagctgtgactacaggtgcatgccaccatgcctggctaattttttgtatttttttaagtaaaaatggggttttgctatgttagcccggctggtggcaaactcctggcctcaagcgatccacctgccttgg

SEQ ID NO: 28235 - DNA, 1034 bp, Homo sapiens
acccacccagtgagcaggactaaggagcctccagatttgtcctttctgcctgcctggcatcctcaaagcatgcagggatgttgctgtctgacacgcttcctcccgaagctgaactggctgtcaagaacaaaaatctggttattgatatcaagatcagatgctgcttgattttgagggatatggttgcttgagtggctttggtattccaaatagagattagggatgggccagatgctggttggggggcataggggacagtggatgaaaaagcaatctattcatggattcaccaaactctttatttcttaacaagtattattgttttttgataagtaagacattttcactgttaaaaaagggggaaatatgaaaacacacaaagtagttaataaagctactgatacgtgggtaattaaataatgctaattaaataaaactactttgtatgtggggtaactgataccccagacagttaataaaaataattccaatgctgagatgaacactgtgtttggtcatttctctgagccacttcccaactatcctaattccccagctacccagtctctctccaggacttcccagaccttcttatggttcagaaactaataggtcaacacccagtacagcaaaatatggccttttgtttttttcttttgggtgcatatgcatatgtgtacaccctacacataggaatgatagaatatttaacagctggttccgcatgggcacgaccaacggggtggacaggagtctgggaggctggcttttgctgtactgggtgttgacccattaggttctagaccatgggaaggtctgggaagtcctgggttgtgggggagttaggaggactggggagtggcttgggaagtgactatttatcatttattatgaaatgtttttaatattttattttattttttttgagacagggtttcactcttgttgcccaggctggagtgcaatagcccgatctcagctcactgcaacctccgcctcccgggttcaagcaattctgcctcagcctcctgagt

SEQ ID NO: 28236 - DNA, 1121 bp, Homo sapiens
tgctggcaatctatggtacttgtggacacggcacccccacctctgccttcatcttccatggtctaactctgtgtgtgtgtgtgcacgtgtgtgtggtccaaatttctcctttttataaggatatcagttatattgaattaggcctcaccctactgatctcatttgatcatctctgtgaagactttacctccaagttaggtcacactctgaggtactgggggttgggattccattatatgctttttaggggaatgacgttcaacctataacactctgtgaagctcacttttttctactttctagataaaataaacagaaatagaggttctaatggcttcctttggcatccccacagagagtggtctgttgctcccacggggtgtatgtactctcctatggaggccactgccttatcagttctggccctcctcctccccttatgatcactcacccctagttctcactaggagcagggggatgtgggatgttgatatggtttggctctgtgtccccacccaaatctcatctcaaattgtaatccccatagtccccacgtgtcaagggagggacctggtgggaggtgattggatcttgggggtgggtctcctcgtgctgttcttgtgatagtgagtgagttcttacgagatctgaaggtgttaagtgtttcgcagttcctccttcacatgctctctcttgccttccaccttatagatgtgactgcttccccttctgacatgattataagtttcctgaggcctcctcagccatgcagaactgtgaatcaattaagcctctttcctttataaattacccagttttgggtatttctttatagccgtgtgaaaatggactaacaccagtgtggagtagacgaggaccgtaggaactccacctgagatcttcagaagattgatttaacgggaaacttctggtgtcaggatagccaagtgagccactggctagcctcctctccatcttctcccttgctctgaacctcagaaataatactaaagttgtgtgtaccacacaactttttttttccagatagggtctcactctatcacccaggctggtgcagtggtgtgatcacggctcactgcagcctcaacctccagggctca

SEQ ID NO: 28237 - DNA, 1076 bp, Homo sapiens
cttactgggtcaatagctctttctcaaaagagctgcacaaagcagattatgtgtgaattcagagaatgatctttggtgccaagctgtgttggatttgaaatgtcctgtcaagtttcagattcacagcttgacatttatatggttatttatgtcacttattaactgtggtatgtttgtggcaatctagttatgattgccctcctagcttgtgaatagcaagaagagattgctttgtgacaagagctcaccctgggatgttctgttgaacacaacttggggaggatggggatcgaaagggctgatggctttgttatgtattatttttgctctgtgatgttctagaagcttttgccccaagaacactggttgccaggtattctgctgctctgggtccaggaaaaggcaggaagaagcttgtgaatctgcttcaggtgcatggtcttgaacagcctttgtttctaggagatgcggaggcactcagagaaaagccctggatttctttaaggtggtttggagatttggcctgagtaggggattgtggagaaccaatattttgcttttggagaaatttgtcttaatttttgacattctggcattaaaaacaaagatattaaactgtgatttttagcttttgcctgctgtgcaggggtactgctctgtgctgatgggcatgtcctctctaatgcagacctggaatgaaatgaactcacattccaaggcttctggttataatgtttgccctccctccaccttccccaccctgtggagctttagggtaaaaagggttatgatgtggagctttagggtgaaatgggtaggatgaaggagaggctggggcaacagaagagaggagctttgggttcagctcagaaccaaatctactgggcttctccagctacagatgaggttcttaagagggcgctctatcctgacacttccagaagaaccagaaaaaaagtttaaaagcctatctgggccaggcacggtggctcacacctgtaatcccagcactttgggaggctgaggcaggtggatcatgaggtcaggagatagagaccatcctgtcaaacatggtg

SEQ ID NO: 28238 - DNA, 1056 bp, Homo sapiens
tactaatcaagtccttcacccaccaagagagggttgctgaacgtttaccagcacaccgctgtaaattccattactctttctttctgagaaatgacttatttttctctgttttagcctagctaacatccctgtctgagagaggagaacttatttttccctattttagcttagccaacaaccctaatgcattggacatacacttccctttgggaaatggccccatcttggtctctgagaccttttctctagttcttctaccctctggggacttcttatctggaaacatttgtggctcttcttcctcctgccttcagatgccagtgtgtgccaagcttaagccttcttttctgtgtgtctttctccagagagctcatgcatctcaaggcttctgccagctctggactgaaaccccaaaatggacatttccaatcacattcctctcccacaggctccaaccttgtatctcctgacagttgtccacagtgtcactgctgtagacctttcccctggtgcatctccctggccattgcctcccatgcagcagatttgagaactcatcttccttcccaggatgttcaggtcagctccttctctcagcagcaactcccctctcagccaaccagacttacctcctgcacctttaatgggcccttctctgaattcccaaagctgggtgccatattgtgctgggtttacttaaagatatccctcatgttagtctccccatctccacccaatctgtcaccccaattttaagctcctcttcctgccccgcctttgagtgcacactccttccccagtctgtcctgtgcacccccctccagcttcctgaaacatcatggcagctccatgcttgggggctctcaatcctactacattccctctacaccaggttccttgtctttcttggtctttatgatctggctctatgaagtgaatgttatttccctcaaacctcctgcatgaatcattcccgtgggacggttttcctgttttgaatctgggccataatcatgtgcaggaactctctctcatacaggctctcaagagcctgtg

SEQ ID NO: 28239 - DNA, 1030 bp, Homo sapiens
ttctatatataccaagatgccctctacaggcatctagcaacttcccagtagttcgtgttacctctctgctcaaaaccctctcactcagaagaaacgccaaaatctcacaatggcagcactatggaacttggcccaggtacctctgtgatgccatgtccttcagccacactggcctccggcgagctccgcctttacactcactattccttttacctaaattggctaactttcccacatccttccagtttcttcacagggggcccttccctggattgtagcaccccaaccctggtgtgtccatctctttggccctccatagccacatcctcatctactgtgcctaaaattgtgtcccctaaaagttatattcaagacttaacgcctaagacctgtggatgtgaccttgtttggaaataaggtgtttccagatagaatcaagatgaggtcatacaatcaagatgaatcaagatggattcaggtgggcctaatccaaggactggcatcctggtaagaacagagaaatttggacatagagacccccaggggagaaggtcttgaggaaggaggcggcaatgggagtgatgcatcgaggcaagcatcctagtccatttgtgttgataaaatacctgagaatgggcaatttataaacaatagaaatgtattttctcacagatctggaggctgggatgtccaaggcacttgtgggttaggtgtctaacaggagctcggtctttgtttccaagatgatgcctcgttgctaccagagaggatggatgctgtgtcttacgtggtggaaggggcaaaagggtaaaaatgggcctggctggttccctccagccctttgtaagacactaatcccattcatgagggctccaacctcatgacggaaccacctcctaaaggccccacttctgtgactactgccaggttggtgattacgtttcaacataggaattttgggggacacatttaaactgtagcagcaaggagcacaaaggattgcagaatccaccagaaatggagaaggaga

SEQ ID NO: 28240 - DNA, 1061 bp, Homo sapiens
aaaaaaaaaaaagttactacggagaaataaacaggccggcttcacctccaacctagtggggaaaaaaagcctaagagggagtgaaatgaaggatgggggagcagaagtctccacccctccctttggccctaggcactccgcattgttgtgcatggggacctgagactttctttgacccgcacgggcaactcagcctgccggctttctgagagctggggtgcaggagtggggattaacaccccctaatgcagccctcagccatgggctgagagattggtggataaatacccggcttcctggacgacaggcggagggacttccccttgcctttcaaggtatggggaatggaccaccagcagctgcaaacctgggcgctcatggcaaggcagaatctcccgccttgccccacacctgctgaatcaaaatctgcgtttccgctgggcgcggtggctcatgcctgtaatcccagcactttgggaggctgaggcaggcagataacctgaggtcaggagttcaagaccagcccgggaaacatggtgaaacaccaactctactaaaaatacaaaaattagctgggcatggtggctcactcctgtaatcccagctactcgggaggctcaggcacaagaaccgcttgaacccaggaggcagaggttgcaggaagaggagattgcacccctgcactgcagcctgggcgacagagcgagactctgcctcaaaaaaaaaaaaaaaaaaaaaaaaaaatctgcatttcaacagaatccccagctccctcctacgcacctttaagtttaagaagtggtagtcaaagccaagtgttctcaaggtgtggctggagaccagtagctgtcacatcatctgggaacctagaaatgcaaactcaggccaggtgcgatggctcacgcctgtaatcccagcactttgggaagccgaggcgggtggatcacatgaggtcaggagttggggaccagcctggccaacatggcgaaaccctgtctctgcaaaaagtaaaaaaattagctgggtgtggtggcatgtgcctgtaatcccagctactccag

SEQ ID NO: 28241 - DNA, 1047 bp, Homo sapiens
cccctgctctcatggaaagaaatgacgctttcttggcgagagacagacgacagatgactgtgtgatgtcagatgctgaatgctaagaagaaaaataaactggggaagtggggtatggaggaaggaggagggagtgctattttagacagagaggacactgacagcgtgaccttaaagcagaggttggggtgaagtgagcaagctggtgggaagggcaatctggggcatgggcctgtgtccaaggcatgggaaggggacaggagtagccagaggacagagtgaccagagatacagcagggtcaggccactgataggattttgctctggcggggaggggaagccactgagcttcctcccagggaggctgtgagcaagggaacctctgcctcacccattccaagaattccccgggccgtcagcaagcacaagagccagtgtggatgcccgcaccattaggcctgagatcagttcctgccgttactggatgtggagggtttggatggtgctggagggagcacatcttgatcagcatcaggaatacttggttctgtgaaacttgcaacttctgcattcaagggtccctgataggagttggtatgaataaagaattttcttcactgggtgcagtgatgcatgcctgtaatcctagcactttgggaggctgaaggcagaaggatcacttgagcccaggagtttcagaccagcttgggcaacatggcaaaaccttgtctctccaaaactacaaaaattatctggccatggtggtgcacacctgtagtccagctactcagaagcctgaggtgggaggatccctggagcctcagcctggagctcttgcaccactgcactccatcctgggtgacagagtgagaccctggctcaaaaaaaaaaaggaatttttttaaggctttggtgatcgtcacatttcttggacttatgcacagaaattcagtgagtaagagttgagagttgggcggggcgcagtagctcacccctgtaatcccagcactttgggaggctgaggcaggtggataacctgaggtcagga

SEQ ID NO: 28242 - DNA, 1045 bp, Homo sapiens
agaaggaagctccttgtttacataggagttatagcagcactgctctcccagttcaacaaaaactggtctcactggttacctgtggaaccccgactccctgagatggctctcggcagccttgccttctgcctgtttctccagcttatctcttgccaccgccactccctcaagctggcaaagcaaccgggtcatgccatttcagtcaaggtggaatgccacaccatgagcacttgggaagtcctggccaagtgctggtctgttccattttcgtcctgtctaaagggcactaacagtgccccctggcaggtgcttcactgagcgtttgagcctgtgtcacctggcctccctgactcactgtgccactgtgcagcttcctttcagtggcatgaaaagaacacccttacaaagatgcctgacttccagaaggaagacatgtcagtgtttcaccgtgaaaaatgcaactcctcgtttgcttggtgggagacgtgcttttaaattggctgacttacatttctttctagacaaagacatctggcattctgaagtcagcattgtactctgtgcaaaagtagggtgactgtctcttctaggaacttttaaaggaaacatttaacatttttattttacgggctaaataaagcgttttaaaaatgaaacataattctgtccactccccacccatatggttaaattactccttttttaaagcattttaaattgtggtaaaatacatataaacaaattgtggtaaaatacatataacataaaatttaccatcttaaccatttttaagcatattaacttgtgtccatgtgtagccttttggaatttttcatcgtgttccctacacagaatgcttctaaatcatgccgtgtcctggggactgtcatactgtcaggttgtgtaaagtcaaaggaaacaaagatattttcttgggtggagcaacagtgacacttcctgatttctattaagcttggatgtagtttgaatctttttttttcaaacatactttatacttaacattttagtattttcttttaaggtc

SEQ ID NO: 28243 - DNA, 1031 bp, Homo sapiens
cggtggctgatccctgaaattccaccactttgggaggccaagacagaaggattgcttgagcccggaattttgagaccagcccaagcaacgtagggagaccctatctctacaaaaaaaatttaaaaattagccggtcgtggtggtgggtgcctgtggtcggtcccagctaggctgcagttagccctgatcatgttactgcactctagcctaagcaatagtgagaccctatctcacaaaaaaaaaaaccttagaaaattatttataaatagtttttctgttatttaagtttatagagttagttttcatattgtaattatgaaaactatgttgtcaatctgagtctttaacttatgatatacgacagatgattaatttagcagaatcaaaagccagccttgctgcaattctggaacattctctgttttccacggaacagaagttactggcagaacttgatgctattataggcaagaaggggacgaggatcatcatttggaatcttagaaggtaaacgtggacatagatgttgaccgtttgggaagtaaagtgcacgtgcagggtggtggtgttatattcatctctcgttacacacagtagaaatacatggaaaggtactcattttttggtgtagttactgatttgtctttgcccaggatatgttatagaggccatttcagcttcaatttgagatattttcatcttgttaaaaaaaatttttttttgagacgaagtctcactcttgttccccaggctggaatgcgatggcgcaatctcagctgactgcagcctccgcctcctaggtttaagcgattctcctgcttcagtcccccgagtagctgggattacagtcgcctgccaccatgcccggctaacttttgtattttagttgagacagggtttcaccatgttggccaggctggtctagaactcctgacctcaggtgatccacccgccttggcctcccaaagtgctgggattacaggcgtgagccaccacacccggccaaaaaaaaaaatttttttctatccctg

SEQ ID NO: 28244 - DNA, 1038 bp, Homo sapiens
ttcctttttcttttttttttctttcttttcttttctttctttctttcttttttttttttttgagatagcgttttgctctttcccccagggtggagtgaagtatagcgccatctcggctcactgcaacctccgcccaccgggttcaagcgattctgctgcctcatcctcccgtgtggctgggattataggcacctgccaccatgcctggctgatttttgtgtttttagtagagacagggttttgccatattgaccaggctggtcttgaacttctgacctcaggtgatccacatgcctcagcctcccaaagtggtaggattacaggcgtgagccactgcacccagccagtttgcacttttttcttgctgagtagtgtttcattgtatgtatggaacccagtgtgtttacctattcaagacatctaggtttgtagttttgggatattacaaataaagctgtaaacatttgtgtacacagttttgtgggaatatagtcttcatttttctgaaataaatatctagaagtgtaattgctgtatcatatagtacttgcattttattttctaagaaatgccagactgttttcctgagtgttttcctaccagcagtgtatgagtgttacagtttctccacatcatccaggatccgttttctttctttttctcttgcctttgcacccccaaccccccactgacgtgcaccatgtgtaggtttatttatttgcttacctttttaatgacttacagtgtttgctggcttatcttgctgtgaagttaaattttggttctttctaaaaattatttttacagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggtatgtattcagctctctttgtggaagtgagaaaatcattgaatgctggtagtattaggagaggtcatgttacctgcttgtga

SEQ ID NO: 28245 - DNA, 1394 bp, Homo sapiens
gctggtggattgcttgaggtcaggagttggagactagccatggtgaaaccccgtctctgctaaaaatagaaaaattagctgggtttggtggtgcgcgcctgtacttccagctactcgggaggctgaggcaacgagagtcacttgagcttgggcggtctcttggttcttgcagtgagccaagatcatgccactgcactccagcctgggtgaccaaatgagactctgtctcaaaaaaataaaaacaaataaaaataaaaataaatgtgatgagaatcatacaagataaaatatagaaaaatatacaaactataattctttaagggtaattattttgagcatcatgtcttatgcttaaaatgctgatttcattttattttttcaggcaaacaacatgggtgttggagtggttggaattatagagtgtaatttccttaagccaactcataataaacaagatttcgactatactaatgagtacaggtatgttacctatttaaattattgactgaggttcctaggaaatgtattaccaagaaagcaggaactactctattttctgtgaatctcagaaataccttattagtaaagaaaggtttgaatatactacttgtgatggtgtaggttacaattcctagaatggaagatggttatattagttttctatgtaagtcccttacctacccattttcttaaagttcgataatgtaattataattttgtaattaaaataaaaatccacaaggtggcaaaacatttagcttaagagaagttatgcaagtattttgaaaataaactttaaaaagaagtcaataatttaaataggtaaatagagggcctggccaatgctggcctatagacgtggtctctggttgacatagggtgtgtggataggttggagctggtctgtagagggagccttatgttgttggagctagcagaagactgctggtgggcaaagcatggcctgatgggcacagctgaagctcctctgggaggtcactgggccctagcaaaatagtaacagagtaccagaacttgggctggatttggagcctagagacaataaattggtaactgaatgaatcaaaaaagtcagccaggtgcagtggctctttcctgtaatcttagcactaagggggcccaaaggtggacaaattgcttgagctcagaaggttgagaccagcgtgggcaacatggcaaaatcctgtctctaccaaaaatacaaaaaattagcaaggtgtggtggcatgtgtctgtggtcccagctactcaggaggctgaggcaggaggatcatttgagcctgggaaggtggagtgtgcagtgagccaagatggcgccactgtactccaacccgatgacagagtgagatcccgtctcaggaaaaaaaagacca

SEQ ID NO: 28246 - DNA, 1081 bp, Homo sapiens
tggatgagaacatgagatatttgtctttctatacctgacttacttcacttaatgtaatgtcctccaggtatatccatttatatccatgtcattacaaatgacagcatttttgtggttggataatatcccattgtgtgtatgtaccatagtttttttattcatttattcgttaatggatgctgacaaggatgtggagaaaggggaaccctcgtacactattagtgggaaagtaaattagtatagttgctatggagaataggatggagtttcctcaagtaaactaataatagaattaccatatgattgaacaatcacatggctggatatatatctaaaagaaagaaaatcagtatatttgaagagatacctgcactctcatgtttattgcagcactgttcacagtagtcaaaggttttatgaagccacatagccttgttagtaagctcaagagtacaggaaaggaaatttatgtcagtctcttatcatagaattaaaagtcttaattaaaatattggtaaataccatccagtacatgctaaaagaataataacattaaaaccaagtgggttgtgttctaagacaatatgggtggttttaatgtaagaaatgagtatagttcatcatattgatgtttaataagagaaagcccttatggtcatatacatagatagagaaaaagcacttgcaattatttttaaaaggaacacctacaaaaactgtgaatcaaagggcataataacagagtatttacacacacacggcaagctacattactaatggggaacaattgatagctttccttagaagggtgggagagttaaggataccagccattcactaaatattcttgaggaaataactaatgtaataaggccaaaaaaaaggggtgggggggggcaggttgaaaaggaagacataaagctctattacaggttgagtatccttatctgaaatctttgagaccggaagtgttttggtttggatttttttgtattttggaatgtttgcattatgcctactggttgagcattgcaaatctgaaaatctgaaatccaaggtactttcatgagcatttcctttg

SEQ ID NO: 28247 - DNA, 1070 bp, Homo sapiens
ctaaacctgtttcacctttaaaatgcagacagcttctcagcttgaattcacagccttttccttacacacaaggtctctgtaatacttctcctttcctccttatcttctgttcttggccctcctctgtacccattagcagttctcagctacctctccctgctccatattcacttcgctaagctgttttaacccagggattccctgacaataccttcttccacccttcatcccctcttcatcctgcctgacctggggaactgaacttagatcttctcagaccctccgccctgtgctgtcagctcccctcccccggtccacatgtgtgatccttgcttgttgatgggtctgtctgatctgtgggctccctgagggtggggactgcatgaagtcatctttgtgaccccagagcctgacacagggttttagtacagagtctctcacttactgcctgctgagtgatgcgtggtaaagggaataatatttaagtcatagtttatactatttgggctcaaacaggttttggtaatgctgttttggtgcgtgtgtgtgtgttttttttgtaggacaaaagatatcaatttttaatgaacataaaagttatgtccaaggagtaacctgggaccctttgggtcaatatgttgctactctgagctgtgacaggtaaattcagctttggcatttacttggaatttctttgtatttacttggaattttctgaagagaggtatttatcgtaacttagccaagatttatcatagtctaactttgattcttttgttcttgttttcatactcattcttacaacataatcagaaattggaaattaattaggacaagtgccttacacgaagtttgtacttagtaaatctttttttttttttttttttttagacacagtctcactctgtcacccaggcaggtgttgtggcgcaatctcacaatctcagctcactgcaacctctgcctcctggtttcaagcgattctcctgtctcagcttccctattagctgggattacaggcacatgccaccatgcccggttaatttttgtgtttttagtagagacagggt

SEQ ID NO: 28248 - DNA, 1055 bp, Homo sapiens
taaaatgataggcattttctcttagataaatttaacttttggctgggcacagtggatcacacctgtaatcccagcactttgggaggctgaggcgggcggatcacttgaggtcaagagttcatgaccagcctggccaacatggtgaaacaccctctctattaaaaatacaaaaattaatgatgtggtggcgcataccctgtaatcccagccacttgggagactgcggcaggagaatcgcttgaacccaggaggcagagggtgcagtgagccgagatcacaccactgtactccagcctgggcgacagagtgatatcttatctaaaaaaaaaaaaaaaaaaaaaaaaagaaactttactatttaaaccctttcaatgaatgctttttcattcattaacatgtgtatggaagccatagcgctaaagccaaagataaagctcctttattgtttttattctcctcaataaagcgcatttgtgacaggattagactcatggacaaacttgtggaagcagcagtggtcaaaatcaaaaggtcagccaagtagcaaggactagataggtttattgtccctatgtccctaggaaggcaaggggctcagcccagcaagataaggctaggcattattgtggccacagtgttctcagaggagaatgtctgctcattgccgtggctccaggaccatcctgtgcatagagatgacaacatagcccagggttgggccaaacgggagggcactgtcttggtttgccactgagtcccatcccagctgagccagggagggcctgagaagggcgtgaatcacacatgcagctgtgtgggtggggctttaaagaacactgcggaacatgtgcgaatgacactttggcccaagaagtctcaggactaagaataagtagttgtttaggttatatttactaaagttagttattaaaagttattcactaaacccagtaataaatccttttttttttttttttttttgagactgagttttgccctgttgcccagctggagtgcagtggcacgatcttggctcaccactgcagcctccgcct

SEQ ID NO: 28249 - DNA, 1034 bp, Homo sapiens
cctgtgtctgccacttctactggatacagagccacttagcacatccttctgccgtcaggcagcacagcctcctgtttccattcttcccctgcagctgatgtccagttacccctctgatcctgtatagttccttctccaccaagccctctgcctcccaaccttcccataaactgagtcacgaggagagctgggaagggggatgcagaggggagtggtggggatggtgagctggacagaagcgccctgtgcctctcagcctctcctgcgccaataggtcttctttggcaagttcataatatgtgtatgggttgctggctttaacgccctcttaaaatctctcatttctttctgcagattagcaatgtattttacaatttttctgtttgtttttatgtgacggaaggtattccttgaactatttttggtattaaattatttttcccctcttgatttcttctgaattatttaccaagcttcttgaagatgtaatcttttgcaaacaagaatagttgttgaaaattaagactctgggtttttatttatttatttattcatttgagacagggtcttgctctgttgcccgggctggagtgcgatggcatgctctctgctcactgcaacctccgccttctgggttcaagtgattctcctacctcagcctctcaggtagctgggattacaggcatgcgccaccatgcctggctgactttttgcatttttagtagagacgaggttttgccatgttggtcaagctggtcgaaaactcctgacctcaagtgatctgcccgcctcagcccgccaaagtgctgggattacaggtgcgaaccatcttgcccggcccaacgctctggattttaaaaaagtattacctgtgtttcgacgctttctatatatagaaaccatatctgactgccttttacagcagccagcagagtgttcacaagaccgtcggtaatgaacagaacacaggttttgaaacttttcgatgactggttatggtttaagttgactgttataaatgtgatggtttaact

SEQ ID NO: 28250 - DNA, 1045 bp, Homo sapiens
ctcaaatgatccacccgcctcagcctcccaaagtgctgcgattacaggcgtgagccaccgcgcccagcttgcccatgacattcaaaaatgccactagacattgcccactgtcccttgagaggcaaaatcgcccctggttgagagccactctatagaacttccattatatcagtataggatcttgccaggcagctcagttccgtgtcttggctctgtattctgtaaatgtcagcccttgacttccagaattcttcatttacttgccaaccttatgtttgttaatgttgcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggtagttgtgtttgttttctgattttaaaggtgacgatgcttattcttttagtaactaagtgaagtgaaaaagatgggtatcacccatcatcttcccaccagaagtaaccctcgttaatgttgtagtatatttccttagcatttttgtggatctatttattctaaaaagagaattgagattttatttcatatgcaatttggtatct

SEQ ID NO: 28251 - DNA, 1026 bp, Homo sapiens
tctcgacctgctgacctcaggtgatccacccgcctcggccccgcaaagtgctgggattacaggcgtgagccaccacgcccaccaaaaaaggtagttcggatctgtgctacaacatgaatgaatcttggacattatgcaacttcatataaatgcagtcacataatatgtggccttttgtatcttttttttttttcatttaacataatgttttcttggaggtccagccacactgcggcatgtatcagaatgcatgtggcgagtatactatctctgtatggctagaccatattgtgttcctccattggtctattgatggacatttgagttgtttcttccttttggctattgtgggtaatgctgctatgaacatttgtgtagaagtgtttgttgagtccctgctttcacctgttttggatatattcctaggagtagaattgtggggtcattattgcattttaattagaaggactctctactctctgaaatgtgttggtgacatcattgtctgtggctttttgaggattcctgtccatcatttcacattttctgaattctccagtttcacctacttgaaggtctcccatagaaccactcatggactccaaggtgcctgttgtgaaggccttgacccctctcacatgctgctcttgttttgcactgaaatactaaataagaggaacagtgctttgccgttgtcgggggctgagggggaaggaggagacagagatggggtgaagctgtcctttttttttttttgagatggagtcctgctttgtcgcccaggctggagtgcaatggcgcaatctgggctcactgcaacctctgcctgcctgcttcaagcgattctcctgcctcagcctctcgagtagctgggattacaggtgcatgccaccacacccggataattttttgtgttttagtagagatggagtttcactatgttgcccaggctagtcttgaactcctgagcccaggcaatccacctgccttggcctcccaaagtgctgggattataggcatgagcca

SEQ ID NO: 28252 - DNA, 1072 bp, Homo sapiens
atttcaattaaaccagaaattagtaagggagggccgagaagacacggctgctcagaagctgttcgctgtttgagggatttcccggagagcctgttaaaagatgcgaagtggtgggtgtaccgctcagccacctttaaaccggctctgtgcgttctggctctggaaagcaagtctccaggcatttgggctcagaattgctgggccccgagtttgggcgggggtggtccttctgggggtcaggccttgagcagcttgcactggtggcaggtttgggagcagttgaggggcttcctgtgtgtcttttggagggggtgaccctggaagttggcactctggaagggagctgtttggccctagagttttggaaagggccctgaacctgttcggtccccctcggaaagggaagggagcagtggcttagtccctccctcctccattcgtgcaatgcctggggtaggggtagacctggagccggtggactcatatccttggaattcgtcaggacagctgctccggggccttggccctcagtcagtctggggctgaggagtagggaagctgggaacttggggcagaggaagaagatgcgtttagaaagacctccattatgcaaactggagtccatttatgcaaactggtcacccttccagtagctccaaagagtggcagtggagtggcatcttgattgatttaacctcttctcaggggacctgggtctgcgagggaggatatggctgcggggttggaataggatctgtctgagctgccagggtcagggtggtggccctagggaggttttagggccagggtggtcccgggctgtggcaggggctctcagatcgcctcgggctctcagctgcaaggtgaaaaataccatgaggaattgatctgccaagggcggtcttgtctcaaagcaagtggattgctggggtaaagaatctagagaccagcttaggactctgggaggaagaaaaaaaaaaaaagaatagcatagtcctaaggaactgcaaggatcaccagattaacccttcatacctggggaaattaaggccagacatgacacaggcctttc

SEQ ID NO: 28253 - DNA, 1601 bp, Homo sapiens
cttcctcacccccacccctccggcaggaaaccacaggctgggttggggacccctggtgctccaagagagcagtgagtgctgggagccgctaaccccgaggcgcctagcacagactcttctcaccccttatttctgaaataaagcccttccttaggtccagatgaggaccacgtgctcagtgcctcactttcgtgggagtgtatatcactttacagtatcaagacaattttctttcgttacaaatctttatttagtctctgcgtttagaccaaagtagatttttatgggctgagtgaaaaaacctcgcccgcattggtttctgatggaacagctggcagcgccacggccccgggtggggtggcctagaggcaggggtgcttgggaggaacatctagcacccgaccacctccaccaggtgggaaagggacgtttgcaccaaatctccgccggcaaagcagaggctttggggaattacagaaaaactataatgatctaaaagagaacaagttatcttgaactgtgcgggtatttgaatcatacagaaaattgtcctgtgtgcccaatgcacttttgcatgtagagccagggccttcgaggaagctttcaggagatcccgggcagcggagtctggtctggagtttcatttccgtaggtgcagatttctccccaagtcttcccgccatgggctttgcaagaagccagggcccagaggccacgctcaccgttaacactgcacagggcaaaggtggctccaggacaactgcccaaccccaggaacgacccagcagcagagaaaaggacagctgccagggtgcctttgtcgctttttggaaatcagaattcctgggtccttagttaagtcttacttcaccaaatcccaggaccttcacattttggttcttgccattgctaacagttgtaaatgctgccgccacgaggcctgggaggaaggacccgctggtgagagcacagggagtgctgctgtgatcacggtggtgatgcggggtgagcgcgatttcccgggattaaaaagccaccgctgcccccgtggtggaggctgggggcccccgaataatgagctgtgattgtattcccgggatcgtgtatgtggaaattagccacctcctcagccaggataagcccctaattccttgagcccaggaggagaaattaaaggtcatccctttttaaattgaggaatagtggttttttttaacttttttttttttaggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgcacggcgactcctcgggaacccactcgtggctgcccgcttggaagggctttgcggccccgggaacgatctccaggatctccacggctggtcaggttccccgtccctcgtatcccgcgctgcccgggggctcctgcctttggttcagtgctcgcggcaccaccgcactcaggacggcagtggggggctggggctggggctgggcctggcccagcgtgggtt

SEQ ID NO: 28254 - DNA, 1542 bp, Homo sapiens
aatttctgatgaataacgatagtagtaatagctgatacatgctgctcttttgtgttccaaaaactttcaattaccttcaatgacattatcttattaagtaaagatgtctttcatgttgattcagtgttaaactttatgttaaaagatcatagagaatgtaagcccctagatctgctataattgtgtggaaattcactacaaagtgattttttgttttgttttgtttttggtctaacctctactaaatgactatccaaattctttatttgagggtatggaaatgattctttatgggttataagcccatccccattccaagtcttttattaagccttatttgaacaagtgttgaaataaatctgcttcgtatggcagagctaaaattttagttttttttttgtttacactagtaaacaagtgattgttgctgccaaactttggtactaaaacaatgacagagacaaccataaaatgccagttgtctcctcagcccagggtccaagtgttaggcagtagagaggcaggctttcagcctgaaaactcccgttggtgggcacactcgcacacgtgtccacacacaaagcatctagacaagtttctatctacgtggatgaggtagagttggggcagcaatgtttttccatgcgtgtttactaaatgatttagttccatgtgctgttttggttaatgcaattattttacttttatttagggaggaggaagaaaaatccccgtgtaaaaatgtagctgctgtatacatttttaagtatccttgggttaagtttcctcaccaacatttcacacagttatatagcatctaggtaactagtatacatgttcaaataaatatacgtatgtaagaaatagctatttatgagacacataaaagaatgtcttatttgagattgtggccagaaacaaccataaacatatcgatgatgttgtttggaggtacaagacctaatcctttcacttttgaaataaagacaaaagacaacataattatgtttgttgacataacttgaaccctgaaacccaaaccatcttgttttaaaatccttaatttaccatactcagcaaaacaccccagagtaacgtgcattttcagagtgccaaacaactctccccttccacacagaatatatgcatttagtgctgtatttatcatgtgtaggtttcttggcaagaagaaaagctattcagcaaaacataaaaaagctcttagtaggaaagctatccattttgtagttagcagggttttgcaaatactaaaatatcacatggaaggtctgttttaataaggctgatgcatgagacccagggagttttatagcgacaaccataattttttttttttttgtgaggtagtcacatttctctcagtgttcaaaagcgtggatagatacgtaaatacaggaaacaccatgtcaaccataattttgacttaaggtcaggactgttttatcattccaaaatttgttctgtaaagacatttccgttatttgaaggctgtttcacttcctagacagctctggagttttc

SEQ ID NO: 28255 - DNA, 1059 bp, Homo sapiens
accctggctggagtgcagtggcacaatctcggctcactgcaacccccgcctccagggctcaagtgatcctcccacctcagcctcccaagtagctggagactataggcatgcaccaccatgcccggataatttttgtattttttgtagagaaggggtttcgccatgtcaccaaggctggtctcgaactcctggactcaagcaatcccccgacctcggcctcccaaagtgctgagatggcaagactgagccactgcttccagctgttatgttgtttcctaagaagcacagctctccacttctcctaagcaatgaaccggtgcctgtcagcacattgggccgcacagtggagtagaggctgggctgggagatattctagcatgtttgagaaaatgagccaggaggagtgggctccagcccaaccccagtggccagtggctgaccctgccctctccactcccaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccaggtgagttcggcacctgccacagtggctgtggccttctggaagacaccggtggtggaaatgggtccctgaaagctgccatcttggccaaatcataacaaggaataagtcataataggaatgtggattaagcaaaaccaatttatgaactgaaagaacatatgtcagccttaggactcaagggcttgttttactttatttacttattgatttacttattttatttacttattgattacttattttatttacttattgattacttgttttattttatttacttatttgaatcactagagtttgaaatgaaaacatgggctgtgagcacaggttgggcttttttgaaggccatgatgtcagagctctgcctcctgcgtccaaggaggactttagaacaaacag

SEQ ID NO: 28256 - DNA, 1026 bp, Homo sapiens
tcaacatttcccgcctgagccttttagcacttgattagttggcaaaaccaatattagtttaaatgaaaggcagtctgcagagtggcgtaactcactgagctgccatgcccccacagggtgaccgaggtgacggggtacgagccgcaggacctgatcgagaagaccctataccatcacgtgcacggctgcgacgtgttccacctccgctacgcacaccacctccgtgagtagcacgcccaccccagccacgggaggtagctggtcagggaggaggcgctgaggacagagccgggggacgtgtcccttttgttggtgcaataatcatccatgatacacacttgaatctcaagccccaagtgtggcttcctccaccccgtgattaagtacggctgcctgttgtcggttctcaagcagccacgcgcaccctttcagggagactctagcaggtgtaggatcaggaagttgcctggattctagattgtggatgtggaacctaaactctgtgatctggacaccatttgcgaataacagcaacagtggaagactgctagttatggagctcttactgctgtcgggcactaagtttaagtgactaaatacattaccagcccagtgagggagggtctcactgtcatgatcctcattttaccagtgaggatgctgaggtccagataggttaagccgcttgcccaccttcatacagctggatggtagcggagttggaagctgaacccacgcagagccctgcctccgactgctataccccagccagctaggggaagcccagggaggccaccattccacgatgggagaggtcatcttgggacggggtgaacaaacaccaatttgatttgccaacggaggcggtttgggaacatcaggatatagaggcggatgctctagtcactgaaatgtttaaagaagtgacacttttcttttacttttttaaaatctaaaaaaaaaaatctttttgagacagagtcttgttctgttgcccaggctggagtgcagtggcatgaacttggc

SEQ ID NO: 28257 - DNA, 1146 bp, Homo sapiens
caggcgcccgccagcaagcctggctaattttttttgtatttttagtagagacggggtttcaccgtgttagccaggatggtctcaatctcctgacctcgtgatccgcccgcctcggcctcccatagtgctgggattacaggcgtgagccaccatgcccggcccgaagcagggatttttttccccatttgctttggaacagtcatgaagcccacagtggtgctcagtcagtgcctcctctgtgtccatcatgggtagatgctttcacttatagactctgacctgcgggcagtttggggagctgtgtccctctcgtgcccttttcccaggtgatcagggtgagactcaggggacacttgtccaagggcagcagtggagctggggcaggaccaaagtccagcccattggctgtcgtgctgtcagccgtcaccaccacaccacaccacaccacggggcttaaccttggagatgtgggctggtggctgttctgtaggatcccagccctcctgagcttgcctggctcaccagacccacaaggtgattttatttgaggggtcttctgtggtttatatgatgaagccactttatctcacaggaagtttccagatattgaagttgtccaaggggactctgaaagggcaagcaggcacaggctcaaaaaggtaggcgtgtttagaaattagacggggcatggctttcttttccaaatgagccagaattggtaattcaaagaaaacagaaaatagcaagattgacagtgattgctactgtcctgtgactctgaccttagctgtgctagagaaacaaccagaaaagactgcaccccagccaggccggtgggttggtgtggtcttggagttcaccatgagtgtgcctgcctcagtttcccctggcagctttgagagggaggggaagcaaggatagtctcagatgatggggagttctttggttccagcgtgggaaccacctgcagggctgagcagcagcctcccctcagagcactcaactggaatgtcacacgcctctccaaagctagaactctctgggaagacagtcaactcccaagcagggtcttcagagtcggggtcttcatggtatggagctttgtgattgtggaggcctcactctccttcccaggtacagaacctg

SEQ ID NO: 28258 - DNA, 1050 bp, Homo sapiens
ggcacccactcatttgtttttggactctgtggatgtgcctattctggaagtttcatgtaaagggaatcatacaatgtttgtttctattttaatgtctgttgatctgatggatggatctgcctttgagttaaacaagggagttgggcatttgttcatcattttgcccattatatttattctttgatctttgcctatattgcttttagggtctttgtgtttttatcaatctgtacgaaccccctatatattaaggtgaataactccgtgcagcattttcttttgcaccaaaatattttgatgtggatgagaaagagccatctgcaaggtgaaaaggaaccgtaaagggccacagacagcccaggagtgtttgggcagagactgggggctttgcccagcggtatgacaggaaggctgaatttttgttgcatatgagcctcaaaggctgaatttttgttggaaatgcaccttggggagtttccttcagccccagctggtacagtcacagactcagcccctttggccacctccccagatctctgctcaggcagctgctagttaggtccaggggccagtcctgccttgagaagcaggaatgttctggagctgaggacccagacatccaagggtgtctttctagacttgtgctatcctcctcttccctggagaagcttcacctctccactgcccacctgcgggttctggcactttcctcccccacctgcctcctggaaggcggtgaggtggaattgtggtttatgggtgcaccgagcctttggctgagctgcttagcggcctggagtttgcacccaagcatagaagacaggcccataggcccaattttcaggaactctgcagccaagtagaggtctttcctacataaacaacatagcaaattaatgggcccaaggaaaactgggattaatgggaagaaaatataaatggcaacaaacagtttcactgtgaataccctcatgttcctgaacagcaaacatcagcaacagcttgacacttggttgaatgcacttaactgactactttgtgtaaataact

SEQ ID NO: 28259 - DNA, 1033 bp, Homo sapiens
gttacaaattaatcatggtgaatatttggtcctttaaacactccagaaggtcaagttcagtcgcaaatgcctttttttttttgtaaattaaaaaaaaatatgtttttgtagagacggggttttgctatgttgcccaggagctggtctcgaactcctggcttcaagtgatcctcccacctcggcctcccaaagtgctggaattacaggcatgagccacggtgcccagcctgcaaatacttttaaggccattagaagcaataggacagatgtctatctggggccatatattactttccacccaccatagctattgtacgttcaatcaccttgctccaggctgtgacccttgccatgccgccagccccatgatgaaaagagttctcgtttgcactttacatggggtgaggatttaggctctaggtttgttcatagaatgactgtgtcttagaagtcaagtgattctgacaaaactgtcagggagaaaacagtttagccctttagttattcttcctgagcaaatgtgtgggctggttctccaggtcgacctctccttgtgtgaacatgaccctgctgagttggttctttagggcagagatgggcccccgatgtgagaatgcacaaagctggtggtcaggctcccagacctgtgaagagtcccggactcttgcctcctggggtgctaactggagaggcagctgggccacaggtgtgcatgttggatgcaggtggacctgatcaatggtatttctgcctgtctctttttcccttggtggctttcctcatggcccacgacctccccgagcaatgtgtttggggttttattggactggagagagctctgacctggctcagcatttcctggggtggcccagcctggggctgcagatggcttttataatgagggtgagctggccttgtctcaaatcccatccacatccaatcccagtgaaaagacacactggagcactgagaacgccctgcccaagggctggggccagggaagctgctcggcctccagcgcctgctggacatg

SEQ ID NO: 28260 - DNA, 1147 bp, Homo sapiens
ccaactgctctcaaaatgtgaactgacttttttttttttttttttgccaaccctgtgtcacttagtgaggacctgacacaatccctacagggtgtctgtcagtgggcctcatggtaagagtcacaatttgcaaatttaggaccgtgggtcatgcagcgaaggggctggatggtaggaagggatgtgcccgcctctccacgcactcagctatacctcattcacagctccttgtgagtgtgtgcacaggaaataagccgagggtattatttttttatgttcatgagtcttgtaattaaaccgtgattcttgaaaggtgtaggtttgattactaggagataccaccgacatttttcaataaagtactgcaaaatgcttttgtgtctaccttgttattaacttttggggctgtatttagtaaaaataaatcaaggctatcggagcagttcaataacaaaggttactgttgagaaaaaagaccctatcatagatttacaagtgacaacgtggacaggcgtaacagagtgtgtatgtacttgaaaatgtgtactagtgaaaacgtccttgtctaaacaaacttcgttttcataacctagaacatgaaggaagattcttacacgagctggcttcaggacggccagggctgagtgtgaagtcagcagagctgttactgtggcaacctaatattgtgacctccatcttgaagagtctgcacatttaagctggggatagcgtttcttgacttctgtgaggctccggcaggggaagaggaagcattttaatacatatgcctctcttttacaaaaaagaaaaaaaaatcatcgtaggccctaacatgtaccatgttgacaaaaatgccagatcaaatggatttgagaaataagcccaattcaaggctggctcagccctccacggggcctcccagggaaaggaattcctttatgttcttggaagcccttttctagaaaagccattccattcatacctttgtagagcagtgggctgggtgtggagggcagcgcggagggtatctgcaagagcctgtattttccgcctcccttgcccccactccttttatccttttaaaagtcctatcagccctgccttcgtcccttccgccctaagccctaagagtgggggaggtttaata

SEQ ID NO: 28261 - DNA, 1040 bp, Homo sapiens
cggggggtgtgcaccggggtcaggggacgccggggctgcacccggagagggggctcgagggagtggaggccggggtgcggggccgcgccagggctgaggagtgggatgggtatgttgtggatgcgggggaggggaggctccagtggctgcccgacctgtttaagccaagtccggcctcccttccttggaggggtgggaggcggattgaggagggggctctgcctatgttcatagctgccaaggccaacctttactaaccagcagcacaccgggagtcccagagcgctccacagccgctacccagtcgacttgggaaaataagataaggccgtttttattaaattatactaagccttcatgcaaaagattttaaggtcaatcacatacattcacgggatgcaataatgtttttttaaataaggacaggaaacagaaattgaagacagataagcaccaagaaggctgcctctaaaaaggctgtgccaggaaggctccctatggtgttcttgctacatgtgggtcaacagtttgactgtaagcatcctaacaccagtgggaaaaggaaaacatcaccatgatttggtgttcttgtctccaagggaagcataattagtcctgacacagaggcttctcccatagaacctcatttctttaaaaggcattatgtaaagaacgtgttctgaacagctgcgaagcacagcaaagaattccatccagtggcttcctattctggccctcgctgaaaataggtggcaagatgcagcaaaagcaatcatgtacaccacgtccatgtcttaatctaaggatagtttttgtttgtttgtttttgagacagtctctctctgtcacccaggctggagtgcagtggtgcaatctcggctcactgcaagctctgcctcctgggttcaagcgattctcctgcctcagcctcccgagtagctgggattacaggtgcccgtcaccatgcctggctaacttttgtatttttagtagagacagggtttcaccacgttggccagggtggtctcgaactcctgacc

SEQ ID NO: 28262 - DNA, 2602 bp, Homo sapiens
caaaaccccctcagttgcagagacctttcaaaatatatgcactctcctactgggcgatgcggtccttaggcgttcttgatgatatttaatggtttatagagtattttatggcattcacctaaatctctttccattttgcccaagatcctggcgagggaaacaaggtagaaattttacagattttactcctccggagagagccttttccttataactacgactctagttaggacattttttgttgcaagaaatttgcgatttatcctaaggaaaatgggatatagtataaggatacctagggtaagaaacttcaaaccccttagagacccagctactgctccgattgctcaaggtttcgtgctctgcgctcaagggctgcgttttggtgtctttgttctgcccaattttcttattgtctaattttcctttttttcttttaatttttggaatatttcagatatcaaatacagagggggagctaaccaatccatgattcagattttacagacgtgattatttaatcttttgccaaatttacttcagatactctttttttttaaagaaataaaattgctctcagttccttcccctccttttctagagatagccactgcgttgaggtttgtgtatatctttactttgcatattttatactttgatcaaggtgaatccatacacaatatatattattgtttgtttttaaactttaatggcattaaaatatacatgcctttttgcaacttgctttttttttttttgctcagcatcatattttgaggtttatatatgaacaaattgaatgattgtgttatctttggttcattcattttaattgctggtatagaattgcgttgtatgaatataccatatttatttatacattcccctgttgatagactttgaacttgtttcagtttttgactcttaaaaacagtcctgcaataaatatctttgtacttgtctgcttgtgcacacatttggaagtttctgtaggaagtacacctaagtagtagatttgccggattgtaggctatgtgcgtcttcaatttaaccaagtatcacagaagctctcgaagtggttgtaccaattttcactgtcactggtgttgagtgagaacacaatttcctcacaaccctgctaacactttatgttatgagactttacatttttgccatctctttactgaccagcttccttatgacttttggttgctgctaaatttgcttgtagccaccttggcttctcttgtagccctgtgtcagcctatggatttatctcttatagctaattggcttagtctttatctcctttggttctcataagattaattccaatgaacatttgttgtatacctaatgtatgtcagatcctatgattgatgtatagatagaatttccatgatatgttaaatatgtacctctttagtggcaggtgaggtgatttaattaaaagtattttttttcttatgatgaatgtttaaaaaatttttcttttcctctccattttattgtagtatttgataaattcaaaatatatgtaaaacatatgcaagctgtatagcagaacaataaaatgaacacctatgaattcaccactcaatccaataatcaaaatgaccagtattgaatgtgcttacttccagaggtgactaccatcctgaattgtgtatattatgccttgtttttaaaaataattttatcagatatgtatacatccctcaaaaatgtattgtatggtttctgttgtttttgagtggaaaaaatcatattgggtatagtttcctgggacttgcttatttcacttgatgttatgtttctgagttactaatattgggtatagatgtaagtcattaattttcactgctgtgtaatattccaagtgtgaatataacacagtgtatgcattcttctgttaatgggcattttggttgtttctaggttttgctgttatgaagttatatactttttggttcacagttgtaagaatttttctaattttcacactggggtatatgagccccagaggagtaatgaagatttgctaaggaatgtgtgggtacaaatgatgttaatgaatcagtttctagatcattacattccataggtactctttcctaaaaatggtaatgcctgaggcctcctgctagtgctactttcttaccttgtgtttctaacattgcactttacataagacaggcaaaccacaggttcttgtggaatcttactatggcattgcccaaagggggaaaactcccttggggaaaacaaagggattttttttttttttttttttttttttgagtgaagttttgctctttttgcccaggctggagtgcaatggcacgatctcggctcactgcaacctctgcctcccaagttcaagtgattctcttgcctcagcctctgagtagctgggattacaggcgcgcaccaccacacccggctaattttgtatttttagtagagacgggatttcaccatgttggctaggcacgtcttgaactcctgacctcaggtgatctgcccgactcggcctcccaaagtgctgggattacaggccaccgcgcctggcctacaaagggataatttaaaataccactat

SEQ ID NO: 28263 - DNA, 1399 bp, Homo sapiens
agaatcgaaatctttaagattttgatcctttttatttttaagaatatggtatgtatctctatttatgtaaagttttagtgtagttttgtaatattctccatagaggtcttccactttttcatatgttaattctgatgttattgtttttgttgctattataaatggtggtgttcttaaagattctatcttaacttatttattgttagtaaatattttaacttattgttaaatagaaatttaatgaatttttaaaaatattgaccctttagtcatccacttgataaacttactacttctaatattttttctgaaattcctttgtgttttctgtgtggataattatatcatttgcaaatagtgacagttttagttcttctagttatttttgcttttaatttattcatttttttggtcttaaatgtgctggcatactttatacttacgttcaatggaagtgattagggttgttcattagaagcgattatagtgggcatagagttcttgttctcaattttaaagagaatatttctcagctgagaataacatttgctgtgaatttttgtagatacctttgattaagttagggaagtcttttcagttgtcacatgcttttctgcatttgttgagaatatcttgtgtcttttcttctttaatctgttaaatgtaatgaattccgttttatagatttaaaactgttcattttcttttatattctttcttgagataaacccaaattggtctttatagattatatttttatgaactactagattgagtttgctcatattttatttagatttttgtgtctgtttatggctagaatcacttctcatttttctttattggctgtcttatctgacttgggtattaaagttacactgactttataccatgagttagagaatagttcctctttttctgttccctgggagagtttggattggagtgatttgtttcttaaaagcttggtggaacttaactataaggtcatttggatctaatgttttcttcttggaggtttagtagtaattagcagttgaacagtcataggactgttcaggtattctatttcttttagtcagttttggtaagttttagaaatttgtcctttcatcaagtttatggtatggttttttttttttttttttttttttttttttttttaagatagagtctccctctgttgcccaggctggagtagtgcagtggtgccatctcattgcaacctctgcctcctgagttcaagcgattctcctgcctcagcctcctgagtagctgggattacagccgtgcgccaccatgcttggctgatttttttgtatttttagtagagacggagtttcaccatgttggccaggctcttcacaaactcctgacctcaagtggtctgcccacctcg

SEQ ID NO: 28264 - DNA, 1052 bp, Homo sapiens
ttaattttggtttatcctatcattaactgagagaagtgtgttgcaatattccaccattactagtttctaacagatttcctgtagttctaacaatttttgttcttctgtattttgagacttttattagctacatgcaagcttaacatttttttcctagtggctcgaacctttactatattgtgatcttctctaagtttgcttctttgtcttagaggctttttgtctgatcccgtctttcttttggtgctaatttacctggaatattcttttctttcattttactttgattttttttagtgtccttacattttaagtgtctcttataagggacatactactggatttttcttttaatctcaccagacaacttctgtcttttaattggttatgttccaggtgtcttggttggtgtttgactcagttttagatattaaaaaaaatctaaaagtatttttattttacctttgttcttgacagatcattttgatggatgtacaattgtaggttggtgtttcttttctgtcagtagggtaggaatactattctgctgttgcttatacaaagtgtgctgccagttttatttatgcctttttttttttttttttttttttttttgaggtggagtcttgctgtgttgttaggctggagtgcagtggcgccatcttggctcattgcaacctccgcctcctggattcaagcgattctcctgcctcagactcccaagtagctgggactacaggcacctgccaccatgcctggccaatttttgtatttttagtagagatggggtttcaccatgttggccaggatggtcttgatctcttgacctcgtgatctgtccgcctcagcctcccaaagtgctgggattacaggcgtgagccactgcacccagcctatttatgcgttttttgaagaaaatatcatttttcttttagttacattggattttctgtcttttgtgttacatcatttcacttctaagtctagatagagattatatttatcctattttggatgcatgtgtttcatgattctgcattttgtctttcatg

SEQ ID NO: 28265 - DNA, 1045 bp, Homo sapiens
ttaattactttttttttttttttttaagatggagtctctctctgtcgcccaggctggagtgcagaggcgcgatctcagctcactgcaagctccgcctcccgggttcacgccattctcctgcctcagcctcccgagtagctgggactacaggcgcccgccaccacgcccggctaatttttttgtatttttagtagagacggggtttcaccgtgttacccaggatggtctcgatctcctgacctcgtcatctgctcacgttggcctcccagagtgctgggattacaggcatgagccaccatgcccggccgcatttttaatttctaaaagttctgcctggttcttttttgatatgtccagtcattcttcatgttctcatgttatatgctgatttttgtgactctatagctattctgtagactatatcagacattcccaatgtctgatatccttgaggagggggatgtctaaatttattgcttttttgtttttttttctgttgtctctcctcaatgtagctgtcacctcatgtgtttggtgatcattgattatgaacttctgtttgatctttgtggtgatcttgagagtctaatttgaggatgcttgctttctgaaagcatttctatcagctttgtctgggagccagaaagtttagctggcatcacttttgagttcctacattttgcttctggcccagggctcagtgtcctgatcctattactgctcttggcaccactacttgtagcactaaactgtagccaggtttaatttctagctcaaggtttgttgcttttgcgtggagagggtgccttcacatgttcccctatttctatgagctcagcaaaaacatccaaaaagtgtttttttttttaatctaggatatacctttttcctcccaacagtacattcccccagagtgtatagttgaccataactgatgggatcagaagctctttattttaatatttaattttagtagtatatttttgtttgattgtattataaaaaattttatggtaccaagcaagctttcttggtgataccaaca

SEQ ID NO: 28266 - DNA, 1027 bp, Homo sapiens
ttgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagtgagaagaaaagagagttgac

SEQ ID NO: 28267 - DNA, 1033 bp, Homo sapiens
cccccctaaatttctggaagactagagatataaagcactgtatgtttctgtgagaatttcacaaattcttgtgtgtgtgtgtgtgtgtgtgtgtgtgtgtgtgttggtttggtgaattattcctcactctgccctctggtgtgtgctctttatttttacttagagccactgaatttgcttttgaagaaaacatttacttttttcagtcttctttggggtataccccctttttaaaaaaacagtaacaaatgcacatggtaagcaacagagtaggaaaaggtacactcgccagctctgacccatcctctgattcatctcttcagatccttgtgtattcccataatattttatgcctatacaagcatttatgttgaaccagatgaaattgccatttttgtaagtcagaatataggcagttttatttggtttaatgtaatgtatatgtctttttctttaaatgggtaggaacatactacatacactgttgtacatcttgcttttttttttacatttaagtcttggagcttgttttggatctgtatatagagacctaccttgttcttcatggctgcacagtgttttactgaatggattgcctatgtaatccattagtttgtattatattagtatatagtttatatatatatattagtttatattagtatatagattattttatttacaatgttaaattatagatatattagtatgtagatttccattttaaagattatatatacctatgcaatgattatctttttacttatgttttacactcaggttcaaatatatctgtaggacacatttctgataaatttattttactcatgatatatgaatgaaagaacatatcattttaattacagacactttttatttaaaatgtatgtttattcagtccgtggttattactcactgcatatttgtcagtgactgaccattatacctgaatcttgcttttgttccttagttggaagatctggaaacttggggaatagttgttatttctttattgatctggtcatatcctgaa

SEQ ID NO: 28268 - DNA, 1035 bp, Homo sapiens
ttgcattcatatactaattgtgatatttataatatatgctattataacgctgtttgtagtgctatatattataagtaatgttcagcattgattcaacaaatattggggttctgttgatggataatgtcagaaatgagcaaaaacagcctctgtgtttcagacagtgggctggcattgtgagggccttgtagtgggaaggaatttgttgcatttgtggaactgatagttgctagatggcctgaatacagaggagagggtagtatgttcataggctaagccaaggagggccttgtaggctgtgttaaggcttttggcctttaagagcaataagaaagtaaaggattttaaactgaggagagagagcatgattagcacttaaaaaaaaaatttgagcatagtgaaaatggatctgaaggggatgtagtgtggatgtaggttaggaggctgttgcagtagcccaggccagagatgatggcttccagcagaatattgacagtgggaatggaaaagtagaaggattcaagagtttagaggtgaagctgacagaagttgctcgtggttggtgttggaacttgagagtgaaggtggttggaactgttctgacgtttctgccttaagcagcatcatggattatgggcctactcactcacattgggattgctggaagaggaataaatttgtaggaggtagaactggacttcactctcggacactgaatcgaagtgcctttgaaggccaggcatggtgactcacgcctgtaatcccagcactttgggaggccgaggtgggaggatcaccagaggtcaggagttcgagaccagcctggccaacatggtgaaaccctttctctactacaactacaaaaattagctgggcgtggtggtaggtgcttctaatctcagttactcgggaggctgaggcaggagaattgcttgaacgtgggaggcggaggttgcagtgagccaaagtagcgccattgcgctccagcctcggcgacgagcaaaactccgtctcaaaaaaaaaaaaaaaaaaaaa

SEQ ID NO: 28269 - DNA, 1032 bp, Homo sapiens
aacacttggccaaaggtaggtttcttctgtattttatattgagcaaataatgccatacaacattgtgaaaaatctgtttatagggtgtgtttgttcataaaaatgctatatgaaattacgtagagctccagaatgtgaaaggggagtcatcagatccatgatcagcgtggggacccagccacagcactgacaggctgtgcgtgaggacaggtggcctgtgggcatcttgagtcttcagggtgccttagtgattgagaggtcatctctgcgtattctgggtgggtgtgcctgaatgtgaaaaatgacttaaaactggggaggaagtataggaggctgtctttataggaggcaggaaaagatttcttaacacacagtgcacaaatcagcagtgaagacaaccatcttgatatatttggctatatcgaacttaaaaacttgtgtatgtcaaaaggcaccatagatgaaatagtagtttgagaggagataatttgccacatatataactggtaggatttacagctggaatatgcacataattcctaaagtaaataagaaaccccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgagcgacacagaagacaggtgatttctgcatttccaactgaggtactgggttcatctcactggggagtgctggacagtgggtgcaggacagtgagtgcagcgcaccatgtgtgagctgaagcagggtgaggcatggcctcaccggggaagcgcaaggggtcagggaattccctttcctagtcaaagaaaggggtgacagatggcacctggaaaattgggtcacttccaccctaatactgcgcttttccaatgggcttatcaaacggcacaccaggagattatatcccgcacctggctcggagggtcctacgcccatggagcctcgctcattg

SEQ ID NO: 28270 - DNA, 1056 bp, Homo sapiens
aaaataaaaataaataaatttttttttaagtggagctttaaataagatatagaaaggcacatgtatttcatacttcattcctggttttacgtaatttaaaaaaagctagtgcaagtagaatcagaatttgaaggccttagggaatttagtctaatttgatacttccattactgctctgcggatagccttcattagattaattgtaggagtttattttgtttaatttttttaaatgaactttatattataaatatcacatgattaaagagaaaaatagaatatagcaaggtataaagtaaaagggaaaagtcagcctggagaccttgtttaaaagacagatttcttcgcttttcccccaaattgtgattcaggtggcctaggaatgtatctaggagtgtggagattgtaaaattccccaggtggacttctgcatccagattttagaatcattttttaaatgccttattttacacatgaagcaattgagtcccagagaggtagagtgatttttgcaaggtgtcattgcaaataaaagacaaaactggtggttctgtttgagggtgaccagtttgttggtattttcattatgagtcattcttttgcttgaaacaaaatctttgctgatccttgaacctggtgtttgacaggtgctatatcaatatttgtaaaatgaatgaatgaatgatagaattccaaatactgaaacccaaaccatgatactggttttccagaaatacttcctgctattttaatatattatcaattaagaaaaacagttattaaaactttttgaagacctggcgctcactcctgtaatcccagcactttgggagggcaggacgggcagatcccttgagttcaagaccagcctgagcaacatggcaaaaccatatctttacaaaaaattagttgggcatggtggcatgtgcctataatcccagctacttgggaggctaaggtgggataatcacctgagcccaggaagtatgaggctgcagcgagctatgattgcgccacttcaaaaaaaaaaaaaaaaaagaaaaaagaaaaaaactt

SEQ ID NO: 28271 - DNA, 1097 bp, Homo sapiens
gttgtagattttcattctctccttgttttctctcctaagtctttttgctttctccaatgcctgaaagtcccttagtctacatttttagtgtatgagtctttcctgctttttcttcttcgggttgtacaaagctgagctgaacagctctgtttgaccggcagatgttgttatccatcataacatgattatgtaataagatggtgagctccttgaagacaggtgccacctttgattcagatttacatattgctgtcatcttgtcaatgatcacatgtgatggaatgtcagacaaagtttgtgtaacattttgttgacaccatcctaaaactaaagacatctagaaatgtaaaattgcttagatttacttttcagttttctaaatttgaggtccttactatcagcttaaagtaaatttgaaatcttttaaagtctgtgttgccaatccattgattactatgtgtgtgtgtgtgtgatgacttttataggtcgaacagcaaataaggatccaattaaagccttttatgaaaacaggtaagttaatagcaggtcagtagctgctactactaggaatggctttgctgcatgaatttaagaatcacttatgtttgacgctttaggagctaatagcaaccacagtaaagttggagatggaaggaagagaggtagttttttaagtgtccgtgttatcaggtgacctgtaagttgtcagatttatttcgctgttttagtgaaccatatagatataagctcagtagcctaatcctgtgggaaaagaggggtgaaatgttaattggacattactatgcttggatgggaccagtttggccatgaaactcctggcagcacagagctaggacatagcctgtgccctgtgcccttcacctctgtcttggaagtatctatggcaaaaaccacaattacttttgcaccaacctaatatttccagcttcctgatgtctttcaaaggctaagatacttcctattagaaataggcaacagatagacttgagtatgctcacaagaaagcaatagcagccagggttctacctttacttatttggcaattaaaacagattaaatgtttttctgcattcttg

SEQ ID NO: 28272 - DNA, 1050 bp, Homo sapiens
gactgtgacaacgtcattggaatggcattccttccaagggattagcacttaataggatctatgttatggtgtgtttacaccataattagccttttttaaaaaacaaaaacaaaaacacgatttgactctttttagtattagccagcacacgccaggcccttagtgcgtactagtaaatgcttataggttgattgtctgatgtgttcagcaggattggtttggttgtgtctctgactatccatatgatcagaaatttatataattcctaagaaagtgaaacacagaggtataattttgccacaggaatttggggatatgcagttgttattttaatattataaaaaaaatcaacctttagataaaatttatttcagtatttctctttgtatgtaagtgatcattgttttcactgctattcaaggaattatctgaagccgaaaaccagtttaagaggattattgaacactaccccagtgagggccttgattgcttggcctactgtggaattggaaaagtatatttgaaaaaaaacaggttagtagaaatgacactactttaagctctaggctggtaactcatttaaaatccaatgtgataatgatccattttctagaattattttgatatctcctctgtagcacactatcataattgtgatttactttgaggacctgaaatttcactatcagtattaattgttaaagcaaggccagtcattgcagttcttggtacttcctgattttaaatctaataagtcaacaatatagtaatttgacattaaagatttaatagtctagtgtataatcatctatagatagtgagtgaattgatataaactaatgtttttaaaatctgattgtttaatttttttgatttaattattttttaaaaatctgtatgaagatggttttaaataagaggtatatatgtgttcaaagacatcatgagtgagttaggaatataaaagtctgtcctctgaactctattgtagttgtaatccttacctgcagtttaatattgaagctgttctctaaatgcctcatgtctctt

SEQ ID NO: 28273 - DNA, 1048 bp, Homo sapiens
gataacatgctgcagcatggatggaccttggaaacattatgctaagtaaaagaagccaaacacaaagggcttgtgtgagtccattcctatgaaatctccagaataagcaagtctgtatatagtgacagaaagtagaccagtgattgctgggcctggaaggttaggggaaaatgaggagggactgctaatgcgtatggagtttctttttgaaaatgttctaaatttagaccgtggtgatgtcagcacatcctgtgaatatgctaagaacaccgaaccgtacacttcatttgagttgtatagtgtgtaaattatgtctcaacaaagctattataaaaaatacaacacagggattcttggatttacctctcttcatacaagattgggatagaggcataggagctattgataacaaaaagccagcactggaagcatggcatgagtctcttgggggcttcattagcagtggaataattctccagggagtccacaaacaacagtggcagagctgcaaggaggaagataatgggagtgttaggattctggatgaggtgatgttgggcaagaggagcctggtaaagtcctcaggattaccctaagggttattctgccttacttgacttcctcttaatgcttatggaagatttctgagagctgtaaattataaaatgcgatttgatgattgtaacaggacaaaattttgattctttcgaaattctgaaaaaaaattttgtccagtcctctttttaaatctctcttatgtctcttatcagccttccttttaaaaggaaaaactttaaaagttgtatgtagtttgttgttggtgaaaaaatttagtcattcttatgctgaaaatattttgatggcaagaggttattgaaatcacaagcatttttattgacagattagtattgtaatggtatcatttttgtttattttgttttagatgctgttagagaaatttgttgaagaatgcaagttccctccagtgccagatgccatttgttgctatcagaagtgccatggatattctaagatccagatatacata

SEQ ID NO: 28274 - DNA, 2061 bp, Homo sapiens
ttcatttcctggaattttcttcaataaaacgactattgggtggacttacatcatgcacatatttaccataagagaggtccagtttttatgttcagcaaaagatgaagggaggaaaggaggaaaggagggagggagagagagaaataatagagcactagtgagataaatttaacatcccaatagtgaacactgcctgcctgcattcccctcactgaccacaagctctgacgtggatagggaacgggaatgtgctattttttcattcggctctcataaatcttttattgtgtgagtattctacatggtcccttattctggtgtttaaagatcctaattttcctgcaacatgatctctgcaagctaactctttaatccagaagcaagcagtctaggataattttgactctgagcaatctctgcttcatttgttgacttcatttgttgactaaggccctcggaagaagtgaccgttttatattagaggcatgatggagaaactggacagagctcctttttgctggctgttcatcaggagtggggcttcaccgtcatttcagtaggagtctgtatgagattgtagtcacctgttttctaatttggagagtggagaataaaagtaggcatactgaccaccttgatttttgtagagaggggtgaggacccacattttggggaataaggaatgttattttaggtgttggggaatgggtttacccatttcctcttttagacacatttgggaagattctgcatattgttgatgttttattactatggaatccatataaagaatcataaaatcttgctagtttatactaattggaatgaaagtctttatgaattagtgaaaacattgtttgggtttgtttttttttttagagatagggtcttgccccatcacccaggctggagtgcagtggcgccgtcatagctcactgtagctttgaagtcctgggctcaagcagtacccccacctcagcctcccaagtagctgggactacaggcatttaccaccatgcctggctaactctttttttttttgtaaagataggggtcttgctatgttgccagggctggtattgaactcctggctcaagtgatcttccagccttgtcctcccaaagtgctggggttacgggcctaagccaccatacctggcctcattgttatatttttaaaggaatttaatgctatactttcatctcctaggtctaataaaggtaactatgatagtagaaggctttggcccacattattcaaatctaatagacaagaattattataattagcctaacaatgttaaatggtgtttctaaaatgcccaatagcttgaacgaatctgttctcaactatttaaatgtttttgctgagaatataagcaaactataatcagctggctttcagagatgtgaaactaaatgtgattttacagtaaataatttccctcctcttctgatttgggttttgtttttattacaggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatgggtatgtggactgagtttagacttatattacatttaatcttaagggggaaaaaatctgtgaaggacctagcttgtttaaatatataacaaagaaaatagtgaaaattattatggtacaatcagtttatgtggggaagttagtgattaacagtagcaatttttttatatcatgaagcttttttactttatcagttaaagagatactcaaatgtaggtatgttatgctaacaatacacaatgttcttcccgtcttagatattttcacagcatcatgggaaagattgcatgttacactgacagaatctattagtaagtggtttgatttatagca

SEQ ID NO: 28275 - DNA, 1065 bp, Homo sapiens
gctgatttagaatataggactagtacagctgaggttgagaccaagtggtagtcaaccgcctgtactaagcacccaccataggctgcattgtggctcatctgggaaacaaagataatctcagactcatttcatctaatagtatcaactcttccaataaacggtagagtatacaaagattctttcttcaggatgccatgctaactctgccttctccaccaaagtatagaaacatagaaaaggggtaaaaagaatgctctgttttttcttcaatatgtataatgaggtcttactatacccacagattggtagtgtttttgatcttctcaattaggagtagtcaatttatctgtcactttcaatagaccagattcatgaggtgctgagattcatgaggtgctgagattataaatttatcttaggctcatcctttatttttatattaaggtaatgattagggtttgattggaatcttttgaatgtttcagactacctttttaaaaaatctttaaatgcagacgctgtctttaatattaaacataaagatgtcagatgaagaacggtcaaactttcaaatttgggaaaagaacttaaaattcaggagacttattttctctctgcccttcggttttagagtttttgttatattaataattaaaattttctaaagtgtctctagtggcaagtttacaagataagcaattccttaaaaatagttggatttttgtgtgtatgtgattatgttaaatgtctcttttgctcatgtttagatgtttatttgaccgtaagtgcttttaatttttaaaatttctaaagcagttttatattatactttttcagtgatcctgcagcatatcctgacatggagtctgatatacgttcatgggaattgtttctttctaatgttacaaaagaaattgagaaagcaaaggtaagttgtaaacatcttttaatcccatcaaaatctttatgatagttataattctcgggaggctggtgtcatattgaatctatttcttttttatctattattatcaataattttttttgttgaaagtattatgagct

SEQ ID NO: 28276 - DNA, 1079 bp, Homo sapiens
gtagctgagattacaggcatccaccaccatgcccggctaatttttgtattttagtagagatggggtttcaccatgttagtcaggctggtcttgacctcaggtgatccacatgccttggccttccaaagtgctgggattacaggtgtgagccaccgtgcctggcctaatttttgtatttttagtagatacggggtttcaccatgttggccaggctggtctcgaactcctgaccttaggtgatctgcccacctccgcctcccaaactgctgggattacaggcgtgagccacggtgcccagccctgtccatagttttaaagtagattcctataaaaggaatttttaactttgaaaagggatgactaggatctctagaaatgagtgctgaatatacaatttcagcagacatgttttatgtgataggataaacgcttgctagcacagctacaagagtaaagcaagagtagaacaaacctaataaaacttgcctacaatttaaattattgtaaaaagaagaagtagatgcacaaagggcaactacggaagactctgatgatcatatgaagtatctagtaacaaagacaaacatgaacgcaacatgactgagaagaatgtcaagctcttcatctaaaaaatgacaagaaagccaagcctctggaagtcaggaatataatactggcatttgatacatatacatatatatgtgtgtatatgtgtgtgtatatatatatatatatatatatatatatttttttttttaattaaaaaatttttttcttaagagatgaggtattgctatgttgcccaggctggacttgaacttctgggctcaagtgattctcctacctcagcctcccaagtggctgggtttacaggtgcatgccgctgcacccagcacgtctatcttttaaatcctttattctgatttatgatttttaccgttttagattgttacaacacaattcaatttatgaatgaaaaatttcttggcacataatttaagaaagatgatattagggtttagcaacaaaagtttctatccaaagaaatgtgcctatgttaacctttagagtaagtgcgg

SEQ ID NO: 28277 - DNA, 1036 bp, Homo sapiens
aggaggaagggtcaccccttgtgtttgcgccatgaaggcacactcctttttacctggtgggtgttgaaaaaatatttgaaggaatagacctgaatgaatggtaattattggtaggggtgggaaatggactaaatgacctagtgagatctttgttttgagatctaagtataagatcatctcttaaaccttttaacaatattttggtggaacctattagaaacttaacacattattgtgtgcaagatatctaaaaataagtccagttttttagaggcagtaacatttaagataatttaaaacattccatattagtgtaatgtcttgttagggaatgtggacagtaaaaacgaccatttgttaaattttttttcccctccaaaatattgtctgatgtttgctccttcgtgttacttatggagagttactgtttatgacttaaagatatgggggtggagaggcctaggtaactgcaacaatgtatttaggtaatttacattaggtttttagagggctatgactatctgcaaaaggaaaattcaagataccttgttataaacatggtatacagtgacctttggcatgcattttgttttgtaactacacgaagtgttaatttggattgaatctttgttttcacttgaaaaccttttttttttttttaagaaatagcttggaaatttaggctgccctgaggtgttttcgtgtgtctgtttatggttgacaagtatctagttatgagaagaaaatgtggatagaattaactgtattataggcgagaagggaattgccttataatcttgtgccactgaacacaagattagtagaagagtgggcttcacttgtgactttcttggtatttgtgattaggcgtgtgccagtttgtctttgctttggcattagctttcctcatatttgagaaggctttcacgtttcctgtacacacacaggaagcagtttcacccctccccaagaaaaaacttatctaaacccagcaaaacccaaaaacttccagaaagtctttatcaagaatttagtt

SEQ ID NO: 28278 - DNA, 1024 bp, Homo sapiens
tttgggaaggcacattccatccctttaaagacaaacctggaagttgcatacatgatttttcttcataccctattggtcataacttagtcatgtggccatgtttagatacaaaggagtctgggatatgtggtctttgataggtgactatttggctgaaaatttgggtctactgaagaaggggagaatgggggatgattaaacattgcctgttacacttcaaaatgttttgggagaagcttccagaaatagactttgaaaatacaatggattgcattagttaataagtttattttctgtatttaatcattaattttttaaactatggtatgtgaattcaaatagaccgttatgcaaaatataagtaagtggtcagattagaaaaatgtagctatacttttagtagtgaagggattttgggtctaataacagttattttactgacgctttattttctgatagaaacatggttcttgattgctgtgcttgtatcacgtaagcaatatttgaaatctgagcttttgcatttagtgttaatagtccactggaccaactgaatgtcttcttgctcataccctcagcaaacaatgctacaataacactcgcatgttgtcaggatgtcataaagatttgagtcaccgaacactgcaagaaggatgatagcagagatatttaaacgtacatttactatctagtatgttcctcttgaattcctgtggatttgaaaaaagagaaatataaatatctaagattcccttaaactatgaaatattattagctctagtacagacttgggaaaactaatggttcccaaacagtcttctggagaacttgtcaaagttaagagatttccaagctcagatgcctctctttctgtaggtttagagtgatgctctggaatctgctttctttttttttgagacagagtctcgctctgtcgcccaggctggagtacagtggtgcgatctcggtttactgcaagctccgcctcctgggttcacgccattcttgtgcctcagcctcccaa

SEQ ID NO: 28279 - DNA, 1695 bp, Homo sapiens
caaaaaatttttgtttcattttagagtccttttaacagttaattttgacttaaaagtttgtttggataaaaataggactctagcccttaagacaaatactgtctgttgaaaaatttattctgatttggttattttccctcgaaaaaaacaactgttaccacagtggtgttttttactttatctttacatcaaatgttcgttattgagagacattgcttctgtgatataaaagattgttttgtaaaagtttgttgaaacaacaatggtaagatcctataggatctcattgagtattttacagtttaattttttttttttgtatttcgttgttgtggttctgtagtacaatttaaaacatcagtaaagctaggtaaatttacctaggaattggcctgaaggcccacagttactcagcaatattagagacagctatgcaaagggagaagccaggcgttttaagattcacgggagacagtttgtaggaaggctgtttgctgaataagacaaagatacagacatgcaaagtaaaggatgtgggcctatagggaaggtcaaagaataaggaaagttcacttgagtgagcagaaatggaagagggatttaagcaaatagatgaacaagaattgtctctcctaaaaaaaaaaaacctacacaattatttgatgatttattatgacttttggggtagagaccacgctagtcacaggatctgcaagccctgccacctggatgatctggctccagctggctcactgcctcttctcaccagtctctggatcatgtgactgtaccggctcctagtctttgcatatgctgcttccttggcttgggatcatcacttctatcagctcttctatcccttctatgcgctcttcgttttaaaaatctcatgtgtccttgtactcttccttcataacgcttattacagttgataattttttagtgcttatttgattaatgccctccagagatgaggaccagtagtgttttgctctctcttgcaatctcagtggttggcagggtgcttggcacatagtaaacactaaataaacatttgttgaatgaatcagtgaactacatgctttggtctttactagttggtctcaaggaccaaaaacctacagtaggaagatgtttgttggactaagagattagcaggaaatatgagagctttgaggaaaaaggaaaagatgaagttttttaaagataggattagaaagttctatgtagtcaggagaaagaaaattattcgtggaataattcaacaaatgcacatgaaatgcctactatgtattgagaattagatactggaaatgtggagtggaaagattctgtcttctgtattaaaggagtgtataattgtagtagtttactgaaatggggacagtccttagtggttgtttggagcaggtgtaagttgtggagagggatcagcctggatcaggatattcttcactcttctagccgacacagtgaagttcattcagcagttatatctggaatgtagctctggcatttgtagtagctttcaggtgcatatcgaatataagtgctatagccaggtgtggtggtccgcagtccagctactcgggagcctgaggcaggaggatcgcttgattctgggaggttgagggtgcagtgagctgtgtttgtgccagtgtactccagcctgagtgagtacactttgagtgatac

SEQ ID NO: 28280 - DNA, 1511 bp, Homo sapiens
gagagcgatctccaccattaagaaagctaattgttcactttccccaccgcttttgcagttaggatgcaatcctgtggcctccatgactggcagtgcttgcctacctcagaggccagtgatctgcagaggcaggcggtatgtagaatctgtattctctagtcaaggagggatggggatgggatagcagcttatcttttccataggcagcagtgactgagattccagttgcaacacttagtgcctggtgttggtatcagtataagttgcagtgactgagtctcatttggtcttcactggaccatatctgtggtttgaattttggatgttcttaactatgtagctttccagcctggtccccatggggttttctgtgagttgcctaatacactttaataacttcctttcagcttaaacaaagccagagccagtttctttgtttgcaactaagaacctttacttggaagatgctaattaagacaatagataattccaaggaactctcctgggtcaggtttacctgcatgtagattagaatttactgagaagagttcacagcatatattaagtgaaatacttagaaacctgtttattgatttaattagtttgctgaatttgagtgcctcttcttggctgcgatatgttttaggtgttaaggatacaggagtgacaagattgacaaggtccctgcactcacagagcttatgttccattgtaagatgtagagtaaacaagaaagcaaataacataattacaaaaagtgataaatgccatgaaaaaaataaagatggggtgatgtgataggtaatggtgtatgtgtgtgtgtgtgtgtgtgtgtagttgtatcttagtgtaaaacatttaaacttcagtgtcaggaatcatggcttctgcttttgactattctgaatttgccttcctactgtaaacatctagaaaactggacaaaacacagggaagaactgttttcagatatcagataataggtagcacagaactgtgatccctgacagatgggaaccaagtgagatgagccctgtgatggccagttttctgcttgaaggcacttttcacacctcagtgcaggaaggggatcccagataaagccacgtggccccactaagttgagaaaacaaagattggagttaggggtaaccaagggtggttgtcatttgaggagcagagttccagagaggagggagctatactgagaaagagttcttatacatctacttagtggtccccttaaatgtttgattgtacatgtataaggtgaagtttcacaaaagaacagtttctgggggagctgtaagcagaaaaaatctcagagtttacagagggctgagaattatttgagtaccttgtaaccagagtggaaatgcaggattcattgagaccccagaagagttatgtcttggtagtggggctaaactagtcctgaagtaaagactcctagctttgcctgaaaaaagcttaaaagcaagccttcaaagaagcaaactaatctgaaacta

SEQ ID NO: 28281 - DNA, 1044 bp, Homo sapiens
gaagttagagtagttgaaaatcagtatttgagcagagcagggactatggtagaagaactttattatgtagcagtatgtttatctcttgctaaatgacaatatcaccacagagttagtagcttaaaatatacacttccatttattatctcagtttctgtgggtcagatgtctgagcacagtttagctgagtccactgctttagggtcttagaaggctgtaaagatgttggctgaggctgtggtctcatttgagacttaaccacagaaagatctcttctaagctcatatggttgttggcaggattctgttctttgtacgctgtcaatcagcaaacatttgccatcagtttcttgccatgtggtcctttctgacacacccacttacttttgcaaagccagtaaaagagtcaccttgcaagaggtgtacatcttaacgtgtcataaccatggacatgccatgccattacctttgttgtattctcttgcttaaaaacaagtcacaggtactgcccacactcggggaatggtgtgcacaggatgtgaacactaggaggtgggtcatgggagcctccatcaaagttctctgagcttttctttcttatcgcttcatgacttgtttcaccggaattttagagctattaggctttattgctttaagaaagcacttttagtattaccataccatgttcttctagttaatggagaaattagtctgaaagattttccctctgtttctgctcttcttccctaaaatttgctctgcaaaccattcctccttcagatggtatgaaggaaataagcctggggaaaattaccttcttggagattgacagctcacattagcatattgtaggaaaccttctttgcacccgttaacatagttagggcaatctttattaagcttgccctgagcactttataaacgtacacataccactagccagtaaggtactgttttcatttaacctatgatgaaacaagcttagaggtgaactaattttcccattttaaatgggaagtggttgatagggtaggattcaaaccag

SEQ ID NO: 28282 - DNA, 1197 bp, Homo sapiens
tgagctcaggcagtccgcctgcctcagcctcccaaagtgctgggattacaggcgtgagccaccacgcccggcctgttactgtttttcaactgtcctgatttagaacagtttcttacctgttctttcttttgtgatgttgatatttttgaggaatacagaccagtgattttagagtgttaccctcagtgtgcgcctggtgtttcctcatattagatacagattagatgtctcaggcaggaatgatgctgttttgaattttgatgaagtctaattattaaaagtttcttttatggattgtgcatttgttaccaaatttcagaactcttcctagtgccctggttctttggagtggagaatggcatttggaaacctatgtctgaatgttaggtgtgcttggtagtgttagtgtgtgggcgctcctcggctttcagtggacagagccagagaatatgtgcatgtcctgagcctcctgttcgtcctctttccaggtttggggatacatgagctagtttccttggcatcttcaactgtagacacttattctgtggcttcctttagtctcctaagcctgccactactgtgccatcttctatccattgtctaaaaacttctttgtccatcactgtcttgtatcttgttttattattttttaactactgattttaggtgagttttatcttcagtgcagttttgtgagagaacagaggtaaatgtatggattattcaatatgttgtttacttgctgaagctttaatactctttcaaaccaatttttgccttttattattttttgcagtcctccttaaccccttgtttacctgctctgttcctgattgggctgttctacagcctataatcttccacgattctcctttgtatggaatgaagacaaatttattaaactattcagattctcttgataacctagccctagtttatctttccgttttcttttctgcagttctgccatcttccctctacttcagagcttacattttcccactcgtgttaggctcctcttcagctttgcctttggagcatactgtgcttttctgataacgttttctatatggcacagagcctctgccagggcatgtagtaggtgtgttcagtgcattaaacaaacatacagatcctctaaactagtaaagccacccaagcttgtttgttgcctgttatcattttccaaatactgtc

SEQ ID NO: 28283 - DNA, 1096 bp, Homo sapiens
gtagaagagtttcattctgaaaccatttcccacctcctcctgtccgtggaaaaattgtcttccacaaaagtagtccctggtgccaaaaaggttatgggatactcagctccacgttgcacctaaagtagcaaaagactagataaaaaccctgaatatgtacttgtgaaatcctgaatatgtacttcgtgaaatcagtgacataaacctcctcctgggttacgtgttacagttcacaaacgatctcaagtattctacagttcacctgtggttgtcctttgtacaggtggaagaagagagggatctcagattccctgtagttgcgtccccgcccccagacagatctctcccttcttcatgccctggattgtttcatccatttaaatagttctcttcttgattctgacttgagggatgggcatcctgtgattaggtttggatgtgacagtggaagtttgtcagaaacattttggctcatgggccagatacattggagtccgtccgaaagctcactaggaaatgtagattctcaggtttaacctaactaggctaactatacctaagtatcttagcagaggtttggatgttacagagtttgaagatcgcatttttaggccctgtattcttattctctgtaaggatgatgtcgcccttcaagggtgtaaggattgttattggggagtatatattcagggcagcttgaatctgtgctcccgctcctcacctcattgttcttcggagggggatggaaaatcttagatgttaatcatggtttgtggccctccagaagttaatcttacctgacaaaaccttattccttaatgtttaatttcccttgttaagaatacatttaatttattgaattaaatttaaattaaatttctctcctggggatgggatactcaaaaaaaggttgagaaacataatcctataagaattactctggcatagtacctgccctgcattatctgtgtcccctctcccatctttggaaaccttaggatgtgattttggctatattattttaatactaagattttacttacatttaatggattaaaaagaaaaacattctagatgggtggaaacatttactctg

SEQ ID NO: 28284 - DNA, 1049 bp, Homo sapiens
acaaatacagtttgtactttcatgttgttgacagttttggtgtggcattttaacatttactgttcttaatagaatatgtgacaactttctagacaggtactactgtttaggattgggtagctcagtgttgggtttcactgagcatgagaggcgtggagagtttacattacatgtcttccagtggttctgtctttctaaagcttgaaggtactcacgagaaagcagtgagactgtacatcattccaaatgagatgttgatgtagattaagcacagtttttcatcccagaatgcaaattaagaatacaaacacaggttgaagcatttttcataggtgacatttgtagaatgtatatattttaagaacatttggaaaactttttttaacctacttgtattagttccctgtggctcctgtaacaaatcacagatttagtgacttaaaacaacagaaatttattctcttacagttctggaggctagaagtccaaaatcagaatcattgagcctaaaccaaggtgttggcagggccagggctgtgctttaggaggctgtaggagagagccacttgctagtggctgccagtacttcttgacttgtggatgccagcattacttgacttgtggccacattacctcaatctctcctgcgatggttgtgttgtcttctttttgtgtcagattgccccctccctctctcaacatttgtgatggcatttagggcccaccttgatgatgaaggataatcccctcatctcaagattctcaacttaatcacacctgcaaagacctgtttttcccccaaatcataaaacatttataggtttcacagtgtaggatgtagatatcttttggtggaccattttccagcttatcacactcctataaattatttggaaaagtaggaaggttgcttttgaagtagcaacttgtagatatatcataagtatacttccagctataataagaattagtcatagttttataactttttagtgttaacttgatgatccaaatttgagatccaacctgggagacagctcccaaaattt

SEQ ID NO: 28285 - DNA, 1046 bp, Homo sapiens
aattactgtgtataagctcttcttcacatgaactttggaaggtgttctacattttgagggatatacacattacatattttcaaatatttagagttaatattgttgcaactcctacttcacactgacaatttccacttcccacttcccattccccagttgccaaatgtagtagccataaagagcatcagattgatttatctgccatccctttgtgcaattgctgccatgtttttactcctacttatattatacattatgtacaattttattatttttgctttaagctgtattttaaacaactaaaatttatttttgtttaaaactctcagtttttaaatataagtatccaaaggaaaaatatttatgaaaactttgtttccatttggtatcagttttctgtcttaacactcttcggcatttcttgtgcagctctgctggcaaggacttctctcactttttttcccttcttacaaattttaatctctaaatgtctgtattcagtcttgagtttgaaggttttttcactgaatgtagaattctagattgatactttttgtcttttagcactttaatggtgttccattgtcttctggcttccattgtttgtgatgagatgtaagtggtaatgactatctttattccctcgatataccagtcttttcttctggctgctttcaagattttctatttctctgctttaagctgttttactctgctgtgcctgggtatggttatcatttgaaagattttaagctatggtttcttcagatatttatccctttttttttctgtgactttatttacttgcattatacaacttgatattgttccacaggtcactaagggtctgttcagttttctttagtcttttttctctctcttctttagacaattttctttccctttctctttccctttccttttcttttttgagacagagtcttactctgttgcccaggctggagtgcaatggtgccatctcggctcactgcaacctctgcctcccaggttcaagtgattctcatgccttagcctcccaagtagct

SEQ ID NO: 28286 - DNA, 2092 bp, Homo sapiens
aacatggtgaaacccttctgtactaaaaatacaaaaactagccaggtgtggtggcacatgcctataatctgtaatcccagcgacttgagtggctgaggcatgagaattgcttgaacccgggaggcagatgttatagtgagctgagatcatgccacagcactccagcctgggatacagagtgagactcttgtctccaaaaatgaaaaaaaaaattatatctatgtatatctctatatatctctatatatctatatatgtatatatctctatatacatctctatatatgtatataattatatatatctatttatatatgtaattatatatatatatctttagtagtgacttttactagtgaaaattttaatatcctaattaccgttatttagaaaaaattctttttgagttgatgtttaaaattcttttgattttttttttttttttaaagtcatcttttacaactcctccctaccgctcctcccctagctctccaggcccattgccctgactagtaaaggtttgctgttttttcttctggacattttcctttgcgtcttcatttatatataagtgctcatattcttgttatacacagatatatttacaaacgtaggttgggtatccctaattcgaagtgtttgggagtacaactgtttcggattttgaaatatttgcatatatgtagtgagatatgttggggatgggacctaagactaaacattcatttatgttttatatactgtagacagcctgaaggtaattttatacaatattttcagtaattttgtgcacacaataaagttttggctgagctgtggctgtaacccatcatatgagttcaggtgtggagtttttcactggtggcatcatgtctgtgctcaatagatttaaaattttggagcattttggagttttgtattacagatgctcaacctgcacttctgtaacagagtagtttgaatgcttaattaaaatggcagttgaatattatgttaactttggttttatgattaaaccttttcaaagtttttgttactttcagatactcataagtaaggcatataacctctctagacctcactttccacatttgataaaggaacgatttgaattaaatgaaattgaaaatctcttagctctaagtataacaaattatgtgttaaattgtataattcatctcttagatatcatgaagaatgtgttgtttataatatgaaaaagtatgaagataaaaatcaaatatgactttgggtagcaagaagagattttgggggaagttgctaatgtgtacagttttttcccctaagagcggcgagagaatggcagctgatcagactggtggtggaatctgtctctattgcccagcttggcactatgaagtttgacctgtgtcgatcactcaaaactagctgatgacatctgaaagggagttttaccccggctccctgaagtttcacattacagctctacatttgtgttaacacaatgaatgcttcaaaaaaaaaaagttatagaaatcaaagcttacataggcaaatctttgttagtgacttagttaaaaacatttcatgaataatagttgctcaagctattttaacccttttccctttcccagaagagaaacaagaaaatcccacacattttgctcagtcatggtatgtttgtaagctctcttgtcagaaagtgtcactgattctttaaatttcttttagttagctgcttttgtccagtagctcacttattttgtggtttgaagatgactgtacttctgacacttttctcacatactcctgctttaatttttcgaaaaactcaatggcaagaaactgaaaacatatacagaagtggagagaatactagaatgagctctcacgtccctagcctcttggcttcagcagtactcagtgttttgcccatcagattttctaatgcttttagtgtaagtaatgccacatttaaaaatactccttttagaaaagagacttagtatttaaaaggaaataaaccagagtcattcccaagatttatctgattaaactgtagagtttataattatataaattttttttagcacatagaacagtcattctc

SEQ ID NO: 28287 - DNA, 1060 bp, Homo sapiens
gtggctggagtgtagatgtgtactaggagatagagtgaaaaggtggaggtaatagtaatttaaaatataacagtaaaaagaagcagctgtgtattgatcacttactgtgcactgttttaaatggtttacaggtgccacatctttgataatacagcaattctgtgggtgcaataagtgatggagccaggagttcacctggggcaggctggctccggagcatcactggtgccttagggcctcaaataccagattcagcaacgctaagcacttttttgggtcttatttttggatggtgatagttagcaggatattaactgatttttaaaaacaaatatatttgtccattgtcatgaactttttaactctgttggagtttaaaaaattggaagtacttagtggttactcattgtggcccctagttacagttcatgaaagggattttttaatgttaagatggaagctgaatttcttggaccatttttttcctcataaaagatgtatatatttataaaaattgcgatacattgagaagtataataaattagtaattactcagaattttattggccaaagatattcattatgaataatcttaaatgctttcttcgagtgttttctatgtatttattctactcttctaaaactgtgctttgggaagggctttgagtcctttctaatataatggtataacttcccccctcatgcagtgaagctttcagaagaattcaagtgatcacacaacatcatatctgtgttaccttttgtgttgaacatttattatttataacatttaatttttaatgataaacttttgtatatacattttgtatattctgttatgaaacggatttctaaaattagagattgaacatgaagcagaatggcctacaaaaggaacatgaatctgtgctacagatataaaaactattttgaaggctataggaacaaccacatttgccaggactcatgcttaaatagactgtgtacggctgtggagatcataaattgagaaagcatgatatttgagcaagaaaaatttactgaggtttgttaagatttg

SEQ ID NO: 28288 - DNA, 1041 bp, Homo sapiens
ctaaagtgagcatggagaggaatggaaaggcatgaggcacttcgaaaatggataggatttagtaagaccatttagataaagtcagcagcttctaatgaaattactgaaagaatggtggtgcgggaatagagatgggaagttcaagtggataacatgtggtgcaggaatgtgatgaggagttgtaggcatagagaatggaggcagggatgtggcactgtaggcagccacccaacagcttgttagactagatattgagtgaaaagtttgagtggagaagagagtttgaagtattagtttggagtaaaccattgaaaatacttcttttgcagggaaagatgtatagagaaatgagtgaagcggtcaggggatagaaccagaggtcacatctgaggttagggctaaatgtgaaagagacatggattatttggaggatagctagtgttgtgaaatacaagaacatacattttaagaatttttaagggggtagcatttctctgtaaactccacagaagtgtgggaggggaagtaagtaaaactgaactcactttactgcttttagtaatagactcattggaagaaaatgtaagctattcatgcagtgtgtgtttttgattatttctgggccttgttatttttctgtgtttctgagatgcaaggattatttaaaggcaatggtttataaaatgatatataattacatacgtataaaagtacatataaccaactaagtatatgtatgcatgcactcatgcaaatcaattatatatttacattttatatataaattatatatgtgtgtatatattgtattatagaacatcctgtgtggaaaagttggtgctgtcagaagggagagagagcaaggcagttttccagtgcatttcttataagctagttatgagaagggcttgcaggttactgattgaacatattctttctaaatgtcttctgtctgatagatactcctttgttagggaatatatacataaatgagattaccctagatgttcaggttagtgagggaaacgttacaatagatag

SEQ ID NO: 28289 - DNA, 2015 bp, Homo sapiens
aaacaacttagggaaaaggattattaagcaggatgattgggatgacatcatgtgaaatttaggaattggaggcattgggaattgagagggtgctaacaaaggaaaacagcttattttagaatttgtctggaggatgtagaattgaagaagttttggtatttcttctgcagcggccccagtgcccttgaccaggaacatctcttggagtcagtagttttcatgaggctgacctaggaacttggccaacatatgcaacattgttctatttaaaatattccttgaattaaattcgatagtatcaatttaaaacataaagttttcactcaactcctttagaagttagattttagcttgtacttgtctttacctcttctgctgattatcagttgacaacactgagattactttcattttcctgtaagtcattatgaatttttctggtcaaccatgagttatcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggtgactcaagttttgaaatacagtaaaactctggctaagagaatgtgggaatcgatggtctattttgaatgggggaggtttctgataaatagcagttagtggggggaattgtagatcagtaaatgcaaaggtagttgggctatttgttaaacttacttttgaactcagattgataatcagtgatttatagtggtgttattacaaatacagcatagtaaatgctagcacttaggcttttcaagagctaatattttggtgggaattggaataattctgttaatgtaaataacacagtcacctttatggttgaatgcatgtctcccccagaactctattagaatatggcagatcttttatgggagtagatgttagtaggatatcatcaaaaagactgacaagttaaggatattatacccatacatacggtttcttaaaaagatatgctctgggattttgtttattttttccttgttcccaatatccctgcctcccatttcctttcttcccaccctccccctcttatccttttgtcatttgtatttttatacagaagaagcagtgtgaaggcatttttgaaagaatattttttgattgctctataattaattgaggtgatcttttacatgggaaactggaggctattccacacatggctatgttcaaatttctgaaaatgtagtgcagctaatgtataaagtgttaataacttttgaacttaaatgttcttaaattaggcatattataaggcattttgttgaactaagtgacttaacatttgaaactctgtcagagagccttatttgattatatttataaactgtttgaaaatgtgattgctaactggaaaagaaatatttatataaattttgaattgatacctaacagatgcctaat

SEQ ID NO: 28290 - DNA, 1098 bp, Homo sapiens
tatgcatacactatatatatactcatatatatgaatttaagtacttaaaaccgtttgtggcagagttttaattttggattctcttaactcattttaaaatgtgaattttgtaggacaaaattttcatatttccagtgatcacaaatggggtgtattcattatacaagagttagaaatcagatctgtaaattacaaaaccccaacttttaaaatcccatcatatgtggggtacactaggagaatgaaagggcatgtagattgtaatatttaggaagctgtcaccagtttgcctccccttggaattgttgtcgtggtcgtgtgtgtctgatctttttctttgtctgtgtctccttctctagctttcgttcatgtctcaacccaagcagtttgacttttttcttactgattcaataaatttatttttctagtaagttaaaaagatagtggatttgcttttgcactcatgtttttactttttgtttattagatgatacaaaatcactgaaagaattctgaaatgtataaatatatatagataagtataaggaaacatatcccaagttttagtgtcccctacagtgtggcacattcccttccagttgtttttcatgccatttttttaactaattgaggtcattttgaatattcaggatgatgtggttgggtaagatccattttatactcgtgttgactaacatatcataaatgttgccctacatcatcaaaagctaaccatagtgatttgctgttactttgaacttggagcaaatccagggtactcagaatgcttttgaagataattactttagatatttattttacagtatgcttatttcctagttaagttaggtatctcttatttttaggcattaagttgttttttaaagcactaatacctgtgcatagtatttggctgtaaaattattttcttataattgattcctaggagtcataatgtttgaaaaattttcaggctcttgatgcaacttttcagaaagctgtttggtaatatgtaccactctgtacattacaagaatgtctcttaatttatttttctcagcattgagtattatagttaaaataaatcttcaacaggca

SEQ ID NO: 28291 - DNA, 1084 bp, Homo sapiens
gtactgtgattgacccagacagaggttcggtagcctgccccaggtcacacagctagtaagggatggagctggggagcaaattcagggcctgtgagtccctcctcttaatgatcatgcttttgattttagggatacttactgttacttattgctggtacattttccagtttgcatttgccttttgttcatggtgtcgttttatacaagagctttaactttttgtatgggagaactaagttttatttattagtgtaatgcctcaaacataacagattctcaaatctatgtgttgaacaaatgagaatgaacccatcagcagtctgttgatggtgatgaccttttatgtagtgtaatatgtatctccttttaaagggattcccagggcttcataaatgagttactctttggtttttatcaggcacagtaagcttatctgtattagctcttctggaaagttttttagatgtaatcactgcttttaaaaggaacatgtgttcttaaacaagcaaataggagttgtgaagaatgtatttattgataatgatttgaattgtagattcaaagtgaaatgaaataatttcactctaggaataatttgatgggatttgttttttgtatttttagaaaattatagatttggccattgtttaaaaagttttgaataaattttggcttagtgtaagaagattctttgataggaaaactaaaactatttgatataaaaagttatcattgcttaagatttggatagtgtagatcatctcctcaaaaggtgaaatttaagattttacttttctcgaattcctgacctcaggttatcctgctgccttgggctcccaaagtgctgggattacaggtatgagccaccgtgcccgaccaagattttacttttctttaagcactctttctcctcttctctctggtggtgaataccaggctacttaatggtgccttcttagtttggcctctgtattccttagtcttttaaaaaagtgtagagatccatattgctaatggatatacattagagagaaacacaaataagttaattttaatttttataaaccatccacaaaatatactc

SEQ ID NO: 28292 - DNA, 1020 bp, Homo sapiens
acaggcaggcttcagtttatttagcgagtgtgagccctggcaggaagattctctttctctgcttgccaggttgaggaggcctcattaagcagtttgaacttgtggttttggcgtgtctagtcctggtgcaggtggcttggtatcctcacaggcatttctttggcctcacccttggggtgactgttcacttgtgtttgagcggctgggactcagtaggttcactggagtaggtatttctttagagccactggcggaggctgatcatgcggcagatagttgtttagtatcaagccagtctctccccttctttctactccagtttttctttaccacccagaatggcatctgccacttctgctctggttcctagatctttttgacattccttaaattattggtattatcccagttgccttttcttgcagaaaactgacaaaatctttggttcactggtatgtctccatcccatgctttattttatttagtgatctttcactgcttgtttctatggatgatatagaggaatatagaggataagaacaatatgtttactctatccagtgttctagattttcttgttagaagcaccctccttcccagcttgggaaaactgagctgctggggtggctgttggctccttcgcttgctgttagttttaaaggattgttttcagtcacacttgaattgtagctatccttggttctctttttaccaatgaattctggtagtatgttttaagagctgggtggccttcctggcctttgtaaacatttcctgcaatgcctagctttagtgagctgcgaagttgcccattggagatgaggctctattgaaagtcagcacctgtacttcactccctgccttttgtgactttgggtttcgaccgggtgtttggaagcactgtttcttctgtccttgaccttgttccacatgttttacccattacctcctgtgagcaggcacagggcctttccttgtcacctgggcttcagctgctttgaggatgactacttacccctt

SEQ ID NO: 28293 - DNA, 1892 bp, Homo sapiens
ttcatttgctctttttctagtgtattaaggtaaaaagcagaagccattgatttaagaactcttttcctttctaatagagatgattaatgctataatattctccgtaactattgtcttagctgtatcaaaaattttgatatattttattttcattcttttcagaatgctttataatttgctgtttgctttcttccttgagttgtggttatttaggactattttgttttgagttatggtttcttccttgagttgtggttatttaggactattttgttttacttacatggttctgttactttattctgatttagtttgtcaccagagaacgtattttgaataactcgatttcctttaatttattagggtttgttttgtaccccataatgttgtctatcttggttaaagttgctttgtccctagaaaagaatgtatattctgctgttctttggtagaatattctctaaatgttaattaggtcaacttggtcggtagtgttgatcagatcttgtatatctttattgattttctctccacttgttctatcaaatattgagagacggatattgaaatctcttaatataattgtgtctatcgttgtagttttatcattttttttggtctgtgtgttttaaagctctgttaataggttcatagatgttcaggatttagtatgttctcttggtgatttgacacttttatcattggaaaataactttcatctcgtgatattcttcagactgcagcatactttctttgataatatagccattctgtcttaattttgatagcatgatatatcttttcccagatgtttacttttaatctattaatgtctttgtattagaaatttatttcttacagacacatatagttgacttgcttttcttgttgttcctggtctgaaatctctgcttctcatttgaggtatttagatcatttgtgtttaatgtgattattggtatgttttggtttaaatctgtcatcctgctatttatttcctatttgtgttgtctgtttttcccctttcctctttttctcctaccgtcttttattctgcttttggattgattgaaatttttaaatgatttgattttcttccttttattggtttattcattttaaccttgttttttaaatttagtggtttctctttatcttatcacagtctacttccaaaggatattagatcacttcacgtatagtgtattgaccataccatagtattcttctatttctctactactgtcctttttactgactttaaaatagattttgtttgtgcatatgttattaaccttacactacattactattattgtttaaacacttagatttaaataagaattcctgtattcttatccatttcgttatcttttctggtcttcattcctttgtataggtccatatttccatctagtttcattttccttcatcctgagtatttctattaacattttttgtagtgcgtatttactaatgatgtattctttcaccttttaggtatctgaaaatgcctttattttgctgttttttttttttttgacagatattttcagtgggtatggaactctaaatgacacttttttctttcagtaatttaaaaatgttgctgcaccatctgctctctcgcattgtttcttacagaaaatcttctttattcatttgtatataatatgtctctttttctggccgtttttaagatttttctgtttatcattggtttttagcagtttgataattacgtaccttagtttagttttctttgtgtttcttgtgcttgtggtttgttgaacttttagatctatgggtttgtagtttttatcagatttggaagatttttgaccattagtttttcaaaatttttgggttctcctctctgtcaggaactttag

SEQ ID NO: 28294 - DNA, 1053 bp, Homo sapiens
ctctgtcaatagtagttttggatgcttatggaggtcacttgatggaatgagtctaaaaagtgaagcaatgaaatgtaacagattttttaggttatgacctcacattttcaggtaatgatattctaaatctttcaaaaaatcattttaaaaagtattgttgtaagtgaaaataattaatgtacctattgggttaatggaaaacaccacctttctgatgttaaaaaattttatctcattgttacttgagataaaatatccagttatagtattttacagggattcagtaagtgttgtatctaaaacaacttagaagttaagattatgtgctgcggaaaaccagatgacttaaagaggatttaatgacgacaaagatgctgatgttaaagatggagtaggctttccactatattgagaagggcaccttatccagacagattttaataagtgagattggtcttatctctttgcttttgggacagctttatattcctgagtgtgctgtgctcagccagatgtgataatgtcaaagccggtagtgattgtaaagatggttattcaggggtggtcacctttttttttttttttttttcgtgccccagcatacttgagcaggttaggttacattctggcaaaaaacaggctcccaggacaattcttgggagatgggggagggagagagtggtgtatatattttgaagaggtcttaactacacagtgattctacccctgtgtgtgagggcctgggctctttggacagatgacatgttttttccagtgttatggagttaaccttagagctgggaccagaaccctggacttgctccttgtgccagttttaattttctcagccacacccttttctttccttttattttgtacccttttttcttactattttcaatagaattttaaatgtcatatgtttaataagatggaaactgctgatataaatcaagaagcagtctttaaattttaaataatggtacatttatggagacattatcaactaatttaatttctttttctgactttttaagtcacctcttttttcca

SEQ ID NO: 28295 - DNA, 1043 bp, Homo sapiens
ccccccgcaagacagagtctcactctgttgcccagactggagtgcaggggcacggactcggctcactgcaacctccacctcccgggttcaagctattctcctgcctcagcctccctagctgagaccacaggcgtgtaccaccatgatcgcctaattgtgtgtgtgtgtgtgtttagtagaggtggggtttcgccatgttgaccagtctggtctcgaactcctcgcctcaagtgatccgcctgcctcagcctcccaaagtgctgggattacaggcatgtgccaccgcggctggccttttgtgtttaacttttaaagcgtctctggtcagatgaatattttgccttttgggtatttttaaatggaaaatttatgtaaataatcagtgttttaattagaatcacaaagccaaatgattgcctcattggataattttaagtattatgctgcaattcaatataggtaccaagtacttaactagacttaaaaatatcttgtatgtttaacagctgtttagctagaactaaaaaagagcaagtcctctatgtgtatgcttctccccttttctccctgggatgggagaaggaaaaagttaatttttttcccccttgactgctgttgctgtgcctgctttagaagaagacagaggtaaagatcagggaaggcaactttgtttccaaagaaacattatgtgcctgaaacttagtaacaccttcagacacttcttaaaatggcttggttatggcatagctgaaggtctgaggctgtggtaggtaaccttctgcctgtgttgtattcctggccgcctctgtgtgttctgaccctgctcctctagagaggaaagcagctaagcaggcacctttcaacttttgaatggcttcatagtattacagcatttagatgtgttgtgccattccccctctttttgtacttacgggtttcttggaagacagctgtaatatgcctgtaggcacgctagacaaagttatggtcaagggggcggtaggggagggcatctgggtaatttactgtgtgtgtgtgtgtgt

SEQ ID NO: 28296 - DNA, 1533 bp, Homo sapiens
catgtccaggctcttcccctgctctccttaactatcctacagatgcctctgacctgggaggaaggaagagaagccctcatctcctgactgagagtgggaagtggcagtcactgaatgtgcttgccgtgtgacattactgcatgtcaggctggcagttcactgttttgtgtgtggaggactgtttctgatgctctctgctatttgctaagccataaataaggatataccgtctgacaactactataatagtatgaaggacagctttgaaatcaagacgtctgataaccttaagctgtggtcactgtcatttttctcttgaaagatcctggactctcaggatctggcttaccatctttgatggacaatcattttattagcttgcttgaaagaattagttcctctgttataatcactgtagtgtcagttggaatgacttgagccatttttgtaaaacttgtgaaatctttatgtatttatgaaagttaaacttactgaaggctgaatgactgcagtgaaagtatgaatcctttaattaaataagtggttagcatttatataagcagtctaattaggaccccaaatatttgttcattttctttagggctactaacctggatgcccgatggagtaatcatcactgtcctgtgtagatcttgtagatttttgaaagtactttctgtctcacagtggtggtagattttgtttatttaattatttagggggcatgttttcagtttagcctgattagttacctgctgaataaataatgttattctaataccctgctaggaagaaatttatgtaattgaaattctgatttctatgtaacgttctgttttcgtattgagacatgatactgcctgacagggctgcttcagcagctgtcatctggtttgttgtttcttgtgttgttatatggattctgctagcctaaaaggcattcttctctgtgtctctgcagggctgtccagtgagtcatctaaaattaaactttgatcagaaataagtttcgtttttttcccgcaaaggactggagtgagtgggcttgagaatacttgtatgcaaattaaaaatatatatattcataaatatttgggagcattaggtcaagtgccaattaagtcaggaaggatcctgcagccatagtcatgaagataaactttttaaattgcatttgctcaaacttaaacatgtttgtgagtattttgtataagcgaccattatttcagttgctatgttagatttgttgctttctttagcatggattttttttttttggtaaagtgttagtttttaatgtttcaaaagattttttttgcagtcatttaaaatcaattgtcagttaatacctaaaattcggcagattgtatgttttatttattgcaacatgttgagaatcttttgtttcctgttgacattttaaaaatctcctaatggcagattgatttgtctgtgctctttttgtattattaagtcaggcagcagatacttagagagcttctgctgttttaagccatggggaggcagtagcga

SEQ ID NO: 28297 - DNA, 1045 bp, Homo sapiens
ccctcctcatttcttagtggattctgtcttagaacctcagcctcataagtttccacatttagatgctatagttttaattaaattattttcatttactttttgttctttaatattgttctttgatttaactgtttctctttaaaatctactatcaattaatactgtcacaggaatggtcccctgttaacacattactaacaaagaaattcaggttaggtaagaataacattcagatctacaagtagagctacgtgtgggttatgtatcagagatgatggcttctgatacttgttatttttacttttttgtttttaaacttagggtcttttctcatgctttttgtatttgctgtttcctctgtgtttaccactatctttttgaatcttatgtcccagtctttgagatgtgttgtttatgaaatatttctctgtagaatcagtgctgatccatactggtaatatggtctctagttattatagttccttgctagaacatagtaacgtggctgaagtaagaaagctgcttcatttttcttttagtaaaatattgaatttttcccaagtttagcaaagttacagaaacatgctcatggtaaaaatgatccatacagttcagaagcacgtaaagacagaactccacatgcatgattttctccaacatgctttccatactgtttgacagcagttgaaaatactttggaactgcactccaaatgatgattttagatagctttgaattatttgttaagttcatcattaaattataacattatctgatgttaaaacatgtattgtgatacattcttaagctaagatattattatactgagttgaataaagattatataatacggtagatagtaggttgaaccatatgaaattactgtttttgtaagccaagggtagtcagaaatctatcagcagtttcatatggttccgcataatactttatatgatcatccctgttacaggatgaactgagtcattttttccattaacatttgcattaaaattttaggaagatagaaacttaagagtaaaaacat

SEQ ID NO: 28298 - DNA, 1049 bp, Homo sapiens
ttacaggcatgagcccctgcgcctggcctgccaaaacattcttgaagaagaacagaatttcctgttggatcttaaaatttttaaagctattgtaatttaggtagtgtccagttcttgaacagagacctaggtaggtaagtctgtatccagtagaacagaataggcagtccaaaactagatccaagcataaagggaaatgtgatttatgataaggatggggttacagagcagtggagaatgtttgtcttttaaataattggttaaggatcaattggatgttaatttggagggggaaatgaaacttgattcctattttacacagaagtcaaatgcaaatggattttgcatttagatgtgagagagaaagcccagtgtttagaaggtaatagatttttttcatgactttgatataaggaaaaatttcttagattccaaaagtatagtactaattgtaaagcaaaagttgataaaattaagaacttttattcatcaaagtataccattaagagggtgacaaggcaagctgcctgtaaccaataggggctcgatcatattcagaatatggatttttaaaaatcctagaaatttgtaagaaatgggcttacaattcagtagaaaaaatagaaaagcaacctgaatgtacatttcacgatgtgatgtataagtggccaatagacatgcaaaaatgctcagagtaactaggaaaatgcaaattaaaaaccacattggagtaccacagcacaaatacacttagcataatggctgaaattagactgatgattgcatgccatagtgaaggagtggagcgtgagaatttttcataaactgctagtggataaattgattggaacaaaaaaagaccagaaaaacaacaggacagcatctctgtgtataccaaacgatgcataacaagaagcttacaagtggcagtgttcatagtagccccaaactggaaataatccaggtgtcggtcagtagtagaatggataaattatcatttgtccatattgttgtaaagcaaggtaatggacaaactgcagtttataggc

SEQ ID NO: 28299 - DNA, 1050 bp, Homo sapiens
atgcatgctaaaaacatgttgttcagtaaatacctgctactgttattgttactttattattaagttattcggttgactctaccaatgacttatacttcctgtcaacttttattatagcagtaatgaagcattgcactgattcagattttgtgaaacctcacatttaggctgcactccaccagcccaagaaaggggcttactgaataaactacctacatgaaaacaatgctgggaacttaaattaaaaaagaaaagacatttaagggaaacctttcatcaccctaaatgcttacagcattcattcacagaaaaactgacgtttattacccatattaatttatgcattaagtccttaaggaatagtataaaaatattctgtgaacttagcattagctactgtttagaaaagtaagactgtctatttgaaaaattaaatcagatcatcttcttaattctgatgatttttgtcagacaaatagtataatcaccaagggttccccccccccccaaccttatttggaattaagaagcacaggactttgagaagagatagtgttatttcagtaaatgggtgaatttgccctctgggtaacaactttttagagtttgagtatacatgcagaagaaaccagtgttaatgttggttcatgataaagcgcacgtagtaaagttcatgatttacagcacgtaaaatgctgtaacaattctgtcttttcggaccacatggatggtgatttttcctgttctgtccactggtacaaacctcccctcttctcttttttggtgtgggttaggttaacaattataccatgactccacacatttttgcgaggtcttagtatgatgtgtttactgtcactctgcccctccgattgacccgagtgtccttggagagatgttgtgtcagggtcttctggctcatttcccagcacaaatgtccagaagagttgggcaggaacacaaagatgggccagggggaatggctgtgaccaccttgatggaaataattggttttgaggatctgttgattgcaagaacccccattgggaa

SEQ ID NO: 28300 - DNA, 1044 bp, Homo sapiens
taggtttttatgtatgaaaatctaattgaaagttagaaagttatctgaagccttctgctgataaacttttaaatatttcatacatattcttagggttcaggtatctctcattaaaagaatagttcgatgagttgttttatagtgttatttagtaagaaagataaaaaaacctaagcatttgtcaagagtcataatttatttctgaaggaggaaaatagttaatttaattttattaagaaaattatctattttgtggatatttagaaatattgtacaaatgcaaaaagaaattcaatttaaaagattgatttaaagttactgtgtaataagtggatatatattgaatagaaatagatggcatctcttctacttaggaaggtcagaaaaataattataaaaacatataattgagaattaggtaaatgttataattaaggtgaattataaattattgtgaaatttttgcaattaatgaaatagagaattattcatcttctcttttaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacataggtaaacaaacaggcaaacagcgcagtgtgccccaacccacaccaaaactttgagttaatggttcttttctatcaaaatattttgattttattttaaagtggctgattaaaaatttgtttatttctgttggacagcaagatttatataagtgacttgatctggtagtaatagtctaaatcttggggaatgtgccttccatgtagcataccatgtagaaacaaatgagaatagtgtgtgtgtgttttttatttgcaacttactggtaccatttgtttgctaataatgatgcatgtttatccatagggtcatctttccagtaactttaaccatttctaatctagctcagaaactagttgtgagctagtatgttcttagtggttgtggaaccattt

SEQ ID NO: 28301 - DNA, 1025 bp, Homo sapiens
ttcttttataaatgaagataaaattgctgaaatattctcactgctgtttgtccatttggtccttatgttttcagatctgacttttagagaaacaaggcattttggtagcactgcttaccttatatcacttaccgacatatgctgtacctgtttaattcagcagaagagcaacttagatattcttaactgattgaaaactgctgttattacaaaatgctgatctccaaactttaactgaactctgcgtttgatgtaataatgttatagaacatttgagagtgcatgtgtttgttactctcagtttattggtatatataatttaaaatgaaactgttttctctttcagtgcatttgaaacgccactttatgtttcgaaaccatctctgtttagtttttgaaatgctgtcctacaacctctatgacttgctgagaaacaccaatttccgaggggtctctttgaacctaacacgaaagtttgcgcaacagatgtgcactgcactgcttttccttgcgactccagaacttagtatcattcactgtgatctaaaacctgaaaatatccttctttgtaaccccaaacgcagtgcaatcaagatagttgactttggcagttcttgtcagttggggcagagggtaagtattatttcagaacttgtgaattaaatagaaattaaatagaagtaggtaggacagtgtaggtattaggttggcgcaaaagtaattgcggttttcgccattgcagttgctgtttttgcagtggcaaaaaccgcaattacttttgcgccaacctaatagatatttgaaatgttaataaggtgtataccatttagaggcaattacaggatgcttatttatctttaaaatgtagcacttaattaccttgtgttgatatctattttggggaaataccttttaaaatgcaaatagcaatactttgagtcaaaagacattgatttttttgaaatgggtatatttaaaattgtatgtatgctaaaagattaagggagagaataggagatggaatg

SEQ ID NO: 28302 - DNA, 1048 bp, Homo sapiens
accagttctccaaagttgttttattttatattcccatgatgtatgagggttccagttgcgtgacatcctcaccattttgtatggtttgtctgttgggttttagccattctgtagtggatatgtagtggtttgcatttgcatttcttcatggctaataccaccttttcatatgcttattagcctttcatacatattctttgtcacaggtctttcccatcttttgcttgtgttactgggttgtttaataattgagtagtcctttgtcattaagttttttgtcacatgtatgtcagtgtatttccctagactgtggctttgccttttcctttcttaatatggtatcttttgatgaatagggagttttaatattgatgaagttgtatttgtcaactttttttgtttggtactttttttatcctgaaaaatctttgccatctccaagtttgtgaagatattctgtgttttcttctaaaagttttttatttttattttttagtctgcttttacagttaggattctgtggtccatcttgaattaatttttgagcgtggaacagggtgaaggggttgaagttcattttcttccatatgcttacctagtagttacagcagcatttgctgaaagcaattactttaccctgttgatatgttttctattctaggtcctttcttttcacatatggatttttagaatcagcttgtaaatttctaccaaaaaaatggtgctagcattttgatttgggttgcagttgggattgcattcaggaaaatggacatcttaacaatattaagtcttccactctgtaaagatgggttatctctccatttatttagggcttaaaatctctcagcagtgttttatagtttttaatgcagaagtcttacatattttgttcactttattccttagtttttaattttttagatgctattttaaatggcatttaaaatgtataatttcataatttttcatttttggtatacagaaatacaactgatttttgtatattgattttgtatcctaagaccttgctaaattcacctattct

SEQ ID NO: 28303 - DNA, 1053 bp, Homo sapiens
cagcatttcctcatcctcaggcctctcccatcttaagcagcacctttgcgtgtccccctttctttccctatacttctgctacctgtggtctttgtctctttaccctgaagacctctttgcttgttccacttaggtcctgccctccaactctcctgccggtgtcagcggtgacctttattcatgggtccagtggacaccctaatgctgtctttctgcattctacaacttcatttggcagtgttgacttttccccactctttgaaacactcactgctggtttccttggcaggatgttcttctttccctccccccaccccttttctttgccctttccttcactgtctgtttcgttttttttcttctacccagcactgaaacctgggtgttcctcgaggcatgacctgtgtcccttccctactccgcttaatgtttcctggatgatttcagccacacctgccagggcctgcagtcaccatcctcatgctagttgctcctaagtcttgacttctgacttagacttcacttctgaacccctggggcctttctaattgtttactataaatgtcaccttgaaagtctcaacaatatgtgcacacacagcacataaactgaagtcatcattttcacttccttcccaacgcttctacttttgccattctttgtaaaaatggccctaaatttacccatttgctcaagttgtaaatttgggggcactcctctctccctctttccccacactgaatcagacagtaaattatctggattcaccacatcttaatacgtttttattctccacctttcactttacctcattgttatgacttgtcttattagaatggagtgtctcattccattcacctgtcagcaccattctcttccctgcagccaagtgagctttcactaaagtggtctgttcttgctattttccctactttttttctcccctgctgagacggagtcttgctctgtcgcccaggctggggtggaatggaacaatctctgctcattgcaacttccgcctccctggttcaagcgagtctcctgcctcagcct

SEQ ID NO: 28304 - DNA, 1045 bp, Homo sapiens
ttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttctttt

SEQ ID NO: 28305 - DNA, 1044 bp, Homo sapiens
tgagcctttgttatttcgccacatccagtaagttctatcagttgaatgttgtctgaattacttaaaaagttctcagttgtaaacaggtaagagcacccagtggaggccatggagctaggcttagagctttgccaccagccttcagttccatagccatgaacctgggagggcaaggaatcaccctagaggtgaaggccattcatcggtgctaacccaaggtctctgaaaatgagttttagttactctattatctaagtatctttcttactgatatgtaacttacctggctgaacaattacattttagagctccaaataaattttcagcctattatgtcattgtccaattacaagcctcattgtaatagccatgttaaaaacaataaagccggtgaaattgatttcagtgtatttcaaattaacctaatatattcgaaatattatgtatgtataaaaattattgagcttttttcttttttccactaagtctttgagagctagtgtgtatgtgtggatttgtactagccactggttgagagctctgtagccacacatggcaagtgggtaccatattgcttagcccaggcctagtagaagattaagactcagtcagaggaagtaaggcagatccgtgcttggaatcagttcctcttgaagaagtgcacagccaagcaacacacaaagcagaaatattttgagctctgtattcaaagcaggaagatctgggaccatgtaagggggtttggtcttcagttctccctttgatcccttccctgggtgtgtgctttcttacagcctggagagtggaagggaagagagggggcttcctggactcctttcctgtctctagaaatgacccctgcagctgtcctgaagctctcaggttaagctgattgtgtccagagcagacaggaggcggcccactgccccactgtacccacccaagcactcacctaagctggccatggaaatgtgaatgaaaagcctgacccaggccctcttgccctgctaacccagcaaggaggctctgaccagccagccagca

SEQ ID NO: 28306 - DNA, 1027 bp, Homo sapiens
tatagttctgagatatatattttctcaattatagtcagaaaagttttttgttaatagttacactgttttaaggaatcatgccaaggtttgagatcaaaattgttcttttccaaaaactaagatgtctctcctaaatctccacctgatatcaccaacttgaagtcctaatgtccccatggggggtttccttccagactccgccaactgtgaattgcctttgttaaccccgtgcagcaaggctgtgatgagtcaagccttaaaagctaccttcagtggcttcaaaaaggaacagcggcgcctgggcattccaaagagtaagtactgctttcctgagcctgcactgggtgagaagaaccaacttcagtgcagttgtttgatcttgacttgtttattaagcttttgcttggggtattctgcaaagagtagcatggatgtcgttaacctgagccagtttctgtttcaccccaatcaacccaagacttgatccagaactcattaaatatgtagtagaaggacgcattactggtgtcttgaaatgtgcctgggtcgtgtcagaatggtgacgtgtcatcatggtatcttgctcattcgtgggttctggtgtatgtcggtacttggtgcataaattagggatgacagtggtctcactacctttccactgtttttacctcatgtgttccattttttcttctctcctggtagacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaaggtaccagctgaacgtcttacttctccttgtccaggatgagctgtggccgggaagactgattgggaaagtcacgtgggtgttcttcaaccttagggttgccacttgaaatgacatagagtacctt

SEQ ID NO: 28307 - DNA, 1033 bp, Homo sapiens
ggagtgtatgtgggagtttaaggactttgtcatggtggggctagtttgtaggtgtttctcagcaggatgaatctcccagtgttctccagcaacagcctttgctctttatcagtcctgggaacgttcacggccgcagtttgcattcagtcctgcagggacgcacacaactggctgggtcacagagtggtcagggcatagacagaaagtagcgggggactggggaaccctcctgtgacccgtgttggaaggtgctgatccccgttgtccgccctgccagatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatggtactgtgtcccttgcagcctggaggcttcatgagagcggatgaatagagaagtctgtatgtgaagattagtagaatacatactttgcttcttggatgttctgaatattgatggaaacttaagttatctggaggaaactcagtaataagtattactttcctcttatttgctggtgaacctttgctttctaagcacagaaatatctaagatcctctcagattttcctcagagccaactctttaaaattttaagctaactcttaaaaattgtaggttttcatttttaaattcatcacttttctgagagaagcccagaaaaaaagtctcacagtggattcccagaggcttttgttccactctctagaaaaatgcccagcagtgtcctcttctgagtgtcacctcccgggtccagtgtcctgtgatgaagagcgctttctcagggcagcccgtgtgctgagggaccccggtcacagtgtgtgcacagtcagagagctgtctctgtggctaggaaaacagacagaggggcctgtccaggcccaggacaagctggactcccaccaggggttcgtgtactgtgcacactgggaaata

SEQ ID NO: 28308 - DNA, 1034 bp, Homo sapiens
ggtggtgcatttgttacaatcagtgaacctacactgacacgtcgctatcacccagagtccatagtttacattagggttcactcttggtgctttgtaaattctgtgggtttggacaaatgtataatgatatgcatacaccttatcacatcatgcagaatagtttcactgccttaaaaatcttctgtgctctgcccatttatccttctctctcttctggcccctggtaacaactgatttttttaatagtctccatagtttgccttttccagaatgtcatatggttgaaatcatactgtatgcagcctcttcagattggcttttttcacttagaaatgtgcatttaagtttccttcccatatttttgtagcttgttatctcatttcttgtcttttcagtgctgaataatattttcttgttttgaggtatcacagtttatccattcacctattgcttctaagtcttgacaattacgaataaagctgctataaacatctatgtgcagctgttgtgcggatctaacttttcagttcctttggaaagacaccaaggagtgtgattgctggatcatacggtaaaagtgtgtttagttttgtgcaaaactgccaaactgtcttccaaagtagctgcaccattttgcattcccaccagcagtgagtaaaagttcccgttgctccactttcccaccagcatttggtgttgtcagtgttctggattttgacctttctaataagtgtgtagtattattaactatttatttattatttgttggattttttaaacttttattttattcaggggtacatgtgcaggtttgttatagaggtgaattgcttgttgtaaggagttgctgtaaagattattttggctgggcgtggtggctcacgcctgtaatcccagcatgttgggaggctgaggcgggtggatcacgaggtcaggggttcgagaccagcctgaccaacatggtgaaaccccatctctactaaaaatacaaaaaaaaaaaaaaatagctgggcgtggtggcgggcgcctgtaat

SEQ ID NO: 28309 - DNA, 1061 bp, Homo sapiens
tcttttttgggggccacaactcaacccataccagcttgcttgatggatattcatagctgatgtcaaagtaaatttaattctcatcctcagaagcaagaaagattccacgactaaggccaacaataacatccagggagttcgtttcttgagcaacgaccagctctttgcatagcacgaattgccaaaaaaggccagcgtagtcatttctcggccatgcacacctgtgatgtggcaagccatgttgacgtgccaaaaatgagaattctccagtaaaaataaaatagagtaaattagataataatgttccgaaggcaatttatacttttctgtgctttgggattcattttcaaaacatgtttcatttgtctttgaaaatcgaagttcacgttcaaggcccctttgagtttgctttttgtccaactattcgggcatgcaatagtcactaatgggaactcctggcttagagccaagaaaccaacaaaaggccccaaaatgaatgctttaaaagactgtgcatgttttaaaggcctctcgcctatcagcaagcaccactgtttctccatggacaaaccagagtgtcctgacaaggtctcctgtcccctggcagacagctgacacccgaggcccatcaggctgggagcttgcttgtctggaatgtctttgaatgcatgggctatcctttcccactcccccatagcctcccctatcagccaaagtaatttgaagatgtggtggtgttataagataatctaggataatctcccaattcttgcacacttctctgttgagaggtcggtttatcgcttcttgcacacttctctgttgagaggtcggtttatcgcagtttgtttttaggtctattaagaggtctaagtcccctctccctgaatctgaaccctgtgagtgcgtggctgatagagcaccttgggtgtggctgtggtataagtcctgaggatgcatgtccttccatattcccttctctttgagtgtgggagagtctgggaatgctgcgctattactcttgtgatttagagcaaaagggatatgatttgagtgggcct

SEQ ID NO: 28310 - DNA, 2046 bp, Homo sapiens
cttaagcctcatgttccaagccagtgtcaacaggattcttcctggggccactgggttttagcacagccaatggcacattggttaccgtggttccttagccctgtaattgcatcagaggcctgcccagaagactgattggaggccagcagtctcgctcctgtggccaggcagcatcttcttgtgtccctcgagagttttgaaggtattttcacattatcttcccgatgctgttgataagtctgatgcaattgtaattcctgattcactgtatatgaactgttttctttccctccagaaacatgtgaagtattcttgacctggtatttggaaatttcttgttgatgtgtcttagtctggatctttaaaaaaaaaaaaaatgctgggcacttggtgaatcttttcagtctagaaactcataacgttcatgtctgagaaattgtctagtaattgcctgttctctcttcttggacctcccattattcagaagttgcaccttctagtctggtctctctgcttcccttgtctgtctttttggttcttctctccattttcatttctgccacccacattttagttttcaggatcactttctttttctctgaatgcttctgtttttgtttgtttttcaccttattcctgtttcaaagttgcacatcttcttatatttctctgagaaaattatgattttgcttaacacttgatttctgcttcctgctttttatctgtctcctccaagttccttgtttcagtgtgtttgtcatggtctttgtgtctcatgctagaggctttcctcactatctcatgattattggctgtctgttcatatttaaaagagaagcattcaaatttgattggaagttaaggactgtatggagacaaggtatagaaaatattttcattgttttattagtcagggttctgtaggggaacagaataggagatagatatagataatagagatagagacatagacatatagataaaggggagtttattaagtattaacttacacaatcacaagatcccacagtaggctgtctgcaagtttgaggggcaaggagagccagtctgagtctcaaaactgaagaatttggagtccagtgttcaagggcaggaagcgtccagtacgggagaaagatgtaggctgggaagctaggccagtctctccttttcacatttttcttctgctttatattcactggcagctgattagatggtgccctccagattaagggtgggtctgccttccccagcccactgcctcaaacgttaatctcttttgacaacaccctcacagacacacccaggatcaatactttgtatccttcaatccaatcaagttgacactcagtatgaaccatcacaagtccacccctcgtcaacttgaacccatacacatctgagatcatacataatcttcaaataaagacaataataaggtcataattatgcctaacatattacaactattctttgtacaacctgaaacacaccagtctccaacccaaatactattacataaagttaacaatacttaaatgctgatttgaagtcagtaaatcttatgtcacatgctaaaggaaaaaggaaataaaatcaagatattttcttagtacaagtataaacatgcacaaacatgtttttaacaaaacaaggaaaaaatactcatgacaattacagtcctcgtttctgcagctggtcacgtggttgtagccggtattgatgactgccttcttctactacccattctgtattccctttgccttcagcaaacaccttggcaggttgtgatttttttttcctggtggagtgacccaaaccttcattcctgaagggtctgggccatttctagtcctgcctggattgggctgttgtagtttcccattgatcttaatcacagggcatggtaatactaagagatgccctaatggatctcctgtattccatgagtactcttccttacctccattgtggagtagtagactgatttcatcttgatagtctgggtcaatcaccccggccaactgtaactcccatcttagcctg

SEQ ID NO: 28311 - DNA, 1013 bp, Homo sapiens
tgtgtcaggaagctgcagatgggagatgtccaggcagtggctcagaagaacccatggaggacccattaggggaagggttggtatgtggacaccagccacgcccagggtgaaccagctgtgcagtcaaatacagaacttcccgtcccttacacctccattctctgtgtttcaattttagtgaagtcagccacacccagagtgaaccaaccgtgcagtcaaatacaaaacttcctgcccctcacacctccattctccctgtttcaatcctggtgaggtcagaggcacagtcatgagcaaggtggggaaacagcagtaaatccaaccacaacacctctcctccccgactatagaccgccaagcctaaagcaggcccgtcacgttggatgccagatagaaactttgatatgagataggactggactcaaaatgcctaaaatcaaatgtatgaccacaaagcttttcgaaaaatgtagactttgtccaagatagcattcaagggttgagaagtataacttacatggcttgttagaaagcagttgtatggcaagagagggttctattaaaatgttattccatcatataatttctatggagaggaatttggaaatggctagcaaaattacatacatttatcctttgactcagaaatccacttctgggctgggcacagtggctcatgcctgtaatcccagtactttgggtggctgaggcaggcagatcacttgaggtcaggagtttgagaccagcctggccaacatggtgaaaccccgtctttactaaaaaaaataaaaataaaaataaaaattagccaggcatggtggtccatgcctgtagtcccagctgcttgggaggctgaggcatgagaattgcttgaacctgggaggcagaggtttcagtgagccgagattgcaccaatgcactccagcctgggtgacagaatgagactctatctcaaaacaaaaaacaaaaccaaaaaaaaaaaaagagagagagagagaaatccaattctggaa

SEQ ID NO: 28312 - DNA, 1049 bp, Homo sapiens
gctggtcccccactgtgtgccctgaaccagtgtactaagctgcctcttgtgtgttttataaatttcaaaatgtatgtgatgtacaaagggaggatatgcataaggggtagatatatacacacatagaagttaaatactcaaaaatatttatttttatttttatttttgagacagagtcttactctgtggcccaggctggagtgcagtggtgcaatctcggctcactgcagcctctgcctcctgggttcaagcaattctcgtgcctcagccccccaagtagctggaaatacaggcacgccccaccacacccagctgatgtttgtatttttagtagaggagggttttgtcatgttggccaggctggtcttgagctcttggcctcaagtgatctgcccacctcggcctctcaaagtgctgggattacaggtgtaaaccactgtgcccagcccccaaaatatatattttttgatgggctagtttatccccaaattttcaaagtcacttgtcactgagaattctgaagccttgcggggaatgatgggcctcgtctgattcaagagaaattgcctgtttctgagttgagtcgtagtgtatctgggtactcaggctagatcctagaatatcacagatgctcaggagcgatgcattcacctgtctgttcctgccagggctttccagctgccttctttaataagctcctctaccaaagcagttccagatagaattgaacaatctttttaaagcataaatatcagcttccaacaggggtctccatgcagtctctactctacgggtggcgtatttgactcctctttccagctggctggtgtgaacacacccactcgagtttcagcaccactgcccttttttttgttttgttttgttttttgtttttaattttagtatgagtactgctagcaaaaacagactgcttctggagcttcaaccgaataaccatcacccttctaggcaacttgggtgatgtgttggtggatctctgtacgctttttatttatttatttatttatttatttatttatttattatac

SEQ ID NO: 28313 - DNA, 1067 bp, Homo sapiens
cctatgagtgagaacatgcggtgtttggttttttgtccttgcgacagtttgctgagaatgatggtttccagttttatccatgtccctacaaaggacatgaacaatgagaacacatgggcacaggaaggggaacatcacacaccagggcctgttgtggggtggggggaggggggaggaatagcattaggagatataactaatgtcaaatgatgagttgatgggtgcagcacaccaacatggcacatgtatacatatgtaacaaacctgcacattgtgcacatgtaccctaaaacttcaagtataattaaaaaaaaaaacaaaaaaaaaacccaaaacctcttcttgggagctctggagtagaattctctttctggctggactctgataaatacagctggtgaccattatttcagaatgaaatttcgtttagtttatgagtctgtccaaatatttcgatcatttaaattcagatgttagtttacctcggtttgtggagaatggactgggctgtagaaacttagaagccaagcgaatgtggactccgctgtcttcattgctgtcttgttactatggatgtcggattaggtgcacccgtgaggtcttggattgtaaccccatgttctgcaggtctcaggacctcttccctgcactgtgctagcccggccccctgtgatggactgaattgtgtccctcaaatttatacgttgaagtccaaacctccagtacttcaaaatatgactatctttggagatggggccttaaaagaggtcatgaagttaaaatgtggccatgagggtgggccctgatccagtctgacaagtgtccttatataggacatgcagagagacaccagggatgtgcgcagagggaccgccatgtgaagaagcagcaagaggagcaagaggacggccatctgcaagccaagggggaagccacctgcccacaccttgatctgagacttccggcctccacaaccgtgagaagatacgtgtccgttgtttaagctgcccagtctgcggtgctttgttctggcagcctgcactgactcacaaacccacttctgacct

SEQ ID NO: 28314 - DNA, 1034 bp, Homo sapiens
ttcattgtaaagctaggtcacagcattccacattcaggtgagtactaggatttgtagattatcagtcattatcattaacatactcacatacaattgtcattgttgctaagaagtgtttgcaccttttcaacacttagaaattaagtcacattttctgctttcaaagcccttaaccttaatcaatattttataatgtgttttcatagatgagatacatttgagttaccccagttataagatggttactccttgcaattattctagatatgaagattcatttggctaaaatgtggtaaaattgcaaggccattcagcaggtcagttttaaatacaatatgattattattccgtcatctttgtgcgtgattgaaaataacagattgtgtggttggcaattcgcttccccattagaaaatttaccttcctacttctgttgtgtcttacatagtataattattctgttgccttgaaaaatattataataaacagaagggctaatttttttaagcgtgttgggtggccgaggagaaatgaaattttgagtggaaaacctcacatgaattgtctgtagttgcttgtacttcatccctcaccagtgcaaaagccaattccacaggaattgaaaactgttatgaaagagaagcctggtcttccgtcttaacatcgggtcatgaattcaatggggaacactgtatcttcttcatctctatgactcaggcacatagtagctgctcacttaatatttattagaaataaatatttactgaaaaaatgaatctcccccaaagaactgaaagcagggtcttgaagagatagtcacacacctgtgttcacagcagcatcattcacaatagcaaaaggtggaaacaacacaagtgtctgtggacagttgaatggataaacaaaattctggtctatacttatgttttagtttgggctgccctaacaaagtaccctagactgagtggcttataaataatgtcaatgtatttctcttagttctggagactggaaacccaaggtccaggtgccag

SEQ ID NO: 28315 - DNA, 1461 bp, Homo sapiens
ccagcccacatctgcggaagcttggttggagtgaggctgcttacggctgctcccctttcagtccatgtttggtttctgcatccaagaggcagagtgagaatcagaccctggtcgggggtgatccctgaaggcaacgcagtcatatgcagtctcttggcaagcagccagtgctctcagctgggacaccctgtcttcaggcatgctgctctgtggccccgcttacaatggtgacgttgcctgattctggccctggttctgcctatcactggccagacagccctaaaccaagctcataccgctagggccttaggaagggagaggaatgcaggcaaaagtcgtctcccatacacagccacctaaggaggaacagagccttaggatgttaagtggaacaaaccaagtcacgacccacatgtaagaatgtgaccaagagcgagaaaacccacagacacacctttctaagggtggtggcctacaggattagtttctctttctcttccaagtgactgctctccccacaccttggcctccaccagaggggaatgtgggcagtgcacgcaggaccgcacggtgtcttctgcaggggtgaaaacagtatttgaagcccctgtgactgcaggtgcctgcaccttctgggggtgggagagggcatgaaatcctatcagcaggaaagtccatccttgctgctctgctccactcgcccaagccgggctgggaagagaggagagaggacttcagaggtacccaggctattcccagggggaggcctgtgtggtccccgtttgttcggagatgataaggagtccattcgagggaggagctgccttctgaacatgggagtggctgacactacctctgagggtttcagtgcctctcccgtgtccagaattcttctgattctgatgcagggggcaggatggcaggggtacagggtaagggtatgagggctcaggggctgctgaggatgggggtgtttgttttgttttagttcctgccaccccaccctgccctctgctccccatctctgcctgggtcacccatcactgaaagatgtcagttgcacaccaaggtggctaccagagggagaaaaacagcccctaggggtagggaaggtgggagttccgtggaggcagcacctggatcaggagagctgggcagccaggggcagaacaaccacctgccagggtgggattaaaaagcaggcatcctcaccatagcctaggatacctttggattggagcattcccagctggaacgttgccctcttgcagccacgtacaggtggtgctgacactcaggccgctcccaaacgttctgtcgtgcggttatgtccaccctgggttgcagcccatgtgcaccctgggaggactgctgaacacaccgccaggccatggagattgtgcacaccactgccggtctgtgtccagactagcagcaataaggattctgattctgattaaa

SEQ ID NO: 28316 - DNA, 1039 bp, Homo sapiens
aggtcactggtgagcttggccggccatggagagctgaggcagaagctccatctctgcaggtggaggagagaaagagagaaaggaattgagacgggaggtggcccactgctggatgcttgaccgcaaagggggaaggaacagtagctggagggagtgtgttttgggttttgccatttttaggaaggcgagaagaaattagccactgagttcctgcagttccacctccttaggtctctggcagcttggatcacagatggttttcaagggcaggtcctggtggacaggccattctccctactagatgctgcactctgcaggggccaggacacaggcaccatcatctttgctgctctcaccccatgccccaggttcagcacagcaaagacccacatctgccctgcaaaggccctcgaggccgctgatgttggcggcagggttggagtagttaaaagccagtgattttcaaggtagaagactccatccagcttctgctggaaaaccggtttttgttagttgtgattgtgttctggaaaaatggaatgtgacttctatgggaggctccctagtatcaggaaggaagcagggaacaggggcggggacgtcgggacctccatgggctgtttcacatctccaaggcgtttctgttttcctcagatgtaaagtggggatctgtctatcgtatgagcttttgagtcattttaagttatgctttgcttggaagttaagaacattccctgaatttgagaatatatattttcaatgaccttttatgtagctggagggacatggcccagggctaggctggtgtgtgtgtgtgtgaatacatgcatacatgcacgtgaggttgaacccaaagaggcaggaaataattttggaaattcctagaataaaggaaggggcagattaaattgctagcatgtggcatgaggtgaggaacctggaaggagcccacagccggggtgtttgagttttccgttgtttgagagcgcgtcgtgtgaaatttatagagcaggtggcattactatttttatctctgtgg

SEQ ID NO: 28317 - DNA, 1628 bp, Homo sapiens
gcgcggtggctcacgcctgtaatcccagcactttgggaggccgcagagggtggatcacgaggtcaggagatcgagaccatcctggctaacacggtgaaaccccgtctctactaaaaaaatacaaaaaaattagctgggcgtggtggcgggagcctgtagtcccagctactcgggaggctgaggcaggagaatggcgtgagcccaggaggaggagcttgcagtgagctgagatagagccactgcactccagcctgggtgactgagcgagactctgtctcaaaaaaaaaaaaaaaaaaaaaaaagtgtcagtgtctactgtgtgcctggccctgttacaggcatgcacggcagacagagcagcaaacagcaaaaatccctgtcagagggaggcttcacgctggtggggcggaggcagcaggagctgtcgggaccccgtgaatggcatgattgcgcacggggcccaggcagtggctgagttggttacaagaatgcgctcggagtctgactctgggttccagcctcagctctgccacttacccttgtagagttgagcaagtcagactctctgcacctcagtgtttgcatctgtgacgtggagtgaggactgtgctgccctcagagctctgttatgaggttgaaataagctaatggatataggaagcacgtacagcagtgcccagcccactgcaggcggtgttcagtgtctgctgtcactgttatgtgaaaggtgtggtgttatgggagggaaagggatgcacaggccggcaggagactgggaacagcagttctcccaaagggccagccagggtcagcttcgtggagaaggtggcgttgaaggaagcctggaagggagcgatgggccgtgccacatggacctggacctgggtatcctggggaagagcccccaccccagcaaggtggccaggggaaaggccctgcccctgggggatgtctggggctttcacggagtggcctggtggtcagcgtggctgggaggagtgatgtcagggcatggcgagtgactcagcaggccatgtgaggacttcgccagttactctgggtgacgtgagagccatgggaggtggagggctgactccctctgacttaactgtaataggactgtggtggctgctggttggaagtaggcctaggaaggaagcagggacaccagtgaggacgaggaggggatgacagtggtgtggacccccacagactccttggaggaggtgaggggtgggccggtgtgggccagaacctgaaggtggagccctcgggacctcctggtggctggatgtgggccatgaggggaaggaagccctagggatcacctccggcatggcctggcctgacctgatggagctgctgtcgaccgagatggtcaagtccaccaggagagcaggggtgggggcagctggagctcaattcgggacacgccaggcgtgagatgatgtcccatctcaagatgtttcctggacctgctgtaactaagtacacaaactgagagctgaaaacaacaggaatgggccaggtgcagtggctcatgcctgtaatcccagcactttaggaggccaagacgagaggatcacttgagcccgggagttcaagaccagcctgggcaacatagtgag

SEQ ID NO: 28318 - DNA, 1028 bp, Homo sapiens
agcctgggtgacagagcaagactccgtctcaaaaataaataaataaaaataaaataaaataaaatgaatacaatatgcttttcttttctttctccaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaaggtaaggctaatccatggatttaaggaaatcaaataacaggatgagattctgaaaatcagtcattaaagggctgacacatgagtcttgggctgttcttggagacagtgagaaccacgtggtggaaacagaccagcattcacacaattatatttccaagcattttttaaattgaaggtaaacagcatgattcttggaaccttcctgtaagacaggcaatagcattaactttttgttttattttcgttttatagtttaaaatgttaacagaatttgaatcatgtagattgtggtgtgtgtttaggagtttttactaaggtgggattaaaagaaaacacatttattaaattcatacgtttgcgtgaagatggagcctgcagacggccctggaatgcaggcagggggtggtgccctccgccaggctgggacgtggcctgttttcctggctctgcaggggacacctccgaggagacacccagcatgggaatatgggcagcctgaaggcatgccctggggagagccagcccttcccagtggtggtgagccccagaggaattgtggaaccctgctcttgccatcaccagagcctccccacatggggaaagacagaattggatgttcaccaaatatttgtacttggggcctacccaaaggaaatatgtctgtatgcaggaggagggaggcaggcaggggaatttccacctggaggcattgcca

SEQ ID NO: 28319 - DNA, 1024 bp, Homo sapiens
acagctgcggctgacaggcaaacaaagatgtctgcggccatggcagctcctagagaaactcttctctccttactctcaaatgcctaagattaggatccaccacctgccacggtaacctacttccacggcttctcacaccccctcacaaggcagtcatgatgatagatgtgactgcgtcgaatggcttccagaaatatgatcttatttgtacaacagagccgtgcccaaaggaagaatgccaaccagtgggaagctctgctggggctttctgaattcctagacccaatcacaagctggtgtactgttgaaccatgaaaaaattgagtataaacaccaggaatgtctgtggcgcgtggcgtctacactgggtgacccatgtctacactgtgagtcctaagcgggtgcccctctctgtcgccctcccgcagccatcaagttctctggagaccttcttcgactccctggtgacacaagcaaacatccccaacgttttctccatgcagatgtgtggagccggcttgcccgttgctggatctgggaccaacggaggtagtcttgtgggtatcttttagtcttaaaggggcgaaaaatcacagatggatgggctgtttttttctgttttattaaacacctgagcagaaatattaggcatgtaggtgtgcgtaggtactgtaaaactttcatcctccttgtagtagatctttttagaaatggctaaaattaggcaatcctttatgtcatcctgccatctggaaggatgattctcatcgcttctccgaattccattaaaacttttctttaccgcccttggaagggcactgctttctgtgggtgggggagggacaagtgaggagcggtggggggcgtggtgagtggacctgactgtgggtagggggccaaaggagagttcataaatttggcagggaaacaggggcccttgtagatcctttctctctctctctctctcaacacacacaggcacacacgcaccacagcacaagtgtttgctgctgaaacagaatca

SEQ ID NO: 28320 - DNA, 1091 bp, Homo sapiens
aggttgactccactggggaaaattccccatgacgtaggcaggtccagctgagctttctgcggtaaattctccttctctttctcctcttttttcatctccactgaggaagcacaacccacacagctgtcatgaccaggtgctgacctgcactctcacctgtgtagtaccgcagtgtcgctggcattccatgaagcacagggtgcttccatatgtgccctgctgcagttcccctccacacctaggctcggtacccacacaccttaaaacatgccgtcgttccagtttgcagggactggacccccaaaggcacgctgagccgtgaccccactcagtgcttcctgagctgtctaagccactgggacctcagtggactttaactgtggtttaataaaccaaggggttctgtctgtgtccaatgtgagaggtggaccgctcatttcacagctgtggattttccctttctgtctccccagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtac

SEQ ID NO: 28321 - DNA, 1023 bp, Homo sapiens
tatcccctctctcctgcttgtgtgccaagttcagtgttccctttgcatttttttggggtgggttggctatattacagaattccaccaaaagtgctaagtgtcccctcctgcagaagtatcgtttgtattcacagtaggctacgtgtggatgtttcagccatctgctctgctccctgggtccccgggtcaccaccatactgagaaatataggactctgccaaagagacgtggaggccacgtcggcttgtcatggtgtcctggaagactctccagcagccagaagaaccttctgtgctgttttcactagagaagatttgagttgcagcctcttggaaagaacatgacggcacggaacgggaggagggggctcttgtatcagggcccgttgtcacatccgctctcagcttgttgaaaactcataatctcagaatgcatttcacacggagagatgtctggaagtccaattctcatcccattggctttttccgtggttgctgttttgtgggccgctttgcacaggagtgaagccaacacccctagattgtgccttcacccttgctgtgaaaaattcaaagccctgaaataagaggagggaatcgcagacatgccctgattagttttcctgcttatttcttcatacaggcatcttctgttccgttgtattgtgttaggtttcagaggcggggagcttcctcctgcagcagatgaacaggcatagttcttaaaatacaggaaagtaacaagtgaggtttccaggtagagtaggtgaatgaagtttgccgtcatgctctgtatttcatatcagatttctttatcttttcatatcgcatgtcattggatgtgacattttgatgaaaatactgaaactacaaaagcataacttcgcaacaagaatgagatagacaattgaatgtgggacatttttctggcatgtcttgctgctgagaatcggacttccagtcaaaaccctgttagtgacacccacctcctccagttatgcaaattgatgcttagcttggcaag

SEQ ID NO: 28322 - DNA, 1095 bp, Homo sapiens
gcattccgaacatccgacagcttctttctccagaatgtcttctgtcagagacttccaggaaaggagctccctcctgtctcactgctgtcagcgtgggagccctgctccccaggctccacgtccccggaaggtccatcttgtcctggagcacacccagccccattcagggtcagtgcaggagggaacagggaatctgcatttcagtaagctccccaggtgaggctgcagagcagaaaccacggctttcagacgtgagcaggctccctgggctcttggtgtcaccctgttagccacatctgcggaatgtggaaggcagaacatagccacgctgcttagtgctgccagcgaacctcaggttgcatcagtggctggaatctatcacagctgttggggatacgtaactcccagcaataaatccagtattttcttccctgccctgagcttcctctgggtttcttatcagcagctattacacacagatgtccagtgcttctaaactaaattgtactgtgtaacttttacatcacacttgtgtgcttaaaaagcacaccgtgggtagtgactgggccaagagacatcacaaagcttcctgataaatttgaatccagccacggcaagagcgacgtgcgggtacctggtccctgatgcttgggtgccccgttgagcctcgggtacttcttggacactattgtgagagcagccatcctggtgtctctgccagcatcttggggaacgctgtgatggtaaaatatctgtctctcctctgggaatcagggcagccctgagaagtgagcagttccctttacagatggataattgtttgtgtaagaccaaccagataaagtccaaactgtgtagaacacacgtgtgcctcacacatagccatctgagtaaaatattttttccaatgtagatttataattagaaatgacagatttataatatagacttcagtaagttgggcacagctgtcactttcgtggtatcaataaaaggctagaaaccttgggtgtccttggcaacctagcctttgacattgatgtttttccataggattttcttcatttgggttggaataaaaatgcatttttattc

SEQ ID NO: 28323 - DNA, 1027 bp, Homo sapiens
aaggatcatcccagccatcatgtggtttgggggaaagctgggaccccacttggtacaatttaggaaggtacagaagaatgtgcattccatcatgtgggttctgcttctcccctgaagcctctgtcaagagctgctttgggtcttggtatggagaaatgccttcatttggccagacccatctggcagaggcagtcacgatgccattggacccccaggcaagcagcccctcctagagagcgagggtcttggaaggcctggtatgacccccatgccactctgtttcctagggaaccctaaagggaaaccgcacgtgagggactccactgagataaccctgacgtcaccgtgccactgtgccccttgtctgcagggtaacttggctttgaaggagcatcaggggaccctctgtaggactgggggtgagatcgatggacctgccagctgttattgttgggattatagggaagtgaggaggtcgtgtgtgcctccttggggtctgagtgcctccttggggtgcctaagggagactgaacatcattttggtgatatttattgatgtaactactccctttgcacgatatttattgatgtgactattccccatcacttgtgggatgctgagctgtgcatagcacagttcaaaatatctgatctaagcaggcaggaaggagacagctgctggtgctgcttagagttaggcgcagggatgaaacccatgagatgaggaggctggtggaggaaagggactgggggcagtggagggatggagaaatggacagaagtatggatggggaatgctgaatgtgagggagaccccagaaccggatgacacaagaaaacaatccttggctgtggccgggtgaccatgttaaggccattaaagtcatgcttggagaaaccacatagatgcttgcagctttgcctgtcatccagtggacttcagagcacagcatccgttcgaaatccagcggcagattttcatagtctgacaaattaaatcagctgttctcctggcgccagagtgggc

SEQ ID NO: 28324 - DNA, 1032 bp, Homo sapiens
attttttaatgttccaatattatagtgacataagtaatattgataatggctgtagaactgaatgaataatacacagcataagaacgtttcagaacacagtgatatgtattcctaacataacttctgttatttcatatcatcctctcccactgttttgtgtttcaggtacagagccttcatttttattttgacatttctgctgtatgcaagttttcacttatctcgaaagcctatcagcatagttaaggtaagaatcatggaaagcactgcctgtcgtctctgtgaggagttcgtcacttgaaaagcttgtggggcagaggatggggatggtagcaggtacatggggaaacagattatgtagaaacaagttattctgctgctttggcttttcggtttccctttgctaaaattaaagtcttttaaatgttttttggatttatactttcagaggtagtagacttttagttttattagttgacatttccagaatttgaaagcttagctaaatatttattttatcttgtgtgactgttccttccaaatgtatccagtcttaagtggttccccaaattccagctcttcgtgcgatccaaccctaggtctggctgcggaggtggctctccattgttcttggaacgctgcatttttgtctgagtgatgggtgggcaggaagttgttaagcaggtgttctactagactttgagaaaagaagattaaagcagacaagcctacataatcaccagttataacctggagaaaagcaggaataattttcttaccctcattgggattacgtcacccggcctgtagaccatcaggggcctgagaggcattagagtctctatcgtagaagaacgaggaaatcatccactgccagagacagtgcattcacagcccagtggcccctcgctcactctccgggagttggcagggacccagctccaggactgcaattctgtgacctttggagctgtgcttcctccactcctgccggtggctgagccctgggtggctgccctctgcagccctggt

SEQ ID NO: 28325 - DNA, 1046 bp, Homo sapiens
aggagtgtgctcggcagctgcatgtccctctatgatgtcaccctgtgttgtatgggaatggacttggctgtggggagcctgcagccctgtagctcagtttgggttgcaaggcagtaaccagtttcatccaaggtgataaagagaccaaggtgcttggtagtcagagggggctgcagaggtggagcgagaagcagtagggctggtttcccgcagcacctagaggcctggggtctgactctgggttcccgcattgctcggggcaggttgctggtgtctgtaaaggacacgctgaagcctcacttctggttctgttccttttcaagtttcctcccttccttgcatttacacaaagatgtttgttccatatcaagatagatgttttatctccactcatttttatttctaatgaatttcataacatgaaatacctcattacagacattcttccagcctcgctcccctgatgtgcttttcctggttttgcttttcttctggggcttgtcctctgaatgagagtcgtgggcttgtccacacagcgtccgcatgctctgcttgtgattattggccacgctgggaagtattttccatatttaaagtagcgttcacgttcacagtgttggcactggctggcggtgatctgccataccccccttgcacacaagtgggctgccaggccgagtgactggggacaggccggggcgtgtgcgggagtcactggtgggacagccaagctgtgcccttgccctcacctggcatgctatggcgatggcttttttctgaaacgaatgccaatttagtaaaggtataagatggcatcttgtgttttattaaattttattgtgtatatttaaggtatgcaacatggtgttacagatacatagagatagtaaaaaggttactagtaaagcgaagcaagttaacatagccatcgcaactcacagctgcccgcttttgtttttgtggcaagagcagctcaaatccactcatttaatgtgaatcctgcatacagtccagtttcacacccggtgctcccgtgttgccctgtc

SEQ ID NO: 28326 - DNA, 1621 bp, Homo sapiens
tctggctctgactcttggcttccagactccccggaaggtgcagtgctaattggctccccagagactccagtaagcatcttgtcagcctcagcaccagctccagcctggggggtctcgctcagaagcaaagtcactgagtgacctgtcctcctgacacccacaagactaaaatgatctctcagaggggacctcacagaaaccagcaccttgtccatgccagctgggtatctgagagaaactgctttgttttcctgaagtcatttgaaacagcgtgcagagacatttaaactcggcgggaaataggagaagcccaccttgacccttctaattctctggccccaggtgccttattaacaagagacagtatcagacacaccagacaaaagccctcctgagcccaaagagcccaaatgtctggaagctctctgctgagatgccaaaatgcatgcctttctgataaagagacagagacagatgaggtaccatgatatggacatggcagtggacgtggacaggggagcagtggagatggagaagatggagacacacgcagttgaggatacaggcgaagaagatggagacacacgcggatgaggatacaggcgaagaagatggagacacacgcggatgaggatacaggtgaagaagatggagacacacgcggatgaggatacaggtgaagaaggtggagacagacgcggatgaggatacagatggagaagatggaggtagacgcgggtgaggatacaggtggagaagatggaggtagacgcgggtgaggatacaggtggagaagatggaggtagacgcggatgaggatacaggtggagaagatggaggtagacgcggatgaggacacaggtggagaagatggaggtagacgcggatgaggatacaggtggagaagatggggttagacgcggatgaggacacaggtggagaagaggaagttagacgcggatgaggatatagatagatgcatagggtgtggatctaaccgggtacaggtgatgcggaaacggatctagacagcgatgtggaaatggatctagacagcgatgtggatgtgatctagataatgtggctctggacgtagaaagagcttcagatgctctatctatgatcgtgggtgtggatataggcatagacatggtgaagaggagagaatagactctcctctctcatgacaaactgatcgtggctgggggcggcacgtgctgagatgtggctgtatttgtcccccaggctggtgcctgcgcctcctgcacccccgtctcctttgtgccttcttccattccctctgccactgttaggtccaggcctcactgagctctgacctccctgcctccagcctgcctctcccacacggctgccaggttcaacctggtaagacaccttcttctccatggtggcctcccaatctgggccctgccaacttatgcctcaccaacttctccaacttacccctgtacccacgcccgcaccatgcccagcccacaggatcctgccttcccagctctgcagaaccagcttctgcttatccgctaggtgccagcccagccacctgccttaagcaccatccacagtcacccagcccatcaccatcactagcaaagtcacc

SEQ ID NO: 28327 - DNA, 1053 bp, Homo sapiens
atcactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccggtaaggccctgctgtcgttttttaaactaaaagaaggaaaaagaaatcttgagcttgcccctgtgataaaatatatactagttaagcatttgaatctaagcatttgaaatatatatgagttacctttgaagcatttaactatatgttagttaagcatttgaatctgcatttgaagccgatacaactgcagaatctgaaaccttgtactactgtaagggctctgcctttctaaccccagggagaatagcatctgcctggggttagcctcccttgtgtggattttttcttactccttttggccactgcctgttcctggtctatggccgttccattggctgcactgtctgtccctgcccctcggccagaggccatcccaaggactttgcagttgcagggcggcatccactctggtcttcctggcccagcacctgtcctccccgctccactgtgagttgccaaggcaggcatttgtggcccctgggatgccttggggtgcctcatacagttacttgggccgctgtgttacaatcctttttctttttctttttttttttttaaaaaaaaacggagtctggtcctgtcaccca

SEQ ID NO: 28328 - DNA, 1031 bp, Homo sapiens
agttttcatggtgtggaattctgcattcacagtttgttttcttcaagaagcttaaagatgttgactcactttctttctggcctccattgtttctgatgagaagtcagcttaatttgatcattattcctctgtatgaagtgtgtctttcttctctggctgctttctttggggtttgtttgtttgtttgtttgttttgttttgtttttgagatgaagtttttgctctgttgcccaggctagagtgcagtggtgcgatctcggctcactgcaacctccgcctcctgattctcctgcctcagcctccaagtagctgggattgcaggtgcccgccaccacgcccaactaatttttagtagagacaggatttcaccatgttggccaggctggtctcgaactcttgacctcaggtgatccacccacctcgggctcccaaagtgctaggattacaggcgtgagccactgtgcccaggcctctggctgttttcaagctgttgatttctttcctttatctttaggtttcagcagttggactatgatgtgcttcagtctcattttcttcttatttatccttcttcatgttcattgagcttccatggactatgaatttaccttttcagcaaatttgcaaaattgtcagccattacgtgttatatgtgccattctttctcactaatgacctgtatgttagaaagtttgctgttgtctttcaagtgactgcagctttgcggttttttataatcttttttttctttgcccttcaaattgggtaatttctgttgacctgtccttgatttccctgactcttccactgactccagacttctgtaagttgatccatgaagtttttttttgtttaggatattatattttaaaattctaaaatttgcacttgactcttgttcatagatttgtctctcgagactcccctctgtttacgatttactgacgccgcttttgtttcggtgtttgcacgtacctgcaattgctgcattaaagtctcgtttgctcattttggcatctgagccggcaagc

SEQ ID NO: 28329 - DNA, 1092 bp, Homo sapiens
atttatcaagcctctctaactcgactacatttaaactccaaactttgtctcctccacagcaggagctgaaacctctgccacactaggcccacaaacatgcgtcattcagggatccaccaaggaacagggtagtttatacagaatttgggtcccactgccatggcttcctcctttgggaactctcctttccatttccatcctctctgacaacctaaaactgtgtcatctgacgcttcaacctggaactttctgcttaagttttagccatctacattataagggcactttatagcaagaaatagaatattattccattctaggccaagtacagtggctcacacctgacatctcagcactttgggaggccgaggtgggtggatcaactgaggtcaggagtttgaaaccagcctggccaacatggtgaaatcctgtctcttctaaaaaaaattttgaaaaaattagccgggtgtggtggtgcatacctgtaatcccagctactcaggagctgaggcaggagaatcccttgaacctgggagccagaggttgcagtgagccgagatggcgccactgccctccagcctgggtgacagagtgagagtctgtctcaaaaaaaaaaaaaaaaaaaaaagaaatattccttcgttcttttataggagcatagtacttcattttgtagatgtactattgtgtatcctactgatagatacttgtgttgcttccagtcttgtttttacagcgatcagatggttcttcttaatttctcttgctacaaatgttgctgctgtgtacaacctgttaaagtccacagatggaataaaagctttggtttgcaaaaatgactcaatctttacaaacattctgtcatttgtaccataatcaattagtttattggatcaccgaattgcctgacagaatccttcctggaactagtctatggggtcatttggcatagagtcaaagcctcagacacgatgagccagagttgatttcctttggcttcacataattaaactttcccagaggattatcaggttacagtgacacacacacaggctgtcagataatggacaaagtcccagcagcgtgtacaac

SEQ ID NO: 28330 - DNA, 1110 bp, Homo sapiens
aggcaggcagatcacttgaggccaggagttcaagaccagcctggctaacatgctaaaaccccggctctactaaaaatacaaaaaattagcctggcttagtggcgggcacctataatcccagctactcaggaggctgaggcagagaatcacttgagcccaggaggcggaggctgcagagagctgggatcataccactgcactccagcttgggggacagagtgagactcagtctcaaaaaaaaaaaaaaaaaagaatggtagtgttccctcctcttctgttttcttgaagatattgttagaatcatgttgactttttaaacatttggtagaattctctataaatgtttagaaccatcttggcctggacatttcgttttggggagtttttaaattacaaattgacttttgctataggttgtttaaattacctgtttgatattgaatgagttgtagtacctcatgcttctctaggagttggtccattttattgaagatgtcagagttatgtgtgtagaggcatttgtagtgttcccgtattatccttttgatgtctgcagggtctgtagtgatgttccctctttcattcctgatattgacagtctgtgtcttccctctaattgtttctttgtcagtcttgctagaagtttgacaatttcttattttcaaatacctagctctgttttgttgattttctgcattgtttttctgttttctgttaccgggatttctattcccctatctttgtgatttccctccttccttcctttgctatcattgtgggtttactttgctcttcttttcctgggtgctcatggtgggatcttggcttattgagttgagatttttcctctcttcaaatgaaagcccatagtgctataaatttccctctcagcattgctttagtcatgtcccacagctaagttttgtgttgtattttcatttttattgagttcaatgtctttttaattttcccttgagacttcctctttgacccttaagttatttagaagtgtgttgttaagtttccacgtgtttggagatttgtctgctatctttctgttattgatttctactttgatcctcgtgtggtcagaggacatgctctgtatag

SEQ ID NO: 28331 - DNA, 1196 bp, Homo sapiens
aataacacaattaaatgtttacaggaaaattgaataattcaagatacaagtgatccccccaaaaaaatatatatatatacagttgaaatgacctagattgatgggtttgggttttgtatctgatgcttgttgttttattttcttggaagaggaaaacatcatacctggcacagagatgtgttctgtaaatgcttgtggggtgggtgggtggatggatggatggatggatggatggatggatggatgggtggatgggtggatggacaaatggatggaagggtggatggatggatgggtggatgggtggatgaatggacagatggataaatgggtggaaggatggatggataaatggatggaagggcagatggatgggtggatgggtagatggatggaggatgaatgggtggatggatggatgaatggatgggtttttgggtgggcagatggatgtgtggacaaatggatgggtgatggatgcacatatgaatcggaataagagatacatgaaataatgtgtgcagggggctcagtacacagtaggcctccgctgaataattgttcagactatacccgtgttaacacgttgttctctcgctatttagggaatgatcacattaatcttggccactgacatggcaagacatgcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccatagcccagcacccctccataaccaggacaaggtggccagagaaggggtagggggcctccc

SEQ ID NO: 28332 - DNA, 1011 bp, Homo sapiens
agctgggactacaggcatgtgccaccacgtctggctaattttttgtatttttagtagagacagggtttcacaatgttagccaggatggtctcaatctcctgaccttgttatccacccgcctcggcctcccaaagtgttgggattacaggcgtgagccactgcgcccggcctaaatctttaattcttttttttgagatggagtcctgctctgttgcccctgctggagtgcagtggcgcaatctcggctcactacaacctccgcctcctgggttcacaccattctcctgcctcggcctcctgagtagctgggactacaggcgcccaccaccatgcccagctaattttttacatttttagtagaggtggggtttcaccatgttagccgggatggtcttgatctcctgaccttgtgatccgcccgccttggcctcccagagtgctggaattacaggcgtgagccaccgtgcccagtcctaaatctttaatcattatatggggttgtagaatagtaattgagtttggtcttattttcatcaatatactatttcctcagtttgaatgtttgaaagtatttagattcttttgttttcttcctccttggtctgtgcacagaacactggtaagtttttaaatatttgtatttatacaaagagagtgccagcccctgactgcctctcacagtgtgtggacttgaggcttggattccacgggaatgttatttagttttgtgctatgactcctgcctcgtttttcaatcattgtttttttctcttcttccttttatgttatttgttttaagagaggggctctggctctctctcccaggctggagtgcagtggcacagtcatagctcactacagcctcaaactcctgagctcaagcaatcctcccacctcagcctcctgagtagctgagactacaggcacataccaccactcctggcatatccctggcatgttttgttgatgttgttgtttattttttgaaatagagtcttgctctgtcaccca

SEQ ID NO: 28333 - DNA, 1035 bp, Homo sapiens
gcagtacagtggcgcaatcttggctcactgccggctccacctcccacgtacaaacgattctcctgcctcagcctcctgagtaggtgccactacaggtgcctgccaccacgcctggctaattattgtatttttagtagagacagcgttttgccatgttggtcaggttggtctcgaactcctgaccgcgggtgatccacctgcctctgcctcccaaagtgctgggatttcaggcgtgagccactgcgcccagctatgttaccattttcttgagcacgaaacttgataagatgcaatgcgctttaggtgggtcgtggcaaacatgaaaaggcaagcttccgttttagaatccatggctcttcttgaagacttctctaaagtgcatgatccctaacaagcgcggctccgtcctgtgtctgctctccatcctctgtaccgccgccccttgccttatgtgccttacatgacgccttcttgttcttggttcgttgtgcgacaggatctatgtgttttcccccctctccgtctgctctttgatcagtacgccaagtgccggtgcttgccagacttcccagcccttaggaactgcatttcctgatgctgctgctttcactcctcctgctcgaaaatggagacgaataacacaactcgcaggataaaaacagaattgggagttttcagactgcaaacctttctgaagagaaagttctaatatttcacgggtgtgttgtttcttaactatcttctgtgcgcatgcgcagagcccaccttgcagagccgtgtctgtatggggccgcggtctcactaggcagtccgtgccccagtactggccttccaggtagagtggttttagatcagagttttgtaacccacgtcttggtcagttatcaccctccctatagtaactaaaatagtacgttctgctttgaaggtgtccctacaccacaccgaagatactcaccttgtggagattggaaggatgccagctctttaaatgagacatcgtttttgcttaacgtaacttaaaaatgaaaaaca

SEQ ID NO: 28334 - DNA, 1020 bp, Homo sapiens
aggagatcgagaccatcctggataacacggtgaaaccccgtctctattaaaaatacaaaaaattagccgggcatggtagcgggcgcctgtagtcccagctacttgggaggctgaggcaggagaatggcgtgaacccaggaggcggagcttgcagtgaaccgagatagcctcactgcactccagcctgggcgaaagagcaagactccgtctcaaaaaaaaaaaacaaaaaaaaaattagccgggcgtggtggtgggcgcctgtagtcccagctactcgggaggctgagacaggagaatgatgtgaacccgggaggcagagcttgcagtgagccgagattgtgccactgcactccagcctgggcgacagagcaagactccgtctcaaaaaataaattaattaattaaattaaataagtgggtgttttaagtgctcagcttccttggttctaccaccttctctccctgaccctccttccctttccccctgaccttggcctttattctagaacggatctgaagcaataggatataaaaaattcacaactgctaaaacagtgttccttctagtgtaattttcacccttagagacctgtctgtaataaacattatttgaaatgcctactatatgctaggcactatgcctcggccacgggttcagacgtgatcgagacagcctgccttctctgagtgtatggcctgggaaagggggcagctgagagacagatgcatggcgatgtgccggataacagacgtagaaggcagaggcaggggagctgtctggggagaggcaaagatggggattcatcagagaaggctttgaaggacatgatgcctaacctggatgtcgaaagggattttgccaggagcacagggcactggtggagggagccctgcggggcagtcctcaaggcctccggatgggtgtgagaggcaccggggctgaagcagcatctgggtttgaggaagccacagccccttggctctccactgcagtctcagagcagcctcaggctgagtaag

SEQ ID NO: 28335 - DNA, 1033 bp, Homo sapiens
ttcaccatgttacccaggctgctctcgaactcctggactcaagcaatctgcctgcctcagactcccaaagtgctgggattacaagcgtgatccactactccaggcctaaaagtgggtttggtttagtttgtttgttttttttgagacagagtctcgctctgtggcacaggttggagcgcagtggctcgatctcggctcactgcaacctccgcctccctgggtgttttgtattcttagtagagacagggtttcactatgttggtcaggctggtctcaaactcctgaccttgtgatccatctgcctcagcctcccaaagtactgggattacaggcatgagccaccgtgcccagcctagttttgttttcttgagacagcgtctcagtggtgtgacctctgctcactgcagcctctggctcctgagcttaagtgatcctcccatgttgcccatgtgaaagaaaaatattttgggccccaaaatcactaaggaaaagtcaagctggacactgcttaagggaaacctgcctcccattctattcaaagtcactcctctgctcactgagatagatgcatatctcattgcctcctttggaaaggctgatcagaaactcaaaagaatgcagcctccagtgtctcacctttctgtgcccagcaagctccctccccgcttggagtgttcctgcctttgcttcaagttgtcccacctttccagaagaaccaaggtgcttcttacatatattgattggtgtctcatatctccctaaaatgtataaaaccaagctgtggcccaaccaccctggggacatgtcatcagtgcaaggctcttgcattggttggaaccccgagagcgcgccaacagacaacatgaggcggtgtggagcaacatgctgttttaatgagcgcctgcatgcagacaggctgaggcctaaaatggcatcagccccaagtgaggatggggcaggggttttatagtcctctgtaaacaggaattgtcccagcctaacgtgactgctatgtagtaccagggcgacctcc

SEQ ID NO: 28336 - DNA, 1043 bp, Homo sapiens
tgtgacttcctcaattgctccaatagataacatcactattgtagaacctaagattggcctttttttctttttgagacacttttgtctcccaggctggagtgcaatggcacgatctcagatcactgcaacctccgcctcctgggttcaagccattctcctacctcagcctcccaagtagctgggattataggcacccgccaccatgcccgggtaatttttgtgtttttagtagagacggggtttcatcatattggccaggctggtctcaaacgcctgacctcagatgatccagctgcctcgggctcccagagtgctgggattacagccgcgagccaccgtgaccagacgaaattggtcttttgagatttttttttcaaactttctggtgtgaaccccaaatatatgagactggtctcagtcaatttaggaagtttattttgtcaaagttaaggacacatgctgtgacacagcctcaggtggtcctgataatatgtgcccaaaatggtcggggcacagtttggtgtgacatacttcagggaggcatgcaacatcaatcaatatgtgtcaggtgtccattggttcgacctggaagtgtgggacagcttgaagcagggagagggctcccaagtcataggtagataagagacaaatggttgtgttcttttgcatttctgactagcctttacaaaggaggcaaccagatatgcctttatcttagtgagcagagggatgactttgactagcgtggaaggcaggtttgccaggagcagttcccagcttgacttttccctttgtgatttgggggtccctagatttattttcctttcacattggcaactgagtggccctactgggacccgtgacttgtgacccagccaatcctgtggccccacccagaggcagactcagcacaggaggactgttctccatacctgtaagatttttctttatatatatatatagtggcactatcacagttcactgcagcctccaactctgtgattgaagtgatcctcccacctcagcctcccaagtagctagaa

SEQ ID NO: 28337 - DNA, 1049 bp, Homo sapiens
ctggtacccaggcagcaggctgggcattccttggtcaatgtttgccaggcacatgataacctaagtgtgcaggtgatgttcaagccaggtcaggacatggggaaccacctggcttctctccagtgcttgccatgatgtcccaaatgaaggtgatttttttttcttttttttgagactaggtctcattcttttgcccaggctgcagtgcagtgtcaagatcacggctcactgcaacctctgcctcctgggctcaaatgatctgcccacatcagcctcctgagtagctgggaccacaggcgcccaccaccatggccggctaattttttgtacttttagtaaagacgggctttcaccatgttagccaggatggtctcgatctcctgacctcgtgatccacctgcctcggcctcccaaagtgctgggattacaggcctgagccactgcacccagccaagtgctgggaaccattttctaaacatggccccaggatcaaatccattccacacttgcatgggcacatgtgccagttttgtcgtatctctaactatgtcttcaactgcttgcccttcattatctatgtgtacgcagcaattagtaaggttaaatttcctacagacctttccttcagctgctagcaagtagttgagagctaatctattttgacatatagcatttctcatctgagcttcttgccaggccacaatagtcaaggctctgctggttttattaatgtttatttttaagacagcttgtaactgtatgattcggttgatcatgtaaatgggggtccggtatccccacgagccgtcttgtgcctaagtagcaggactataatgttgtatgattctctcagggggccatttatcattttttcaatttcttatggctacgattctcttttcgtgggaagaatagacagggaagcccaggagttcgcctgtttttttgggcagtaggaagaaagatggtttaatagtaccaataacacaactacctgcctactggtcaggtaatttggcgtaagctctgtgcctacatatccagtataa

SEQ ID NO: 28338 - DNA, 1133 bp, Homo sapiens
gggattttcaaatagcatgatttggtacttggttaatctatcatttgttaaccaatgatatcctttggtatttattaaggttaccacagcatggggggtctttatattcagattttgcttaagggttagtttatctgcttcttgtgctaacagggctgttgctgccagggcccttagacgtggggccagcctttggaaaccctgtctagttgttttgagaaatagaccactagccttgaccagggccccacagtctgggttaaaactccaactgccattttttctctttctgacacatagaatgttgagttttgtcaggtcaggtagcctcagggctggagctgacgtgagttttcttttaactcatgaaaagctcgttgctgttggttgtaatagatgtagtttatccaatctacatttttattaactgtcacctaccaaaatattgactcaaatcctgcagctatttgatttcaagctttaaattgatctggtattcctcgtgggactccaattgcgtctaaatagacatgagagttgaaagacccctaaggagcttctctcgctttatgatgtcttattgatgaaatgccagggtgaaagggatagccaaccggactaaagtacaagtgccactccagttattcggcagagtgcccagtaaaggtccaccacaataccaccacacatccgctcagggatgaacaagggctgcctcattgataagctcttgaaaattcttatgcttcactgcatcctttcaggtctccaaggaacacgaagtttcctccctgtcatgagagacacgaagtgaacttagtgttgggagacggaggttggatggccctcaggggctgacccacagggtgctggactttgggatatagcagagagagcttggcacgacttattactccaggccgtagaatcctggaaaagagctaccatgcagcccacacctggtcaactggaggaccaccttagtggaaaggggacaatctgggcctctggcctgccatgtgcacaagcataacaattggttttatttaatgtcaaatggaatatttgatccattttaactaggcatttgcatcttggtatcctgtcttaattgataaagtttgttttaagtc

SEQ ID NO: 28339 - DNA, 1070 bp, Homo sapiens
gcggggcggcgggcgtgagggtcgggggcgcgcggcggggcggggccggggcgggcggcgcgcgtggggccggtcgggtccgcggcctcgcggagtcctcagggccggcggggctgctcggagggtgcggggcgcgcggcggcgcaggcgggaagatggcggccgcgaccccggccccggcctcggccgtggcgagcgggtgggtcggggtcctgggggcggtgggcgtgatggggctcgtggccctcagccgggcgccggcgcgggagcagcccagggccgctcgctgacggcagtgtttggggccgggtgctggggaagcggttccggcgtcccgggaattggtgggaagagccgcttctgtcacacgggtcgtggtaatggatgacaggaagtgccgggcagggtctgggcgccctgtgggtttgcaccttccttgtgagggaaatcgtgtcacttaacgaaaaatgaagaaacgcggagtctgctttatgtcatcctcgtggctctcgaaatgccttatttggacagtggctctgcgacgggaccagttagggcctccgttccgatggcggattcctgacgggaggcccgagggtccgggaatggcggcgtcctgaggtcgggcccagggcaggccaggctgagcgccacggcggggccgcagccctggggggtgttccacctgtgtgtggggttctcttccaactctacgagagtttgctttttaaaacagtagatgatttttccttaggaagtggttcctcttcaggatgaaagaaacccccagctttagttaggtctactttcatgatttttcctggcatactgaaaaataggctttctctaaacataaggaagaatcgaggtgaaatgtgaacctctgccagtatagttattggtgatgctcttgcatttagtcataatttggaagatggcaggctgaccccaatgagcctttcatcactctgcttaatttacttagagtgatttgtgaatcctgtccttgtacacaggcgtacctcagataattcgagttctaatccagaccaccgcagtaaaataagtat

SEQ ID NO: 28340 - DNA, 1078 bp, Homo sapiens
tgaaagacttctttgtagcatgtgatgctgttttgatagcattttaaccacagtgaaaattctttcaaagttggaggctattctcaaactctgccactgctatccactaagttgatgtgatattccaaatgttttgttgtcatttccacaatgtgcacagcgtcttcactaggaataaattccatttcaagaaaccactttctttgctcatccgtaagaagcaactgttcattatttccaccacatctgcagttccttcctccactgaagtcttgaactcctccaagtcatcataagggttagaatcaacttcttccaaactcctgttaatgttatttgacttccttccatgaatcatgaatggcatctagaatggcagattctttccagaaggttttcagtttactttgcccagattcatgcgaggaatcactaccacagctatagccttacaaaatgtatttcttaaataattaagacttgaaagtcaagattactccttggatccatagctgcagaatggatgtggtgttagcagacatgaagacagcattcatctccttgtgtacatctccatcagagcccttgggtgactaggtacattgtcagtgaacggtaatattttgaaagaaatctttttctgagcagtggatctcaacagtgggtttaaaatattcagtaatgtgttattccatttccagagcacaggcaagagtagacgtaacataattcttcagaaccctaggattttcagaatggtcaaagaccactggcttcagcttaaagtcaccagtgacatttgcccctaacaagagagccagcttgccctttgaaactaagcactgagttctctctaggtatgaaagtcctagatgtcatctccttccaaaggaagtcttttgtctatattgaaaatctgctttttcgtctcgctgccttcatcaatgatcttagctagacctggataacctggtgttgcttttctgttaggtagcacttgctgcttcaccttgtactttcgtgttatggggacagcttctttccttaaacctcatgaaccagcctctgctgcttccaa

SEQ ID NO: 28341 - DNA, 1071 bp, Homo sapiens
ctttagaaggccaaggagggcagattgcttgagctcaggagtttgaggctagcctgggcaacatggcaaaaccctgtctctacaaaaaatacaaaagtaaaccgggtgtggtggtgcatgcctgtggttccagctactccggggctgaggtgggagggttgcttgagtgagggaggtcgaggctgcagtgagccagatggtgccattgcactccagcctgggcaacagagccagaccctgtctcaaaaaaaaaaaaataataataataagcggacacagtgtgcctgtaatcccagctactcgggtggctgaggcaggagaattgcttgaaatcaggtggtggttgcagtgagccgagatcacaccactgcactccagcccgggtgacagagcaagactccgtcataaatgaataaataaataaataaataataagtaacgatccactgtggcttcctggaaacatccatgttcacagctggggtctggtcagtctgcatagtggagcacactgctaggatgcatccttagcaagtgaaaaaagtgaggctcagaactgtttgtagagtatagccttttatctaaggaaggcagatgaagactggcttatgataaaggtgctaacccccagactagtaaaaatggggttccctgtggagtagggaaggggcagtgttataagttggatttctggccatatctgctatagtactgatcatggaactctaggggaggaaagatgttttccttctacccatcttacgttcattggctggggctcctggaacagaagacagatttacaaaagagaaaggcacacaaatttatgtaatataagttttacatgacatgggagcctttataaggaaatgacccaaggaaatggttaaacctgagtggttttgtgttaggtttgatgagcaatgaaaagctatggagaactatgataggaggagtgtgagctaaacgcaatgaactgggggaaacttagcaaggtctgttcagatttctctctgtatccttctttggaggtcagcatgtttcctccccccgtagatacggagggcactt

SEQ ID NO: 28342 - DNA, 1051 bp, Homo sapiens
gctactcgggaggctgaggcaggagaatcgcttgaacccgggaagcagaggttgcagtgagctgagatcgtgccactgcactccagcctgagcgacagagtgagactccatctcaaaaaaaaaaaaaaaacattgattctggccgggtgcagtggctcacacctgtgatcccagcactttgggaggccgagatgggtggatctcttgaggttaggagtttgaggcgagcctgtccaacatagtggaaccccgtctctactaaagatgcaaaaattagctggatgtcgggtgcatgtctataatcccagctgctcgggaggctgaggcaggagaattgcttgacctgggaggtggaggttgcagtgagccgagatcgtgccacagcactccagcctgggcaacaagagcaaaactccatctcaaataaaataaaataaacaaaaaaaaaacacacatttttttgagactttgcaaacctaaaaatgagtttattttaatctcatatttgatatgcagtctgtttacttgtagaattctgggttgaaaatcctttctacccaacattgagaaagcattacttttgtttttctgagacgaagtctcactctgttgcccaggctggagtgtagtggtgtgatctcggctcactgcaacctccacctcccaagttcaagtgattctcctgcctcagcctcccgagtagctgggattacaagtgtgtgccactatgcctggctaatttttgtatttttagtagaaatgggtttcaccacgttggccagtctggtctcgaaatcctgggctcaagcagtccgcctgcctcggcctcccaaagtgctgggattacaggcgtgagctactgcacccagctctcaagaaggttggtgttcttttttccaatcttttgtgtttttctcatcttttagaagcttctctttttttgcaggtgctctgatttttttttttttttttttttttttaagagacggtctcgctctgttacccaggctggagtatagtggcacaaacacagctcactgaagcattgacc

SEQ ID NO: 28343 - DNA, 1048 bp, Homo sapiens
tggaaaaataagtgatgccaacttgggcctatgagatcgagatgctgggtgtctgtcatggcctgcatcggccatctcgctattcgcctaatgttatgtggaacccacatggcacagaccagagctcagcagggcaaggccactggacctaattacagaagccaacacctttttttttttttttttgagacggagtctcactttatcagccaggctggagtgcagtggcacaatcttggctcactgtaacctctgcctcctgggttcaagcgattctcctgcctcagcctcccgagtagctgagactacaggcatgtgccaccacactcggctaatttttttttgtatttttagtagagacagtgtttcatcatgttggccaggatggtctcaatctcctgacctcgtgatccgcccgccttggcctcccaaaatgctgcaattacaggcgtgagccaccacgcccggcccaacacatcttctcgttgttggagctagtttgttagattgtctgtcacctgcagcgaacagcacactgggacagcctggtccacttagggtctctgaagcggttccctcttctgcagagcgagacgctcctatttctcaagagcttgtgtgggtcaactgggataaagagctaaagaggtcccttttcttcctgctttgtcccatgtcaaccacaactccccttgctggtgtctggattttcagggcaggtaaaatttaccttccatgcccccacaacctggttcagctttgctatttccaaagcccttgagattctaaccccgccatccccctggacctctcacttctcaggctgctcatctggaccgaagggagctctgggaacagagcggtggttcctaggaagtgctgcttcgatttgagccccgcttctccagggcagaggcacagcattcgccaggcaggcactgtgtcttgctcaccccgtggtgtgcatgcatgtcccagcgtcctggcggtgctggccactgggtggctgcgaacccctggagcctgggaaacatgaaataacaagcca

SEQ ID NO: 28344 - DNA, 1055 bp, Homo sapiens
ctcctgttcactctgcaaagaatcccacaccttcttcactgccagcattcagttcagtatcacttccttcaaaaagcctcgcctagcatcttgccctactcctccagggttctaaaacatccattgtgtctctgttgtagcacttagctacattgcttcttaattatcaatgtgtcatccttctcccgaaacaccgtaagcttccatctgttttcttagccagaagtgggagtacatgcaaccgtaaaaggtcttggcctgtacaagagtggaagaccagaggcaatacttacggtgctaagacagcctagacagagccttttgctcaaaccctttggtgagccagcccaggatttgcaaatgcagaggttatgcgggggcctaagaccagtttacaccagtgctccagagtcctgtctggttagtgcctatcacacccagagtgacttgtcttgtatatcttgttcaccaccacattgcatggagtacagtggaccttcagaaaataactccgcagcatgaacgtcgtggacagtgataatgggacaagaaaacacaaggtctccaccacagctatgccccatcacaattacagcacaagtttggaaataacttggcctgacattcgactcccgatgacaggctccaacttttctgcatcttgtcttaggcatcataaaggaaatgtgagctatcactcttcctgaaacatgagctgttctgcagcaacatcaatagatagctttgtcattttaaaaataaattggaaatctttgtattgctttaagtaacagtgttgcgctcttgctttaactgttcaagttgggtgctcacagtcataaaatgatcactctccatggctttcatccataagagcttatttgtcccaattcattcattcattcatatatttagcaaacatttatggagtgccaactgtgtactattatgtacgctattcttggcactgggaatatagcagtgaacaaaacagaccatccctgcctatcttatcagttctgcaactttaaaaatattgactaaaatggggaggc

SEQ ID NO: 28345 - DNA, 1065 bp, Homo sapiens
cgtgaggatccccaggcatgacttgttcataacaagagggcaagagaaccagttggtacatcttctctccaactgtgaaagggaatatactttaataaactagttttatgttagttcctgatatcctggttttacatggaaaactatcataaaagaatcaaaatgcaggccgggtgtggtggctcatgccagtattcccagcactttgggaggccgaggccagcagatcacctgaggtcaggagttccggaccagcctggccaacatggtgaaaccttgtctccactaaaaatacaaaaaattagccaggcgtggtggcacgcgcctataatcccagctactcttgaggctgaggcaggagaatcgcttgaacccaggaggcagaggttgcagtgagcctagattgtgccactgcactccagcctgggcaacagagcaagactctatctcaaaaaaaaaaaaaagaatcaaaatgtaccattataaaattgttgatgggagaaagacccttagcaaagtggaaatcaatacctgtaaattaaggttaacgcactctgaatacactaaacaaactttggtccattaaaaggtctttttgtcacttttttttttttttttaagagacggactctcgctctgtcgcccaggctggagtgcagtggcgcaatctcagctcactgcaaagtgcaaactccacctcctgggttcacaccattctactgcctcagcctctggagtagctgggactataggcgcccgccaccatacccggctaattttttttgtatttttagtagagacggggtttcactgtgttagtgaggatggtcttgatcgtctgaccccgtgatccgcccacctcagcctcccaaagtgctgagattacaggcatgagccaccgcgtctggccctttttgtcactttttaagcatcttttggagtattaagatcacattgattctaaatatttgtttgcattcatctagtttatagcactttgttgctccaaaagatttctcctaggatctcctagtaaaatcctaataaagaccatttgtaacacac

SEQ ID NO: 28346 - DNA, 1034 bp, Homo sapiens
tccccaggccctttcctaggcctttgactttcagatgtactgtttggagctcctgtgtcctcagcctggctggttttctgttcctcggaagtggggctgcccgttgctggggcttcatatgacttgagcaggtcccccgcatctcttgtaagatttgcagttttacttcacaagaccagcgaaaatgtcagtgtgcaggatggctgcacgtggtgggcggggagggcgttgatgaggagccgatttcataagtggccactttgttcatgaattttgtgttgtgatgacatttgcttcctcacgctgaggccgggccaccactgccaccctaccctgtagctgataaagctgcaggtacagtagtaatttatttgtgtttcttttataacaataaggaaatgtttgcttcaattttttaaaaagacgtgcaaacgaaagagaattaaaatgtatgtgatacttcaccactttctaaacttgaagaaaagagatgcatagactctaagatgtttgtattgttttgccttccaggaggtttcagtcaggaagaacttctgaaaatctggaaggggctcttctactgcatgtgggtgcaggatgaaccccttctacaggtaacatgcgttccctttgtcatgctcccgggttcttgctgtggatggataagagacttgatcactcatgctgtgccagtcccccgatacactgacgcacactgacagtcatgcttcaaggagtcattttcgtacctcttgtccatacagaaagggatgcagggtcaacacagttaggtgaattgtcttttcaaataaaaggaaagatgtgcattcgttgtcaatttactatttctctgtaaaatttcataggttccatgctaggttttacattacttaaagtttctctcttctggtaagtttattttttgtggtcaaggatggcatgacaggagcactaactagtcaagaccctgtgaaacccaggagagggcagccgcgtcactgggcttcgggttccatggagagcagcagtagcgc

SEQ ID NO: 28347 - DNA, 1072 bp, Homo sapiens
agtttgaaatcgagtgttctgatgtctccgggtttttgagggttttttgtttttttgtgtgtctttttttttttggtgttttggtgttttgggttttttttggcggcggggaggggagagagacagagtcttgctctgtcgcccaggctggagtgcaatagtgcgatctcagctcactgcaacctctgcctcccatgttcaagcgattctcatgcctcaacctccctagtagctggaattataggcgggtgccaccacgcccagctaatatgtctttgtatttttagtagagatggggtttcaccatgttggccaggctgatctcgaactcctgacctcaagtgatccaccagcttcagcctcccaaagtgccgggattacaggcatgagccactactcccagcctctagatttattctttttgcttagtcttgctttggctatgcaggctcttttttgattccatatgaattttaggattgttttttctagttctgtgaagaatgatgatggtatttttatgggcattgtgttgaatctgtagattgcttttgccagtatggtcgttttcacaatattgattctacccatccgtgagcatgggatgtgcttctgtatttccatttgtttgtgtcatcagtgacttctttcagcagtgttttgtagttttccttgtagagatctttcacatccttggttaggtatattcctaaggtttttgaggttttgttgtttgttttgttttttgttgtcattgttgttttggtaggggtttttttgcagctgttgtagaagggagtaagttcttgatatgattctcagcttggtcgttgttggtgtatagccatcatactgattcatgtaaattggttttgtatcctgaaactttgctgaattcatttaccattctaggagctttttgggtgagtgtttagggttttctaggtatatgattgtatcatcggcaaacacggactttgacttcctctttaccagtttggatgccgtttatttcttttctgtgattgctctggctaggattgttcgtgcttttaaaaaatctggaaggata

SEQ ID NO: 28348 - DNA, 1048 bp, Homo sapiens
ggtcttaaactgttaggcttaagcattccacccacctcagcctcccaaagtgctgggattaaaggcatgagccaccacacctagcccaaaatgttagtatagttagctgtaggtggcagaattatgggtgatttctgtttcctttgtacttctctatttcctacagtgattatatattatatttaatcagaaaaaatcaagccggttgcagtggctcatgcctataatcccagcactctgggaagcccaggcagtcggataacttgaggtcaggagttcgagaccagcctggccaacatggtgaaaccaagtctctaccaaaaagtacaaaaattagccaggtatggtggcggtcgcctatagtcccagctacttgggaggctgaggtgggagagaatcacttgaacccaggaggtggaggctgaagtgagccaagatcgtgccactgcactccagcctgggcaaccaagcaaaacactgtctcaaaaaataaataaataaacagatagatagatagatagatagatagatagatagatagatagaatcaagaaccttttttttctttttaatttttagacctggtggacgggaagtaatttttttttttttttgagatggagtttcgctcttgtcgcccaggctggagtgcaatggcgcaatctcagctcactgcaacctctgcctcccgggttcaagcaattctcctgcctcagcctcccaagtagctgggattacaggcatgcaccaccatgcttagcaaaatttgtatctatcttttggtcaggctggtctcgaactcccgacctcagttgatccgcccgcctgggcctcccaaagtcttggaattacagacaggcgtgagccaccatgcccggccaagaatctttaaaagaaagaaaaaatactctggccaggcacggtggctcacacctgtaatcccatcactttgggagcctgaggtgggaggatcacttgagcctaggagttggagaccagcttgggcaacataacaagaccttgactttacaaaaattttaaaattagc

SEQ ID NO: 28349 - DNA, 1052 bp, Homo sapiens
gtggagactcatgcctataatcctagtactttggaaggccaagatgggaagatcacttgagcccaggagtttgagaccagcttgggcaacataatgagacccccatctctaaaacaaaacgaaaaaaagaaatagtctgattttaaatttggtgtagataacagagttgactaaggacctggagcaaattttatgtggtcatgggagtagtctctgggtccctccgctccccacatttctgtcgcctaacctggacacagactctcttccaagtgcagttccggacgttccctcccagttgcgttcatgaaacgtgtgctgcgcctgccccatcctccccaggccttgccctgatgtcgcaccactaataagcttagagggttccagaaacagtacacgtttaaaataattttgagttctcctgagtctgtttaatctgcttcttcataggctgtaacactctgaattttttaagtgctaaaagttgcattaatattgacttgtgcttcctgaagcatgctcgtgaaaagtgactgtactgctgtgacaggttctcaccaaggtcctaaactgacctgagactagggccggattcctgcgtccatgctcctacccctggtggtccagggcgatgccgtgtcccatccgcttgcctgcgtccctggacaggagcttcccatgcaccgcagccttcgtcctaacgggaccacgtgtgggggaggaaatcatcgaaggcagcagggaattggggttttatgggtacaaaaggcaaaacatgtgctttttcccagacttaccttcattcccatagcctgaacaatcaaaatgtcctgggaaattataaatggctttgcagagtttttctccttaaataaattttctttcattttttctttttttgagacggagtctcgttgtcgcccgggctggagtgcagtggcatgatcttggctcactgcaacctctgcctcctgggttcaagcgattctcatgcctcagcctcccaagtagctgggattacaggcacccgcaaccacgcccagctaattttt

SEQ ID NO: 28350 - DNA, 1014 bp, Homo sapiens
ggaaaccaaagttttaaaaagtagtataggccaggcgcggtggctcatgcctgtaatcccaacactttgggaggccaaggtgggcagatcatgaggtcaggagttcgagaccagcctggccaacatggtaaaaccccgtctctactaaaaatacaaaaattacctgggcgtagtggcaagcacctgtagtctcagctgctcgagaggctgaggcaggagaattgcttgaacccaggagatggaggttgcagtgagccaagatcgtttcactgcactccagcctgggtgacaggctgggtgagactccatctcaaaaaaaaaaaaaaagtattataacgaatttaggacctgactcttgttgggaactgcaagtaatagagagtatgtgtatgtgtgagtgtgtgtacatgcaccagtatatatgtgtgtgtgcgtgtgcatgcacacatgcgtgagtgtgtatgtttagggagaagagactctgagagactgaggagctcacccagcctttacaactggagaaaatgaacagtacgaatcctgcagctccacatagcacagatttgtcccagacacaaatgcctggttcactcattgtccaaaacacccccacccccaatgttcacccttccaggagccaccctaccagcagctccccttagtctgtgcaggcagccctgggccctcccttgggagggtgagttgaggcatgggatgtggcctcactgccctcctttcctcagaaggctcttgggcctgctctctgcagggccttgagatggccctgcttcgtcctagcaagtgggtggggtcggcacccaggcaggacgctgtctaaggtgttgaagggacagctgtcggacccacttaatatggggccttgctctcatttgggacagaattcaagaagacagacaagagtatcttggtcagtcccacgggcccttctcgagtggccttcgaccctgaacagaagcccctccacggggtgctgaagacccccaccagctcacc

SEQ ID NO: 28351 - DNA, 1109 bp, Homo sapiens
ctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggcttaatggctgcattagataggatcctcacatcccattcagaaccaaaactgatacagtgaaacaattaaggtgagcaaatagttttaacttttcttttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgac

SEQ ID NO: 28352 - DNA, 1041 bp, Homo sapiens
gcccttccacattgctaggactgtttcctcttgggtgtaggaaacctcaggttcttccagggctgggaggtttggctctttggagccccaggtgtgtatgtgtggaaagccttcctggctatcagttcagcagctcacatgtttctgtaggcctcactgcatgggggagatcctggggccctcagggcagcctcccaaccccttttgctctattgcttccgtaaccctaaggtacacagctgtagggttatgtatgagtttgctggattgaaaataccatatgcagccttagggtcatgtaggagtttgcccggactgccaaaacaaagtaccacaaaccaggttgctcattgtagcagaaattcacctctcatagtctgggggccagaagtctgagaccagggtgtgggcagggccatgctccctccatacaagggtccttcccggcctcttccagctctcggtggccccaggcttctggggctcacggccgaatcactccagtctctgtctctgtcctcacgtggcctccgcccagtgtgctctcttaaaagtccacttaacatgggattcaggcccacctggataatctggcatgatctcatcttggaatcttacatctgcaaagatactttttctttctttcttttttttgagacggagtcttgctgtgttgcccaggcagaagtgcagtggcgcgatctcggctcactgcaagctctgcctcccgggttcatgccattctcctgccttagcctcctgagtagctgggaccacaggcgcccgccaccacgcctggctaatttttttgtatttttagtagagacggggtttcaccgtgttagccaggatggtctcaatctcctgacctcgtgatccgcccacctcggcctcccaaagtactgggattacaggcatggggccaccacgcctggccttctttttctttttctttcttttttttttttttgagacgagggtctcactctgtcgctcaggctgaagtacaatggagcgatctaggctcactgcaacctcccc

SEQ ID NO: 28353 - DNA, 1028 bp, Homo sapiens
aaggaagaaaattggctagttttttgcttttctgactcccttagtttgggactgaggtttctgttattcttgtttggctgtcatggagaaaaacaagaacttatcggtcccgttttccattttttctttttcttttttttttttttttttttgagacggagtctcactctgtcacccaggctggagtgcagtggcgtgatcttggctcactgcagcctcctcctcctcccaggttcacgccattctcctgcctcagcctcccaggtagctgggactacaggcgcccgccaccacaccaggcaaatttttctgtatttttagtagagacagggtttcaccatgttagccaggatggtctcgatatcctgacctcgggatctgcccgcctcggccttccaaagtgctgggattacggctgagccaccgcgcccggccaatttttgtattttggtagagacggggtttcaccatgttggccaggctggtcttgaactcctgacctcaggcaatccacccacctcagcctcccaaagtgttgggattacaggcatgagccactgcacccagcctattggtcccattttctgatctatttttccctcttgcctctggctctagcccacatcggtgcatgtgtgtgtgtgtatgtgggtgtgcatgtgtgtacgtggtgtgtttgtgtacactgtgtgtgtatgtgggtgtgcatgtgtgtacatggtgtgtgtgtatgtgggtgtgcttgtgtgtacatggcatgcatgtgtgcatgtgggatgcatgtgtatggggcatgtgtgcatggcgtgtgtgcacatgtctgggcatgcatgcgtgtgtcatgggcatgcatgtgtgtgtatgcggtgtgttgctctgcaggccccagtgttggccggcccccccgtctttcctgtaagtgacttccttcctaggaggcttggtgtgactggcattccctggaaagggaggggcggatccgcagaacgggcagcttcggggacacaggggctgctgattggcattgt

SEQ ID NO: 28354 - DNA, 1023 bp, Homo sapiens
aaaacaaaaaatggtagcacggcggcctaataagaccatcccgagaagggggatgaggtgatagtccacaggcctcagtggaccgtcacagcaggtatggacatcagagagtcttgctcatatctgattgattgattgattgattgattgatttggtttgatttgaatttttttgaggcagagtctctctctgtcacccaggctagttgcagtcttggctcactgcaacctccgcctcccaggttcaagtgattctcctgccttagcctcctgagtagctgggactacaggcacgagccactacacccggccaatttttgtatttttagtagagacggggttttgccatgttgtccaggctggtctcgaactcctgacctcaggtgatcctcccacctcggcctcccaaagtgctgggattacaggcgtgagccactgtgcccagccctcatatctgatttagagtatgtactgccaagctccgtggtgtgaatacttccactatagctgaacgtaaactaccaacctgagcaggaaagagctgtgcagcagcctctgtcatgtagcgttcttccctccagacacaatagacacaaatagctgagtagacaacagatagtgtaaaatgctagtaaactaggaagtggtgaggctacaatatatattatgtttacttttaatatagtttatgtagtctgggtgcagtggctcatacctgtagtcccagcactttgggaggctaagggaggagaattgattgagcttaggagttcaggactagcctggacaacatagtgagactctgtctcaacaaaaaaatataaaaattagccaggtgtggcagcacgcacctgtagtcctagctactcaggaggctgaagagggtggatcccttgatcccaggagttcaaggctgtagtgagctatgattgtgccactgcactccagcctgggtgatagagtgagaccctgtctcaaaaaataataatataatttacataattgtaagttttatgactcaat

SEQ ID NO: 28355 - DNA, 1050 bp, Homo sapiens
ggggggctcgcggggggctcgcgggggggctcgcgggggggctcgcggggggctcgcggggggctcgcgggggggctcgcggggggctcgcggggggctcgcgggggggctcgcgggggggctcgcgggggggctcgcggggggctcgcgggggggctcgcggggggctcgcgggggggctcgcgggggggctcgcggggggctggcggggggctggcggggggctcgcgggggggctcgcgggggggctcgcgggggggctcgcggggggctcgcgggggggctcgcggggggctcgcggggggctcgaggcgtcccatgtgggcagccgttgggacctgccaagcactgcgcctagtgatctccttcgggtttgagccagtccatggggaggagccgtccaccaggcagcctcagggagagtgggcgggtgtcaagggaagcccacggccccagctggcccccttgtgtctgagcccccatggcttcctctgcctctaggctatgcccactggaagggccaagtgctgaattcagatgagctccaggagttgtacgaaggcctgaggctgaacaacatgaataaatatgactacgtgctcacaggtaggtgccggagcaagctgccgcaggggactacgcaccccactccagccagggtgggctcagggaggtccagagcacccccgccctgggcctgtctcgggtccctgccccttcaaggagggccttggcgtgcccaagccaccatcacacccccggtagcctggggggtcctggccacactatgcctgccgggacaatgactgcccaggctgtgccaagtcacccccactcctgtgaccacactggggttccagtgcccaggggagggtgcaggcagggtgttgggaacgctgaccggggcaggacaggtgggtgggacactcaattaggtgacgggctgctacctggtacactgccatcctttgtcaactttctggttaaaaaaaaattgtatttgtatacatgtttattattattattatttttgagacagggtctcactct

SEQ ID NO: 28356 - DNA, 1031 bp, Homo sapiens
agtgactgaacagtctgtaccagtcggggcctccagagatcagcaggatatatgtgtgtgtgtacatgtgtggacatgtttgtgcatgtgtgtgtgtgtgtgcatgtgtgcgtgtgtgcgcgcgtattgtgtgtgggtgtgtgtgtggatgtgtgcgtgtgtgcgcgcacccatgtgtgcatgtgtgcacgtgtgtgtgtgcacatgtgcatgtgcgtctgtgtgcatgtgtgtccatgggcgtgtgggcatgggtgtgcacgcatgtgtgcatgtgtgtgcgtatgtgtgcacgtgtttgcacatgtgtgtgcatgtgtgtgtgtgtgtgtgcacatgtgtgtgaagagctattgtaaggcggtggcttgagctgtgtgggggctcctgggcatgtttgggatttgcagggccagctgttgggaagggcaggctggaggctggacacaggagcagatgcagcagcccaaggtgcagtttcttcaaagtcctttttctccgggacttggagaccgtgcgtgtcttgctagcattgaaccttggttgagtcatcttagtctgttggggctgctgtgacaaaatgcctgagactggatgatttataaaaaacagaacttttggccggatgcagtggctcacgcctgtaatcccagcactttgggagactgaggtggtcagatcacttgaggtcaggagttcgagaccagcctggccaacatggtaaaaccccatctctactaaaaatacaaaaattagctgggcatggtggtgcacgcctataatcccggctagttgggaggctgaggcaggagaatcgcttgaagccaggaggcggaggttgcagtgagctgagattgcaccactgcactccagcctgggcaacagagtgagcgagactccatctcaaaaaacaaaacaaaacaaaacaaaacagaactttgttccccacagttctggaggctgggaagtccaaggtcaaggcactggcaggctcagggtctggcgggggctactttgctacccggactgca

SEQ ID NO: 28357 - DNA, 1060 bp, Homo sapiens
cttgtgttccctggaaatcccctcctggcagcagtgggcacgtcgggtgttgtgagtgggccaggggcacagcaagtctgtcctccctgcaggtggcctgtgagaagaccgtgtctaccttgcaccacgttctgcagaggaccatccagtgtgcaaaaggtacggcggccgggctgcatgggctgcgtgggctcctggctcccgaagtgggtgggagagaagagctggcacgtgctggttttgaaggtgtgatcggtgtctcctgctgacctcacctctgggagtgggggcaacagcgggagcccctctgagatgggaactcagtgctctctgcctgccccgcagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagct

SEQ ID NO: 28358 - DNA, 1024 bp, Homo sapiens
aggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcctgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgta

SEQ ID NO: 28359 - DNA, 1083 bp, Homo sapiens
agctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggtcgtgttgaggcatgatggttccttcccatcccaggagctccctacctgtgattggctgaacacccagtaccctgccagccacgctagggattgctgctggaaatggtggcagctgactccctaaaaacctcccctttggaggaaagagcatgccttgcccctgcctgccgggcccaggccccctcccatcctgcactctgttttctgccttgggggctggcctgggtgccccggcatgggcttcctgcaggacttcccagggcagagccctcagggataggaggcctccctgtgcaattctgaggcccagctctgggtgttggccaagggtgtctgctcctcctgggatccacctggctccttcacacctgggtggtgacgttgtagtgcctctggctgggcagat

SEQ ID NO: 28360 - DNA, 1035 bp, Homo sapiens
aggcagatagccagtgatctatggggtctcgcagccctcttcctcctgatggttagggggctgtgagtcccaaggctcccttccgctctcccacgtccctctttaaccgtgactctgtggcttagggcacagcctctgtcaagagggcagtgcctgctgtggttgtgtgagaggctgttgaccccagctgtctagaggggcctcccgtggttgtgtgagagcctgttgaccctggctgtagaggggtcttttggagcaggggtgaaacctccagtgcactgagctgagaccccctggaagccgactctctgtgatgagtgagtgagtgagtgggtgagtgggtggttgcgtgtgtgtcattgtgagagcctggtgcttcaggggctgagggcgtttttgttgtttcctacacaggaagaattaggaaggactatttcccagctcgttcatgcttttcagaccacggaggcgcgtgagtatgctctgctgtagttgggtgcatttgtagatgtcagaacctctgagcatcagagccaccagacccaggaggtttgtgttctcaaatccagagtaaggaatgcctaagggcaagagagcgccagctggtgtctgtgggtgcttagcatgtgtgcagtgctggtgtaagtattcaacatggattagctcatttacccaaaaccctcatttcgagcctaatgggctaatatcttacactttaaaaataaagtgaaaagccaggataatgtcaccaagagattggactgaattccgcctgatggtcctgaggttcctgcagttgatttttctgactcctctgttctctggtgaccggagttgagaagttcttaccctgcctgtctgtaggactcacttgaggagcctctaaaaatcctcatgtccagatcctggtccagcaagatccagttctgggggtagggcctgggcatcagcattttttatctatagctatgtaaagaacgggttcctccatgttctcacctccctccccagagtggcttcgtgctcctcagtggt

SEQ ID NO: 28361 - DNA, 1045 bp, Homo sapiens
tggcatgtgatgccctcaccaggggcaaccctgggtccgcggcagaccactcagggcctggagctgcctacctgcagtggagggggttgagcacagtgccgggcagggcagggggcccatggcaagaatggggtgcagaggaggcacatggtggctttgccccacactgggaagccttccctgttactctctccatgctaaactggccccagggcctagggattcaccccttcccttgcccagagctccgtgccattgaagccgtccatctcatttcccatgaggcagtggcctcctctttgtagccggcccttggctgtgtgaaccctgtcggccctggcgttcaggacctggcactgcctggcgtcctgttcttccacctccccttctgccttgagcccagtcctgcctactcctctgtgcctttgctcctgggtctcatgaccctgtcctcacgctggtccttctgaggtcagcccttgctgaggtcctgagccgtgtggatggagcttggcgcccacactggacacgggatgcgtctggctggctgttgtggccgtgttgtcctcccaggtctgtggtgctggcatcctcagcctgagttggagtaagtggaaagagcccgtgttggcattctctggctcatggggtcttgctgttttgtcagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgcca

SEQ ID NO: 28362 - DNA, 1091 bp, Homo sapiens
cacctgccttggcctcccaaagtgctgggattacaggtgagagccactgtgcctagctaattttgtatttttagtagagagacggggtttctccatgttggtcgggctggtcttgaactcctgagctcaagtaatccgcttgcctcagcctcccaaagtgctgggattacaggtgtgagccaccacgcctggccagtgttctggtctgtttgtgatgggtgtaagaatctgtctctttaaagaggtgcctctggccaggtggttacctctgtcaccagagatgagtcacccagtctcagctcgcaggccttcctggacgttcccagatagtccccagtgctggaggcctgtcgaaagtgtagctccaccacgccctttgatctcttcctcctctcctcttccccacccgcttccccctccttccccctccttccccctcctccttccccctcctccttctctcctgctgagggcatttggcctcatagataagcggtttctaatgagctcactggtttccgatggtgggtggggagtgactctgggctttctgtgctgcctcttcgacctcgtccctgttttctgctgtgcggagcatggccctttcctaatccgaaagagccgcacagtcccttccagtgctgcctgtggtctcgcccagctggctgtgctattgcgggacatggggcccagcctcctgctccttcagaggcctggggtgggtgaggctggggtgccctggtgctggatgcaggggtgctgtggtgctgaatgctggggtgccctggtgctggacgttgggtgcccaggcactggatgctggggtggcctggtgctggatgctgggtggcctggtgctgggtggcctgatgctgggtgctgggtggtctggtgctggatgctgggtggcctggtgctgggtgctgggtggcctggtgctgggtactgggtgctctggtggtggatgcagaggcagggctatctgtgggtctgcccttgggtgtggggcaagccaggtcagcatattgcaaagcacacgttgggctgctgcttgtgtaattgtctccttgtctctgctctctcccttctcc

SEQ ID NO: 28363 - DNA, 1031 bp, Homo sapiens
agttcaagtcaagaccaagctgggcaacgtgacaaaatcctgtctctgcaacccccaccaaaattagccaggcatggtgacttgtgcctgtcatctcagcctcttgggaagctgacttgggaggattgcttgagcccaggaggcagaggttgcagtgagctgagatcatggcactgcactccagcctaggcaaccgagtgacaccctgtctcaaaaagaaaaagaaaatctattgttgagtgtggccaccttcatcagtgatcttagctccatctgcagatgacttgctgcagcttctccgtgggcacctactgcttcacctgcacttttatgtgaagaagatgtggcttcttttcttaaatctcctgagccagcagcctctgctagcttccaactttttctctgcagcttcctcaactgtctcaaccttcacagaattgaagagagtaagggccttgctaggcactaggctttggtttaagggaatattgaggctggtttgatcttctctccggaccactcgaactttctccatatcagcaataacgctgtttcattttcttatcatttgtgtgtttacctaagtagcacttttaatttcctccaagaactttttctttgcattcatcacttggccaactgtttggcccaagaggcccagctttcggcctatctcggctttcaccacaccttcctcagcaggcttagtcacttctagcttttgatgtaaagtgagagctgtgcaactcatccttttacttgaacacttacaggccatcagagggttattaagtggcctcatttcaacactgctgtgtaacagggaatagggaggctggaacagagggagagagatgggaagagccgctcggccgagcagttcagagcatgcacgacctttttccactcagttcctcctctgatgggggcccggttcacagcactgaaaacaattatggtaggaacatcaaagatcactgaccacagatcactgtgacaggtataacaatcatgaaaaagtttgaacgatt

SEQ ID NO: 28364 - DNA, 1053 bp, Homo sapiens
ggtgaaggaatctgctctgcttgatctctgtcttctgaaactttttaggacttgccttatggcccagcacacggtcagattttaaaatgttctgtgtgtctttgaacagattctgttctgcagtggtaggggcagcattgtgtgtagattgattgaatcaagtttattcatcatgttattcaaatcttctatactaagggtcagcaaactacagcctataggctaagtctggctagctacctgcttttataaagttttgctggaccgcagtcacaccatttgtttatgtcttgtctacagctgtttttgcattgtggatttgtctattttgtctagcagttgtatcgagttttgctttatatacttgagagctatgttattaggtgatacagacttaaaattttatatcttccttatgaatgaagcgactattactgtgaaattatcttcttacctttttaatgctttctgcctttcagactttgtctggaattaatatagcggcaccagctgccttttgtttactgtttgctttgcatgtctcttttatttttttatttttaatttttctgtatctttaaatctgaaatgtatctcttgtagacagtgtatgattggaggatcttttttaaattgaagtttgacagtccgtttttttttttttttttttttttttcagtatttattgatcattcttgggtgtttcttggagagggggatgtggcagggtcataggataatagtggagggaaggtcagcagataaacatgtgaacagaggtctctggttttcctaggcagaggaccctgcggccttccgcagtgtttgtgtccctgggtacttgagattagggagtggtgatgactcttaaggagcatgctgccttcaagcgtctgtttaacaaagcacatcttgcaccgcccttaatccatttaaccctgagtggacacagcacatgtttcagagagcacggggttgggggtaaggttatagattaacagcatcccaaggcagaagaatttttcttagtacagaacaaaatggagtctccta

SEQ ID NO: 28365 - DNA, 1712 bp, Homo sapiens
ggctgatgaggctgcaggtcccttctgggtggccctggaccctgtgtccttctcccactgtggctgctttctacccaggaggtgtctcctccaaatgctgtcggcagagatcaaatcccatccctgatgttccaaggcttccaggtgtaactcacaggcccagttcttggtaggcaggtgatttagccttctgtgtcccagtcacaacccagggtgtgttgaaagctaccatttgataaaaacaaacatgagcaagattgaagtgaccaacaccaagctcgggctttcagagatgtagtcatggcggacctcaaacagcattgctgaccatctgagctgggtgctgaatgcctccatagttttcaaattaaaatgactgtatttagtgtctctttttttaaaaaaaatatttatttatttatttatttatttatttatttatttatttatttatttattttgagacagtctggctctgtcgcccgggctggagtgcagtagaacgatctcggctcactgcaacctccacttcccaggttcaaatgattctcctgcctcagccccctgagtagctgggactacaggcgcccgccaccacgtccggctaatttttgtatttttagtagagatggggtttcaccatgttggccaggatggtctctattgcttgacctcgtgatccacctgcctcggcctcccaaagtgctgggattacaggcgtgagccactgcgcccggcctagtgtctctttaggattgttttattaagattgcttatttgatagcagataactatgaagatactaacgatactataaagacacagtggcagctcccagctaactggcactctgagctgtcctctaacattctggattcacaaaagtttacttgctgggtttgctcattgttgatttaatactttgcctgtggtttaaactgttaaattgttgcaaattgctattctgtgcaaaagaaacttgaactgtcctgcaccccccagttcagctctcactgcattcccgctcttctgcctgtcctttggctattgttggactgtactcagggctgagaggagggcatggggcttctgcagtcaccacagggctgtgggaaggccaccagcaagggctggggggccagagggcttctgatctgtcaggtgcagggtgtggcgcacgtgggcttgtgctgtggatgaggttttgcttctaggggagaaaccggccaaggcgcgtcaggcatcagcagacctctcccagaaggaggacattttgagaagatgaagatggaaatcggtttgatctcctttgttccctttctggggacagggacatcacggttctgtaataactgaggtctaggaaaaagaacagaaagaagggcaggttggaaacattgtgtcttttggggctagtagtagctgcagaacaacccaaatccgatttacaaccaagcttctagggtgagtaactcgatattcaccaaaccgggtgactgtcagtgatggcatgccacgtatcacttttgggagggaggagaggttgcaaaactaagcagacggtgtggcactgcagctcccccccgcccaagctggtgagtgttaatatcgaaatctatagcaaaatgtttgtccatgacttgcaccagtacctctcgaaaggtgcccaaatacctaataaacatctgaaaaggcatgcaactcaattggtt

SEQ ID NO: 28366 - DNA, 1087 bp, Homo sapiens
cacttcggtcgagtttttggtggtgttgagcggatagccggggaagttggagtcttgtttgtggccgcctcgtgctcgtgtctgtatctaagatcctcaggctgctcctttttgggtaaggtctgttgcttctctaggaacagtgacggtggcagagcccgtggcccctctctcctgtcccagagccaagctgtttcctctccccactcccgggcaccctgcgggcaagtgaggggggcccactctgccctggcctgccccaccgccccatttgctgggttgtcctcaaagcacacggtaagcacccccgcccccgccccccacacacgtaccgctgtcagccttcttgctcgtcacctccatccagggcacatccgcccctctgggtgctgtgagcctgttgccggcgcggtcccgctgctcctccttctgctgccctgcactgccgtggcacaaccctccctccgggtctctgctgagccctccaggcgctcaggtctgccgtctggttgcaggtgttttatagagtgcagctttacgctcccactccagtcatctccacgttggtgtccgtctgtgtgtcctctctgcctttaagttctgcctctgtgtgacacagtttcacagtttctgtgaccaaaacacaggtttagtcgcttgctgctggcagagtccaattaacaagagcacgtcgggtataaagaaagtgactttattccaaagctagcttaggggaagaggtaaagtgagggtaccactttgcttttggagcagaaagtgggaacttttaaaggtggggggatgtgtggcacacaggggaggaggctggcaggtgggggtccgcataactcgtttcgctgccttatctaccgggtggtcgagttggcatcttccccggcagaactgtgttggggtgttgtgggtattgtgggtattgtgggggttgtgttgtgggtgttgtgggggttgtgggtgttgtgttgtgggtgttgtaggagttgtgagtgttgtgggggttgtgggggttgtaggggttgcgggtgttgtgggtgttgtagggggtgtgggtgttgtgggtgttgtgggg

SEQ ID NO: 28367 - DNA, 1050 bp, Homo sapiens
ctcctactgcagaagtcacacatctgtccatcatttatattcttggagtgtcgtccttaaatgttaggatgcatgcttgatgtcacaaaagtttaccggtgtctctattttctttttttttaaacttcactaatgtgtggggtacaggtggattttggttatgcggacaggttctttagtggcgaattctgagattttagtgcacctgtcacccgagcagtggtacactggacccaatatagagtctctatccctcacccccttcccaatttccctgtccattatatcactctatgtttttgcgttctcatagcttagctcccacttataagtgagaacagtttttggttttccgttcctgagtttcttcacttagaataatggcctccagctccatccaagttgctgtgagacattattttgtcccttttgatggctgagtagtattccgtggtgtatatggaccacgtgttctttattcactcttcggtccatggatgctttaggttggttctgtatccttgcaattgcaagtcatcttgctgcaaacatgcatatgtctttttccgctcatggcttcttttcctctggtagatacccaggagtgggattgctggatcgaatggtggatctacttttagttctttaaggaatctccatgctgtttccacagtggttgtactagtttacattcccaccagcaatgtagaggtgttccctgttcaccacatccatgccagccaaaaatgtggaatgcttcacgaatttgcatgtcgtccttctgcaggagccacgctaatcttctctgcctcgttccggttttagtacacgtactgctgacgcaagcatgggtgtctctgttttcttcccaaatagtgtaaagatcttggagccgggactttggttccatggtgttttcaaaccggctttcctcatgtgtgggtgccatgcgggcgtctgcatctccatgcttggagtccgcggggggtctccagacaggatcctggttgtcacctgaagcttggagaagggacaggagtgcactgcagg

SEQ ID NO: 28368 - DNA, 1029 bp, Homo sapiens
tagaatgacagatgtggcatttcaatcggtaaataatgagtacacctttaaggtccaggcactctttgtttagaacattgtggaatgcctacatcatctcatgcttgcacaggagcgtggctttgtcagaactcatccccaggcagccctgtgggcacctggtgggggctggacaggggtcacgaggagaagccagcaggagggtggtgggccctccaccttgtccccgcaggactcccctctctgcccagacacactcagcctccaccaggactcaggggttccagccaagctcctcttaccaacgatgccccgtgactgccccagggacgggagggctcaatgccattcccctgcaggccctgtctctccccagcttccagttggttgtcctgcagcctcaggtctctgatgggatgaagcaaagtcgagaacttacggtttgtctggctttattcttgtgagagtgggagtgacaagctctgtacatccccagcagaaaccagaattccacctcctacataactttgtaaattgcaaaatataatgaaaagtgcatgaggccaggcacagtggctcacgcctataatcccagcactttgggaagccgaggtgggtgggtcacctgaggtcaagagttcgagatcagcctggccaacatggcaaaatcccttctctactaaaaatacaaaaatcagccaggcgtggtagcccgcacctgtaatcccagctacttgggaggctgaggcaggagaatcacttgaatccaggaggcagagtttgcagtgagctgaggtcatgccactgcattccagcctaggggacaaaacaagactccttcttaaaaaaaaaaaaaaaagtgcatgagacattgatgaccagtttaatgaataagtatgcagcaaatatccatctgtttctatagagtaaaagtagttattataacgcgtagttcgttgtaagaaaattatgtctaggtcaacttagctgtgactgttttatgtgtgcatgcatgtatgtgtgtgtgtg

SEQ ID NO: 28369 - DNA, 1196 bp, Homo sapiens
tgatgaccagaggtatttgtttcttgtcttaggaaagcaaaagcctcccttaaagcccccgcagacttctccctggctggacccagggcacatgcccatcccatccctggatcacttgctcaaagaggggatgggattacctttatggcttagatctggggctgggcttccctcccatatccaagggtgagcgctgccataatagcaggaggttctgttaccagcaaagggggtagtggcaggtaggtaactcacagtgacttgcatgttgcaaaaggcggggttctgttatccggaattggaggagtggttttaggtatgtcatataattatgcctttaaatccattggttgagaaaacaggcaatgctaaaagattctcatgaacctagcagcggttttaattttgtattttatttattttatcagtatctaaatacaatagaaatataaatacaatagaaatggaatggatcatgtgagatgtgtgttgttgacgaacgtgtagtcagtgcttcatgcacatgggatccaagtccccaaacagtggctgcagatccacaccctgctccaggtgctgaggtgccccagacagctgctcctagtcagtgaagcattgactctttagtctcaattgttggtctgcatgtctactgataagccggtactgtgctgttttaattattgaggctttctagatgttgtagtgtattttagggctattttcttgttctttttcatgattttcctggcttttcttccctgtttagttttccatatgaactatagaatcagtatgtctagttctggggctgggggggagcttttgctattttaattaggattcagttatatatttaggtttatgtatcatttacatattactatctaacaaaccacctcaaaatgtatcaatttaaaacaaccatcatgtcggggggccctcaattctgtgggtcagcaatttgggttgggctcagcaacatggttcttctgctggtttcccctggggtcattggagtggctgtcgtcagctagagctgcctggagaacctcaggtggaatggcccatttctggtccatttctgctccatgtgggaccaccttctgtcagactagcccaagccaccacctctgatggccacaagggtgtaagggagtggcaacgctctaaagactgtcttggaagtcctgtga

SEQ ID NO: 28370 - DNA, 1094 bp, Homo sapiens
cagcactgcctttcaggagcctaacccttgggcagctgtagcagagggcgctgaagctaaaccaggactcttgagcgagggcgcgagacaagctagggttaacagtgacccttgggtttcagcagaggcaaacgaaagtacactctggagaaagtctcattcaggcctgaagaatcccacagattaaggaaaattaaatatgaattcataatcaagaatgacaacgtaaacagcagatgtggactgaagatgacccactgtgccccgacttgaaagagaaccaagtagaactgctctcagtgagaactgtagatattttaaagcaaaaacttacagacaggttttgtatcagattagatacagttaatgagaatgggtacagaaccaagtagaactgctctcagtgaaaactgtagatattttaaagcaaaaccgtatggatggattttgtatcagattagacacagttaatgagagaatgggtacaccagacatcaatgtgaagaaatcatccagtgacagtaaaggaggtgaaaaatgtgaaataggcgtgaaaagatgtaaggacagaatgagaaccttcataaaatagggctttggcccccatccccaaaggagagaacaggagaagcctcctgggaagagaggatgcctgaggacctcctgaactgatgaaggcacgatttttcagatacaggaagcacatgtagaccaagcagagcgaatgcacagaaatccacacctaggcaggccctggggcatcacagaccatcagagacaaggaggagccgggcgcggtggctcacgcctctaatcccagcattccaggaagctgaggcaggaggatcccctgaggtcaggagtttgagaccagcctggccaacatggtgaaaccccatctctactaaaaatataaaaattagctgggcctggtggcacatgtctaatcccagctactggggtggctgaggcaggggaatcatttgaacctggtcggtggaggttgcagtgagccgagactgcatcactgcactccagcctgggtgacagagtgagactctgtctcaaaaaaaaaaaaaaaaaaaaaaagataa

SEQ ID NO: 28371 - DNA, 1033 bp, Homo sapiens
gctgcccattttgaactcactgccagtgtgtctctgctgtcatctgatgtgcagagctataggtgctgcggcgaagggtgcaggtttggagccgtttaaacaacctggcccagcctcctcactccctgctgaccttggtcaaggcttcagtctctaaacctcagctttctcatctgcagagcacagacaaaaccacctgcctttgagctgtcttataaagcctaaatcaatgcgcacagcaggtacacagcaatgcttgataaattgttactattattgggtgaattttaggttttttttgttgttgttgttgttttgagacagagtctctctgttgtcctggctggagcacagcagtgcgatcttggctcactgcaacctccatcttctgaggttcaagtgattctcgtgccccagcctcccaagtagctgggattacaggtgcctgccaccacatccagctaattttttttatttttaagtagagatgggcttttgccatgcttccccagctggtcttgaactcctggcctcaagtgatcctcctgtctcggcctcccaaagtgctgggattacaggcttgagccaccgcacccgtccagaattttagatttttttaaatccgtggttgaaaaataggctatggctggcttactcattgtgctttagggaagcatgtatttgagtgaaggaaatgataaaaggaatttcatatcgggcccaggcgccgcccaccctgcaagacagtttacagatgcctgccctgacagctgtctgcagttagccagcgtcagccgaggggtcctgagatccgctgaaggctgcctttgcatgccgacagcaagggaaaagtgccacatgtccctgggcttgccacaggtgacctttggatgggaccattctccagacagcgcagctcgtctttccagaacactcatggggagtgtgcctgtgtctggctggctgtgtgggctcccattcagttcattccccttctccagcctttaggcatgaccctaaaggcagaggtctc

SEQ ID NO: 28372 - DNA, 1023 bp, Homo sapiens
tgccccgcccacgggcagtggctgcggagtgtctgctctatcaggcatggtgatttcctgccagcctgtgcctttgacattcccaccagaggcagaaccttctgcaggtggccctggccaggctcctctctcctcccagctcctcattagcctcctttgccaggctaggaaaccgaggtatgcgaggttaaggaactttccttgggccgtgcagctgagagtgcgctttgcagggatttgcatccaggccgcgggactcacacaggccacacctgccacccccactgcctctggctcgtgggaggtgtgggatgtggcgggtggccggggcagtgctgggcaggcaggtgttggtattcacaacgttgctttcttgaccgattattttcctgggagacttcctcagtcaaagggttgatatgcttgcgagctctcgatgcacgctatcagattctccaaaaacgtacagccagcttcgcctgcacctgcagcttctgtgatttgtgctcttaattgacgtggcgctttttttaggttgagtcgtttttcattgccaacaatcttctcctgcattgaaataatagcttgtaaagaagcctcacgcttcctttttctctgttgactcttctaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcaggtaatggacactgtcgctaacagctcacactctgacgggcctcacagtatcagccacagggtccgggacctggtgactcatcacagtggctgtgggaggcaggggcctggctgttatggaccctggagccaggatccccccacggcctgcgggcctcagagcctggattcttgcactgagctgagggtcgcct

SEQ ID NO: 28373 - DNA, 1542 bp, Homo sapiens
ctgccaggggccttggtgggaggggtcctgagaggcagtgactgccaccagcctctcccattggactacgagatgacttgaggccacccacagaggacaggatgtgacctgcttacatccgagggtcctgctcgtccacctctgtcacctgttgggtttgcaaggccgagctgttagaatgccccgaagcccttctgctcccaccagccaaagacccagaggggcaggcagggcaaggtccacgtgtccacctgcctcggacccagccggtcagaagacgtgcccctcacccctgcctgagcagaccacggtctgagagggctgtctccccgcgggccacacctactcactgacagcagaggccactgggtgcggggcagagggacagggtctggggcagaggaaggaagccccagtaacacgttttacagcaaaaaggcaaagtcatccgtctcacctcttctctctctctcctgtcttgaaagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagcatcgctcggctcagcaccttggctcccagtgggggccccgtggagggcgcccgtagtgataagcacaccggcacgaacgtcaggtccattcctcgaagtcggagccctcactctgccctgtcctggggctggctgagggcgaacgccccacctcactttctagagccctgtctgtcctagctcctatctgaccttgtgtgtaaatacgtacatctgtttttaaagtggatgggcccctgagaactcagtgaaatgcagagttctccatgcacctaaagctcctttgtcgctctcatggctgtcagatcctggtccctccacactgggtgctggggagggaggaccctcggggctaccgcgcgcccccccatcccacagatcaggagccaaggagggagaacagggcagcctgtgggactctaggatgcttcagaagaagcgacggcaccgtcaaccctctgttttttaaaggtggttggagactgttaacactgagctca

SEQ ID NO: 28374 - DNA, 1023 bp, Homo sapiens
cgaggccggcgtctctggtccgggagcgtccaggctcgctcaccgcgcgcgaggcccgcctgccgagtcctggcctcagctccggcgcagggcccagcggggcgcccactgccgagggaggaagatggacgtgtcccgggagccccgctccgcctcccacttcccacctcccggtcccgcgcggccggcccgggcgcacttccgtcggaggcgaagcgcggcgaagacccgccccgtgaagcctcgcgcgccccggaaatggtcatgcggcggcgccgaggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgagtgcccggaggcggggagggcgcggcggtcgttgggcgggcccgggccctggcgttatgcacccggcgcccccagaccttcagcccccggcgcgctccgggctgggccgcttcctggaggtgtgaccagggctgcggctgaggcggggccctctgacttttcggggacgccctctgaccttcccgccgggcgacctctgacccctggggggcgccctcgggccggctgcagttggagccggtggaacccggcggactctgcccgggactgggcgcgcgccggcgtcgagggcgaggagcgggggctgccaccgccccgtcccgcccccgttgagccgcgcgcccgggacctgggggccccggcctcttccgccgggcggttttgcccgcgggcgccctttccccgactacggggaagtccttgggggctcgcagagttgcaggcgttggcgaagtaggaacagtttgttgcggggtgaagcgtcaggcagagccgc

SEQ ID NO: 28375 - DNA, 1030 bp, Homo sapiens
cttcttcttcttttttgagacggcgtctttctctgtcgcccaggctggagtgcagtggcatgatctcggccatgatcttggctcactgcaacctctgcctcccgggttcaagcgattctccttcctcggcctcccgagtagctgggattacaggcgcatgctgccatgcccggctaattttttgtttgtttgtttttgttttttttttttttcagtagagacagagtttcaccatgttggtgaggctggtctcgaactcctgaccttgggttgtccacctgcgcagcctcccgaagtgctgggattacaggcttgagcccccacccttggcctcaagcaacatagtgaatgttaatctctgcatggatggtacactgtcctagaaggtgcaaactttcattcattggagtctcagaagagaagggggcttcagtagactgtcaaagttaacttgaaaaatgatcactttaaaagtgaaggtaaaaagctgacttcatacttcccacttgaaattatgttgtggtatatctgggactgaagctttaggaagcacttggcctggtttcactttatgccttcatcttgctcctctctttcagctatacatgttttgaaaggagaaggtggtatgaacaattgctttaaaaaaatccacccagaggctaattaacccttaactttttaatattatgtacatagttctcttagtaggcaacatttttgttttcaaaaatcttttaaattcttacttgaaatggtattacctcagatctgttcattttaaaatgaaagtagagtttatgcatgttgtgaattttttttccatagaatgtataatattttacttcagtgaaaatgcattctgcttagacctttctgggaagaatatagaatgtaactggttcaggtgaatttaaaaactgtgtatatgtagggatagaagaatgaaaagttcccaaagattaagggtaattagaatagattattactttaaaacctagctgattatttcacttcattttattattat

SEQ ID NO: 28376 - DNA, 1137 bp, Homo sapiens
ctgtggtgggttgcctcagagcttcctgtggcttcctgtcctgtgtctcaccttctttcttcctcaaatctttcctctatctgctcttaatgtcaaatatagtcacagtattttggccttagagaatatttgtttttaaattaaaaattgataaccttggagtcatttatgacttcttttttctctcacaactgacattatctttgaaatatatctagaatccagctatatatagggcctgcctggataatctgggataatcacatcttgagctcctgaacttaattaagtctacaaagacccctttcccaaataaggtgacattcacaggttttgagggttaggatgttgtggggcaccatgccacctgccgcaccactgtctgtgttagctaccaagcgcgcagtggccggcattcatcaagcgtctttggttttagacagctgcgtctgtctttggaggtttgtccttcgtgtactcctgaccgagggaatgttatcttgacatttgggcttctgggttctagatgtggttacaaggtggggtgatcccttcttaggaaaagtccagcctcttctgtgctctctcccttatgtggctttttggacatttgttacatggtgtttaatttctgaatattattttaggcccctgtttgcaattttttttttttaacagtgaccagggaccattccattgtatgtttggacatttttcttttcttttctttttttttttttgagacagagtctcgctctattgcccaggctggagtgcagtggcgtgatctcggcttactgcaagctccgactccgcctcctgggttcacgctattctcctgcctcagcctcccgagtagctgggactacaggcgcccaccaccacacctggctaatttttttgtatttttagtaaggatggagttcaccgtgttagccaggatggtctcgatctcctgaccttgtgatctgcccgcctcggcctctcaaagtgctggattacaggcatgagccaccgcgcctggcccatttttcttatttttaactgagatctgttagcagtttgaagcgattgtatacatttcagagttagctgggcatggtggtgcgtgcttctagtcctagctacttgggagac

SEQ ID NO: 28377 - DNA, 1056 bp, Homo sapiens
agctaaatccatttctctgtctttctcacccattagtgctctggggcctactaagccctacagaataaagccagcctttgaaaataagacagcccattaggtggccgaggacagtgtcttgttaacaggttgaaacactccacatgtctccaacaatttaagataaagtgagatgtattttattagaaaacttactgttccttttaccaagattatgctaaagaatttgaagaaaaattgtcctgtatcagagtatcagcaaatattcagactccttatgtcaaggtttttttttccaacataaatctccaaatagaagtattgaccttgaaaatatatcatgtcaggtatttaggaaagcgacaaactgactgaacattctgttttgcttagccactctctcagggttataattttgtgatccttttatacttttgtatgagtaagaccatcacggctttgcacgttcaagaattggttcagtaaaaaacagatgacagaaatgttcactctgtctgcggaaggccttttggaacccatattttcagccaaccattgttaaaacaactgctgcagagtaagtagtaaacttgttagaattaagaagttgggaaggagcactgggcagtattgagtcctaagccaagctacctgggttcgaatcccagccttggcgctcatttgcttgatgttgggccaattaggggagttcttgatgtcttggtttccatatgagggttcagggtgagtatgcgtgaagtgccgggggcatagcaggcgcacggtgctgtctggagggacggtaaacaggtggcccttctcttgactgtgttacctagcagctgttccatgaccctaatgtgatggttttgggaggtggggcctttgggaggtgattaggtcatgtggctggagtccccacaaaagggattagtgcccttataaaaaagggccccagagatctcccttgccccttcccccacgtgagggcacagcaagaccaaggtactcaacctgctgaagccttgactcagacttacaccctccagaaatgat

SEQ ID NO: 28378 - DNA, 1027 bp, Homo sapiens
atgagagggtgcctggcaggtgccttgtgtaatattcgcacatggggagccacctataaattttagctcctcctggcacttggttgaacagtgagttgattttggtgaagttttggtttctttttctccatggattttgggcgtctgggagaaagtggaggctgtagaacacagcaaagctgggtgaggtggagcaggctccctctcctaagctttgtgtccttggggcaagttcttcaccttctctgatccttgttttccttgtggggaaaatcacacccaccccatggaggtgtcacgagggttcagcttcatcacatctgtcccgtgctgggttttcctgagacgtgttatgtagaggcacaggtacagaagaatcttgcgatatcgctttactaaacataaaactacctaaaaacaccaatttattaagctctagagccattttgcatgtattcacctaaaaatatggtaactgaatttctttcttcccttcataggtgctggagatcagaatttatttacctctgtttatccaacgctctctcagcagcttccaagagaaccaatggaatggagaaggtatgagttgtgtgttttttggctgtatccctctcttcattttttaaaatgaagtacatgtttttaaataagtatatgttgtttagacatttatgtgaacaagtgaagtagcacaagttaaaagcctcagttctaaagaaacagaatgacctcacataatctgtgggtctttgtgggtcttattctttatggaatgccatggttttctttttttttttttttttttttgagacagagtctcgttctgtcgcccaggctggagtgcagtagcgcaatctcggctcactgcaacctccacctcctgggttcaagcaattctcctgcctcagcctcctgagtagctgggattacaggtgtgcgctaccgcacccggctaatttttgtagttttagtagagacaggttttgccatgttggccaggctggtcttgaactcctgacctcaa

SEQ ID NO: 28379 - DNA, 1028 bp, Homo sapiens
ttggaaagtagaagcaagacaattattttgagttaaagactcacttttataggaatgatctgtgattcttcatggttgaccagaatgtcttaaaggcacaggcgttttgcaaaggagacacgtgctcacttagactccaccttaaagcggaagaactgggctgtatcagccatcttacaagaccctccctccaccctggctcctgtgcgttttccttaaggacaagaaggtaaacagaaagatggtatttaaaaattaggagcgaggttagatcagccatcaccgttgctctgttgcatgtttacagttagtcgtctggtgacatactcataggaaatcactgactgggaatcctcttcttggaaaacttatttctggtaagagcaggtgttacttgtaaatataaagttgtgtatatgtaaatgtaaatttgtaaatttggattttgtcttgtaacataggtaatctgattttaaccagggtatacagaatttcctgttgttctttgtgtttatgtaagtctgattcttatagcattattcctttctgaccaccagtttgtgccttagtaacatgagggattaaggtggctttctggagttgacttacccaggtgaatatagtctaatttctgtgctgattatagtgtcttacaagatatgcatttagttgctaatatttaatataaagagtgtacagagtgtaagagaaaaattgcttaacatgtgaggaggcccagtgctgtgaaagagagaaaagagtttagcaaatggagtaatctgtaagggcattctgatagataaagggaaaaaaaaagtgtgttcatgaaacaagataattttgagaaaaaaattaaatggagaaactatgtaggcccggcatggtggctcacgcctgtcatccagacactgtaggagggtcaggtgggaggatcgcttgagcctaggagttcaagaccggcctgagcaacatagtgaaacccctgtctctgtaaagaagaaataaaattagctggacatggtggtgca

SEQ ID NO: 28380 - DNA, 1064 bp, Homo sapiens
ggcccgggtgaaagcagggctggagatgggggttggcagaggtgtggacagggacagttagactcagggtccccactcctgtctgtagtgaagtgattgctgtcattgcccactcccccaacccccccccccacccccgccgcccctcaggaacctggaaagtctttctgtggacagaagagctccagaccctcggatctgaggtgctgcagaaggcaagggagaagggccattctaaaaccagccggcctaggttctgaacagggcacagctccgctccgggaactctgtagccagatccatgcttcctaggcaagagagtagagaacttatctcaggaaaattggatggccccagggaaaagactacgtttttcagaaacaaccttaaaatttgggaaagaaatgtgttaccttagggaagatacgtccacctgaaacctcaggatgtgtctttattggaataagggtcttcgcagatatggttaagataaggacctcactgtgagatcctcttcaattagggtagaccctgaatccaatgacaagtgtccttgtaagaggcagaagagaagacacagacacagggtagaagaccttgtgaagatggaggtagagatgagagtgatgtgttcatgagccgaagaatgctgaggatgccagcagccagcagaagctgggagagaagcaaggaacctcccactgcagccagagggaactaagcccacccataccttgatttcaactttctggcctcatgaaacatgcaagaataagctaatgtcctaagcctccaggtttgtggtagtttgtgacagcaggtctggaaactcatgcaggagggcaggttgaggaggatggagcaggtacttggtgtagtttggatgtgtccccaaacattcttgcattggaaacttaatttctgccctcgtgagtggattaatgttgctgtcacgggagtgggctccttatcacgtgagtggctttcttatcaaagtgagctctctttggctctctggctcttgccctgtcaccatgtgatgccctctgcgggttttgacatac

SEQ ID NO: 28381 - DNA, 1030 bp, Homo sapiens
ctcatttatttaaagagaataggaggcaacgaagtggccagctgtgatggaaactagccctgctctgtagtagggcttgatccacactccaggggcgacgggggctgaggaggggagcaagacggccggatagaggcctctgccctgtgggtgctgcttactagccttgcgcactcccttaatggaaaatgtgttaagaatggagattgtgcctaccttgcacagctggctgctggggtgagcggtaacacccgtgaagtgaggccagttctgcgtgagttcaggatcctccttgacagagtatttcctttttttttctgtaacaatttctaattttccctccatttacaaaagttgaatgttttctttatgtaaatttggaaaataacagacaaatatacgaagaaaatgtcgttgcttttgctagcaggaagaggttccctttttttgtccatggccttcttatgtatagatgaactgcagttatttccttgctcctatttggacatttgaattcttcaaaattctttgcaattgcagcagtttgtatccttatacatacatctttgtgtgtaaattcatacaagtagaattggaaggtcgaagatagacatgtttttaaagctatatgttgttaatttgtcctccagaaaggtcttcccattttcagtcatgctagtgatgcctgttttcctgcacctttggtaagaaaaaagtatgatacttatatattttgtcgccaaattagaagaacggggaagatactttcttgaaggccataatgtgtttgttacaatgattgcccaagtgattttttgggggggtttggaatgtgtttcattcagcgtttgaccttttatcaccttagctgctggttatgtaacagaccgtgtgggcctagcagggtcaggactcctccagaccccaggggagtcaccagcctagcctgtggcacggaggaaccgtgcatgggacgccgtcggagttagctggccggtttgtgaacagaggctgtgtgtggccaacctgc

SEQ ID NO: 28382 - DNA, 1183 bp, Homo sapiens
ctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccgg

SEQ ID NO: 28383 - DNA, 1024 bp, Homo sapiens
cacttgttcaggagggacggggtccagaaaggagagggaaggaccagggctgagctacaacgtgacttggggaggttttgagggcgggggtgccatcagggtcaccttcgtctgctgatggggaccgagggttccttagaggaggaagcagcaggggatgatgggattcgggtgtgcctggcggccatgccgcgcctcccgcacctcctctgcctcccatgggcactgctgtctctgggtgcaccactagctctgctgtggggccagctggcgacagtggagatgctgtgtgaggttcctttggggtcccgagcttgggatggaggcgggcagcttcagggcctggggtggagagggagagggcaggtctgggacctcctgcctggatctgtggcctgtgtcctggagcccagagcaagctggggtggcagtctggctctgcgctcctcctcacaactcttctctctcgtcaattcaggtacttcttcaataaagaaggggattttaacaacctgacagctgcagcatttcataagaagtctcacctcttggtcactggctttgcttctggaatcttccatcttcatgagctgccagagtttaacctcatccactccctgaggtaagcctttgctcgcagtggggtgtggttttatgcactcactggccctgaatctgagggcccagccaagcctgcccttagcagtgggggcagcagagccacttggagcgccggctcaggccacaggacggcagcccgaaacctgcccggccgctggtgctggtcagtgcgacagtgttgccgcccccactggcagtcagcagcattggtctcgggtcagtcacagcctttcaagtttttgtctccgcttttcttcatctgtgagacacagagaacgaaaatactatgctcataaaattgtgaagttgcaagttgttgaaccctggcctcccctctgggccttctctgattcttttctttgagacagagtcctgctctgtcgcccaggctggagtgcggtgg

SEQ ID NO: 28384 - DNA, 1051 bp, Homo sapiens
tgggctgggccatctgtttggcagctcacccggaacagcctccgcggccccagcacgggcccacctgccgcagctgcagcgagggaagggctgcttctgcctccgctttgtgcaggacccaatgagtagaggctgctgctcttgatggggctcccacagcaccccccagccagccgggagaccgcaggatgacttgcttcgtggggagagcagcctggatatgctgtccagtgatcattaacggttcttttttccccaggtgacatgagttctcggcacttcaaacctgagatcagggtgacctcactccgcttctctcccactggtgagcactgagccatgggcttttggtgccggtgggcactggggcatctgtgccatagcaaggctggccaccatggagctgtctgcaggctctgggctgtgccctgtgcccctgggtaagaacatggccctgcaaaccctgcaggccacaagatggctgttgtccctgaggatggatggctgtcacggtgccaacctcagatgcactgagctttgaaacatggcaggcctggtatgcccttgctctagcagctccccgagtgccctggacgtgctgcctgggggcggctctgccatcacggagagcccgtctcctgcgcactgcccccatcctctcgcagtggggaggagggtctgtgccacaggcctgtggagcctggcggtgcacatggtccccacacagaggagccaggagcagggctattggcaagcgtgctccagcctagactgagtgtcagagccaggggcagagaggcccatgtgagccaggggtctgtgccctcgggcccaagggccaaatctggctggccacctgctttggtcactgatgttttactgggacattttactgggcgtttttttgttggcggatccttctggctgtctctagtgatccgtgcagcactgagtaggtgcagcagagaccacagggcctgcggagctgaagacgcctgagctagacagaagacttggctggctcccggcgtcaagagaggaggacgcatgc

SEQ ID NO: 28385 - DNA, 1111 bp, Homo sapiens
ccgggggcctcgagaaggcctctccaccagtgaagtttactcttttttgaacagcttagagaaagcatgtattttattttatttttactttttgtcttttgagacagcgcccagtctggagtgcaatggcgcgatcttggctcactgcggcctccgcctcctgggttcaagcgattctcctgcctcagccttccgagtagctgggactacaagcatgcaccaccacacccaactaatttgtgtatttttggtagatacggagtttcaccatgttggccaggctggtctcaaactcctgacctcaagtgatcctcccgctttggcctcccaaagtgctgggattacaggcatgagccactgcacccggccgagagagcttgtattttaaataccctattcttggctaaaaaaaagcaaaaacgacttgcaaaacccagggagacgctaagaaagaacagtttttaagtgtcgcttatgctgtcacctagagcctagaaatgacttagcatttcacttgagtgtttttcaggacacacacattttgaaaacactgagatcacactcacccgtgttttgcaaatgtttctgacgcatgggaagtaattcccattcattcagttctcaacatcattttaacagttgcgtggtatttctgggtcctagacaggttactgtttacgtaactggtcagctgttgctgagtgcttggtggcctgatttcctgtgctactggaaatgactgcaggccgaaccagtagggcaggaggccaccacgcgtgccaggtacctgtagttcccatgtggttcagggtgaactggagaggggagagctgggtggtggcgaaaggggtgtcaggccatggagagtggcctgaggctggtggctttgtgggtggcccaccttggctggttggagttggcactaggcagagtgagctgggggaaagggccaggatgtgtttcatgatttggccttggtgggatagaaaatagccccagaatagcttgagccctcccaggcagaacggcagggtcttgtgtctggggtgtctgggtggatttcttatgggtagcggaacccaagtgccagggccaggtgctgacctctccc

SEQ ID NO: 28386 - DNA, 2022 bp, Homo sapiens
aggagcttctgttgcccttgcccttggggagatggagctgcctggcctgtggtgttgtcctggggtctcttgtgtctctcccaccatctgtgatgggaaagttgagggagactagaaattgaactaagtagtgaccgaaagccccgtcacaccgtctgtgcacgtggcactctgagcacactgctgcttctcactcttggtgcttgcagcaagcaactggaggagggcagccaggccctgggtgtaggtagagcactcagcagccggggacccgcacgcctccaggctgtgccctcagtggagtcacccggcccccataccccagtttgcaaagggagctgttgggaccagctgatctccatagcccacttctgagggtttgtcatagtcgtaacccaccaaccgacagtgaattggaatgggggtgtgggggacgtttggcttggtatggaaccaactgtaactttttgcagagcaagtaagatattaatatacattaggaatttgctcctggtacttagctaaaatcctgtttttaaaaatgtgttaacacaaatctgagtggggcacgttttgaagagttgtctctggttttcccccgtgcaggatcctggtgcacctgagccgtggaggggctgaagtccagatctttgctcctgacgtccctcagatgcacgtgattgaccacaccaaggggcagccgtccgaaggcgagagcaggtgtgggggtgggattggaacttgcttcttgtctacctcccacggtgcagcctttttttgctggcttagcttaaaccaagtcttgtgtgcaaatgaacgtccttctgagcagctgtgctcgggctgttccagaagtaatgctgccaaggctcaggagtgccttccttccagtactcacagaaggactgaaaatggcgaccggatcgcttcccactgagtcaggctgctcataccttggtcttaagcaaaggtggtggttctcagcttggtcgcccaccttcttcccctgtctgggctccagatctgttttgctggttcccagcagcatgtctgttactgcggtgtgtgtggttctggcctgtgtggcctgagatccccttcccttgcctgtcctgcctgacagccctgtgcaggccattccaaggtgccttccaactggcctcggaccacgagaggtcggagctggagattcgaggaagaagccatagctgcctcctggggctgtgcttctcaccagtggggacccctgtgatttcttttcctgcctgggaccctggcttctgcacctggacttgcaccttcggcccccacacctgggggctagcagcttcctgcggtggctggccttcgggttgcttcactggtcctgagtcctggcttcttaccttcccctctgagtcccaccgtcctgatgagtgcacagaattctgtctgctttagacactcggagagacttccatttcccatgggccttgactgcagaagattcagagtgatttggcgcaggttctgaagtgctgatcggaagagcccagcatagatttagcgttgctagaaccatgttgtctttccaggtagtgaccaaacatgctgacctggaagtaagtccccgtgtggctgagagccacgtgtgtggagcgtgttgcctgtgggctgtgcccctgccgcgctccacagtccttcacctgcatgctgaggctttttgccctgtgctctttcccaggaatgttttgaccgagtctgcgaggatcgcccgtggcaaaatcacagacctggccaacctcagtgcagccaaccatgatgctgccatctttccaggaggctttggagcggctaaaaacctgtgcgtatttgagctccaaggtcttccgctttccatgtggagcagatgggaagggggtgcacctgtctgctgtccaatgtggtcagtggagcggcgatgggagggggtggtgataggagcagtctctgggtttagggtctgggcagggcacgtgcctgccctctgacttgggagctgtt

SEQ ID NO: 28387 - DNA, 1050 bp, Homo sapiens
ggtgtgctgggggctccgtgccctggcatggctcctccacattttgccaacccagaggcacaggcgtgaggtgtgtggtggttctcagggtcagtgggtcttggccttggctttcaaggtgttgatgggccctgggactgatgtgcccgtgtgtctgagcccacgtcccctgggcgaagctcccattttcactgacctgtccagagcgttctgggtgagcctgccctgcgtgtccatggtgcggcgcgctctaatgagctgcagccgtggccactctgcaccctctgagacagtcacccatggggacggcgaacacccactgcctccagaagattcccagcactctgccagcaaagccatgtggaaaatgctggggcagaggactggggtgcgtgagggtggcgtagagcccaggggtgggttcgtgggaaggtgtgtccacttgtagatttggtggcattgccagatcacacgccccatgggcagtgtggagagacctcccctgccccgcgtgccctccacagctcctgctcctcggcctgaggtgtggatgctggtgtcgcaggtaaactggcgtttctttcacggtcatcgaagcaagagtgcttggtatgcctggaggccgactgcgtttctttttttgggaactcctggagtttcctgctgcccctttgttttaaggaaaaactctcacaccgtgtttctcctcctcccaccacaacagttgtccacacagaaggtgggtgtgaagggtcttccccatgcaccacgcaggggtcgctgctgccttctaattcagttccaacagtatggacccggggtagcgtccgatcgcacgggttgagggctccgtccccaaaactgccctctgacacataccggtaaactgtctgagcctctggaactgaccaattggcttcaagttggggttcccacaaccccgtttgctggcgtggctcacagtgctcagggaaacatgacgtcagcattctcccccggggagtgggggaccctctcaggagagggtcctgagacccacagtcagaaagg

SEQ ID NO: 28388 - DNA, 1900 bp, Homo sapiens
gccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttagactttgtgctgcattcatctgtgtgttcagggttgtttggggaagaaaacatttggggtgggagtcaggtgtctgcacgcttcactcagtgtcacatatctgttgctgtttgggtctgtctctgcctgagcagccagggccaggccagcctgagaggccccacgctgggtgggtggcaggagctgcccagtgttgggtggcggtgtgggaaacgcccactctggctgctggcgtggctgttccgtgtggtctggtttgcacctccctgtgtgtcaggtgctgggcccggaatgggggtgcaggccctggtcccacaagactcgaaccctcaattgcactggtacccaccacaccccctcggccctccccacccactgcatggaatcagcggattcattctaccgccttgagagggcgtggggggcccatgggtaaggcaggaaggccccggtgcaccctgcatcgggtctcagccggacacttctggttcttcctccgtgggagctgggttctccagtggccttcctcccacggaggccgggcctcaggaagtcctcacgggcgcccacgcccgctgcaaacgcccacagcactcgccttggggccaggattaccctgtccccagcagcggaggagcctcccatgtccagggtaaggtggggctcctcccctttctcataggctggtagggacacattttgcatggctggagggggggtacccgtataccacgcatgtttattcacgtgtgtgtgagtgtatggaaaagtgcacaagtcacaagcattcactttggggtttccacaaagcaaatacgcaaaaccatcgctcgggcctggaacggtggcactgtccccagagcctctcagcctcctgcaggcactggctgcgtgcttgtttgcgcgctctctctgaggtgatccagtgtggcgccccacacgcaggtgcttctgctgggccaggcctgtcctcacctgcatctgcccttagcccaggtggccctgtgggtcctcagtgtccccacttgcagatgaggctttgctccccccagggccctgcagcttgtagggcttggctgggactcagctccgggcagcgcagcaccagaaccccagccctagaaatagatcttgggacgttgggaagcccagagaggggccgtgacagaaccggagagcttggtcctgggttcactgcaggagagtttggtcctgggttcactggacagtgactccgtggctgctgcgtgccaggcaccttcaggtaccaagggcattgtcacgagcatgccctcgtcctggagttcaggtgggggcagccagtatgtggcccggtgagccatggagtcccccc

SEQ ID NO: 28389 - DNA, 1088 bp, Homo sapiens
tgcaaccctgccgagtccaacggagcaggaacccagagtcaggtcagagagaatcccaccccgatgtctgagctccaggagcagatcagacctcagtcctcgacgccttcagcaggatgccccggccctgccgcaccctcctggtgattttccagccacggaccccctcacttctcggctgtgaaccccccttgtcctgctgcacccaacatagagcccgtctctccctcactgcgggagtccataatgaagtcttccttgccattacgataagcaccaggataatttttccttaacaggttctctctagactggatcagggacagtcttggctgtaaattgtgaattagctgtgactctgccacccacggttgcccgccagagttctttctaaatgttctatctgagcctggccgttgctcctggctctggaggtgccagagtttctgaacgttaatctgagcctggccgttgctgctggctctggaggtgccagagtttctgaacgttaatctgagcctggccgttgctgctggctctggaggtgcagtcacaccaccctggctgacacgcctcggcctgacctgcagtctcaccccacagaaggatctggggtgaacgtctggctccaggcactgttgcagggctgttgggtcctgtgtctgagcccacaaaggcttcctgggagcggcatcgccagccctgtggaccctgctccctatgggcttctgggtatagatcaggtgcccagcatgcgcccccagacaggagctgccctctgccctgcctctgggacccactttcacccaagtcctgtgggactggcatagcctagggcccgggtgctggcagcgtctggctggagcctggggcggggcagggcagggccttccaggcgcgttcccgagcgtgcactgaaggtgttagcgcgtggcaccggagacaccaggctggatgaggctggacaagcgcctccgccagaagcagcacaggcctgacacaggcaaacctcccggagaccaccccacggaccccagcccctgctgaccctcccaggaggcgttgctggaaatccaccctgagaattc

SEQ ID NO: 28390 - DNA, 1219 bp, Homo sapiens
ggggctgtgggtgggaccccatccccctctggctgcagcaggcagtgaagctgcatcaggggctccaccctgctgaccacagtcctggggcacccagtggaggccggagacaccagcaggttctcctggtcacatggccccacctgccctgtcccccagagccccccaggcttgggatgagttgcgaggggtcggatggacggcgcaggacacacgacacagagtagttgtggcggttgcccctagggagacgtggagagaggccccagggcaccctggaagcggaggctgtggctccgtgtgtcccagggcacagcaccgcccctcacagccgaagctctgatcccttggtctcaggaaacactcaggaagtgcagggcgggcgtgggtctgatttcagggtgagggagctggcagccccaggagtgaggaggccccagtcccctttcaccaagcccgtcctccccttcccgctgccacgacactggtgcctgcagccgtgccagctaggagggcgacgtggacaggatttctctctagaaaggatcctggggtccgattgagaagctggcttgaacgttagacgctgtagctcagagcactgggtatgcacccagaaggagaagtgctcatcacatggtaattcttttgttttgtttttttaagaaaaaggtctcactctttgcccaaagcaactttcttatttatctttgcatcttaagagtctaaaacaatgactggcatgaagtatacaaactatacatcgcctagtaagtggataaaacgattaattaatttgcccaacattcaaaacgtgatggggtgggattcacagccatgacttctcattgcaacgctcaagctccttgtgctgctccacgccgcctttcggtacacgagaagctgaggatccacgccgcctttccgtacatgagaaactgtaggatccacgccacctttcagtagagaagctgtaggatccacaccgcctttccgtacacgagaagctgtaggatccacgccgcctttccgtacacgagaagctgtaggatccacgccacctttcagtagagaagctgtaggatccacaccgcctttccgtacacgagaagctgtaggatccacgccgcctttccgtacacgagaagctgtaggatccacgccacctttcagtagagaagctgtaggatccacaccgcttttcagtacacgagaaact

SEQ ID NO: 28391 - DNA, 1046 bp, Homo sapiens
tttgacctggtatattgtgactctgccatggcaccacatgacagacagcagacctccttattttaactcaagcattcctttctactgactcccagtttttaggcaaagctcaactctttcaaccaactgccaactaaagaatccctaaacccacctataacctgtaagcttcaagatatctcgccttttggggctgatccaatgcacatcttctatgtattgatttattgattgattgattttttgagatggggtctcactctgtcacccaggctgtagtgcaatggcgagatctcggctcactgcaacctctacctcctgggctcaagcaatcctcctgcctcagccccctgagcaaccccaggtgcacatcaccatgactagccaacttttttgtatttttggtagagatggggtttcaccaagttgctcaaactggtcttgaactcctcagctcaaagtgctgggattacaggcgtgagccaccgcgcccggcccgtgtactgttttctgattccacctgcagttcgcatctccctgaaatgtacaaaaccaattgtgctgggagtggtggctcacgcctgtaatcccagcactttgggaggcagaggcgggcggatcacgaggtcaggagattgagaccatcctggctaacacggtgaaaccccgtctctactaaaaatataaaaaaattagccaggcatggtggcgggcgcctgtagtcccagctactcgggaggctgaggcaggagaatggcaggaacgcgggaggcggagcttgcggtgagccgagatcacgccactgcactccagcctgggcgacagagcaagcctccgtctcaaaaacaaataaataaataaataaaataaaaataaataaatacataaaaccaaattgtaactgaccgcctcaggtgcacttcctcgggatctcttaagactgtatttcccaggccatggtcactcttattggctcagaataaacctatttaaaaactttggcagaatttggtttttctgtctgtcctcacattgcccttagagaa

SEQ ID NO: 28392 - DNA, 1061 bp, Homo sapiens
gcgtttgttggatgtatggaacagccagcctcaccatcctgccagtgttgcccagtcctgggacttctcgggccttgatttccccttctgtgaaagggggttggggacaagacaggccaccttgcaagttccttccagccagcccacaagtcctgtcctgtgtggctctgggtcacgcctttcctgttggccaggggttggtgctgttgagcaggggagggcgttgttcaaggatatctatttgcacaataacctgtgcaaaggtagctagaagacttgaaacaggccgggcgcggtggctcacgcctgtaattccagcactttgggaggctgaggctggtggatcacctgaggttaggagttcaagaccatcctggctaacatggtgaaacctcgtctctactaaaaatacaaaaaattagctgggcatggtggtgcgcatctgtaatcccagctactcaggaggctgaggcaggagaatcgcttgaaccaggaggtgcaggttgcagtgagccgagatcgagccacggcactctagcctgggcgacagagcgagactctgttgcaaaaaacaaacaagaaaaaaccccaaaaatcagccaggcgtggtggtacatgcctgtagtcccagctactcgggaggcagaggcaggagaatcgcttgaaccggggaggcagaggttgcagtgagccaagatcccgccactgcactccagcctgggtgacagaacgagactctgtctcaaaaaaaaaaaacagacttgaccaaaaaaaaaaaaaaaaaaaaaatggcccggcctgcctatgcctaccttcatctcgccctggcctgggcacttttaattctctgggccctttgtctagtgccccctccctgcccctgcaggacaccgtgccctgcctttccctggctggtgtgtttggacgttggtttcctgttatcgcaggtgaggacttagcttcctggcccgccacgcctccctgacatggcctcctgtttggagccttcaggctcatgcttacatccttagctgatcattaaactttgtgaccatttcatg

SEQ ID NO: 28393 - DNA, 1045 bp, Homo sapiens
acagtggcttcagggtgcagggtgtccggggagccctggctggtgccagcgatgcggggcccctggttataaggatgagcagatggaagctcacaggggccccaggtacctggcccaggctagcccgggcaggcccctctgccctgtgccccgtggagctgcagccctgtgcgtcttcccgcctggaaggcttcaccagacacaagggcccagccccagctgtgtgtgtgctgggcccagccccgagggcccccttcctcccctgctgcccttcccaggctttcgggcagagccctcttgttcaccgcctccaggagggcggggcgtcctagtgggcccagcctcatctctgccctcgcgctccaggcctgctttcctcctgctgggtggggattgtgccctggcccatgtgggttgggaatggtggccccagggagggctcctggcacccgggggctgtgtccggggcaggtttccctgcctggcagctgagccctgtcgtgtctttgacccagactcggagccgtgggtcccgactgaacatcatcatcatcgctgagggtgccattgaccgcaacgggaagcccatctcgtccagctacgtgaaggacgtgcgtgtgggcctgggggtggccactgggcacctgctcctctaggccgtgtgggctggggctcagggctggtccttcccactgtcctgcagctggtggttcagaggctgggcttcgacacccgtgtaactgtgctgggccacgtgcagcggggagggacgccctctgccttcgaccggatcctggtaagtggccatcaccctgccctgcgtacgtgcgtgggtaagcgtggtgtgtgggtgtgggtgtgggcagtgtgcacgcgagcatggcacgtgcactgtgtccatgtggctgtgggtgagtgtccgtgtctgtgtgtgggggtgtatgtgtgggggacgcgtggtccttgtgggtgtgtctgtgtgtgtctggtccgtgtgggtgtgtgtggcagtgtgtgtgggtgtgtgtcagtgtgggtgtgtgtg

SEQ ID NO: 28394 - DNA, 1063 bp, Homo sapiens
tgggtttggaggcctgcaactggggcagagtgccctgcctggagctggagctgctgagaggtgaggagggcagctgggggcagggtagggcctcctggtctcagccagccccagaagagctggccttggtggtgaccgctgttcctagggagaggctgccaggcctgggccagggtcaggagatgccggccagatctgccctcgtcaggcccaccagacagggcagtagccatgggtgtgcgggccaggctctccatagtctgtgttctgtttctcttccttaagaccaaggaagtgcagaaagccatggatgacaagaggtttgacgaggccacccagctccgtggtgggtaagccccctcagcagacccctgcactcttacatggctgggtcccggtgccaggcagcatgtgctgcagtggcgctatgcacgcctggcctgggtcatccttctaggcaccgcgtctgaagatcgagggaggaaggggcctgcgggtggtacaggaggcgggctgggaggtgtggtaccacaggagaccctgggcggtggcacgggcagggcccagtgcacagggatctgggcatggcgaggggatgagaagctgtggatacaagcccaggacatggggtggccccgcgggggctgggaaggctggcagatgttgggtgtgggtaccacccccctgcaggcgtcctggcggccgggtcaggctggattggacgtctgggttcccatgcgtgcctccacccgctaccaaggtggccaaccctcccttgagctggatgccggccacgtgctttgctgcacgggctggcgtggcctcgtgttgtgttgggggtctcgcaccttctgtggaaggtgccctgcctggcatgcgcggtgtctgctgcctcatggctgagcttccatcgggccgtgtgcctgtgaccagcctcctgggctctgtcacggctgcgctgtggctgtacgccgtggcgctgcagggctgtgcatggtgtgacccgaatcccttccaggagcttcgagaacaactggaacatttacaagctcctcgcccacca

SEQ ID NO: 28395 - DNA, 1065 bp, Homo sapiens
caccctaacccaatcctcgccctaaccctaatgctaacccctgacccgacccaatcctaaccctgatgctaacccctgactcaactctcaccctaaccctgatgctaacccctgacccaatcctcaccctaaccctgatactaacccttaacctaacccaacccagccctaactccaactctaaagctaactcctaaccctaggagaggagcccaggccgggccctctccctgctggtttcctgttgggctttggagccccagatgcctgcccagaggcttccttgtgcggggtggggtccagcagtgggggatgggcccagagctggtatagccaccagcagagccatcctgatccacaggaccatccctggtggggtggggccccctggggcaggaaggccactgaggccagggagactcccaggcccactcacggcgcaggccccacaggagctggctggaggctatgggtgcggggcgtgggcctgccgggggttgcgtgacaggcagtggggagtgggttgtgctggcagctgtgggtgagtgaggaggctcctctcatgaagggccctggggaagtggaatctggccctgagagacccccggcctcctctgcaggggctgctggcaggaggggaaccggggaccacctcccgccacagagcctggggcccccagccttgcctacagggagggtagatgagagtgtaaactgcatatgaggttgggctaaacctggacatgtgtttcataaccaaagcagccaggaatctccggctctgcccagtgatcatctgggcaggacatggggacgagtgtccaggctgaagtcagggcccggccagcagagggccattttgtattgagctccacagctggtcacattctgtggaatgtgcagacgtgcacggcccatcagacagggtctggagtggggctgccgtcttgggcagctcctcccgggtgtctgcaaaatgcagaggtcaccagagccaaggcagcaaggcaaggagcccggcttctaaggaactctgagcaggtgtggtccatggctgggaggcag

SEQ ID NO: 28396 - DNA, 1029 bp, Homo sapiens
gtgaggtgagcgattttaacccacatccttactgacttcacagcacagtaggtgcttcgtggctgtccggtgcaaggatgtatatacacacacacctttgcaaaaaaagtttgcatctcttgcctggctgtttgttgcaataatctatcatttgtcttttcctttccagcattgcagatgatcccttgaaaagaagtctgatcacattcacactctgctccgcccatttcactcagtaaagctgaagtcctgcagtgctttgctctgcctccggtcaccccgccatactcccagaccctccctccctctcactccactccagctgccctggcctggttcagagtccctgactcttccctccccggaaacactttctggcggctcttgtccccgactcttcccacctgctctttcagtctttgctcaaatgttgcctcttcagtgtggcctaggccgtcaccacccggccttcaccgcatacctttttctctgcaacacctactcaacacaccgtactatagaacttactggcatgctataaatgtattacccttatctgttgcctctaaccaaaagcgtgttccatgagagccatgggtccctgcctacttctgtcttgtttctggggcagcctctgtacctggacatcgtatactcttaacacggatttgtcaaatcaaatgaaatttaacaatacaaacttcacaagtatgcatagtgtaggaaaattccccaaaattcaaaatttcagtctacctccatcttttcaaatgaccacagtgctttataaaatgacatggtcctttgagactgtttcagagagtaatttgtgcaaatgcaatgtgcaaaaagtcacagtggaggtgtttcctcccccattcaagagctgctctctctctaatcagacagcaccccacaccccaaggcagtctgtccagtgctcctaaaggagagcagctccccttttccagttatgggagatgtgggcaataaagcattactgtcaatgccgtgatgttcactgcaaca

SEQ ID NO: 28397 - DNA, 2040 bp, Homo sapiens
tgggcgacagcgcgagactccttctcaaatatagaattttaaaaaggccatctcgactgccgcgggggtcgcgtcctctccatccccgaccttggacgcaaccccgggcttgggtcccccacgatctagacagaaactcgttgtttctcgtgctccgcgccacccgcgtcctccggtctgtttctcccaggtgcgtcggtgaaaggcggagcgccgccaccctacacccgcgaccctgcgcccgcccgagccgcttccgggtacttccggcggccgcggggctcccggcagccgcggctcctgtttccgccgggcggcgagaacgcaggaccagcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggtgagctggggaggcgctggccgggggctgccgcgtgggtccgagggcgggtgagctgcggggcgccgcctccgggagggttccgcgaccccggccttccctcgggctctgcgggcatttgctgcgctacagacgcgaccttcttgcttcgcgaagcgtcgtaaactccgaggctccgctctgcgctgccgtcctgggcacacggactcgcgccgctcccggggaggggagagagccaggaacctcccgctgcggtccagggttgccacgcggaccccagaggttcctgaatcgcactgagctccccggaaaggaaaggacgttcccagagttagagaagaacggagagcaaactgaagagagaccccgttccctttagcagtcggctggcctgtttctccatccccctcagccctaagcaagcacgaatctaccttttgtctttattctagacactgcatgtgagtggaattattgctttcaggatttttttttttttttggcttttgccttaaatattttgaccgatgtgtcttggtgtaggtatctgcatttattttgcgtgttcactgagcttcttgcgtgtgtaggttaatgtttttcgttacattggcaagtcttcagccattatttccttgaatatttttttctgcccctttctgtcactcctctctttcggatacttccattataaatatgtacgtcgtgcttaatggtgtcccacagtgctctgaggcgctgttcactcagtttttctcttttcttcagatggcataatctatcttaattcaagtttactgatgttctgccagcccagaggtgcttttgaacctttccagtgaaattttcattttttttgactccagaatttatttactttctttctcttctcctgttcctcctcattttaaaaaatactctttactgatgttttctgtttgatgtgagaatgtcattataccttcgtttagttctttagacacggtctcttttagtccttagaaatatttataatgcctactctgaattctttacatgtgggctgctcaaagcagtttctgttgcctggctcatgctggcaggtaggagcaggtgggccttctttgaatgtatcactttttgtggaaaattgggcattttggatagtcctgtagcaaccagggattagtatctgcttgattactttgtttattgatctggaactgaactatgtgacctctctccttgtccccttctggctgtgtgcagcctctgatgtgcccccttggttttttttttttcttcctgtttttctcttttagcctggctagttggatctgcttaagctcctcactggtcagcaattgttcttaaagcctccttggccagggggtttttgccttttaccactggatacctctggcttggaggtggctgtcagattcagcgtgttcacatttttgaccttcatttctgccctcagaggcacagccaaggactagtagcttacagagtccctctgctcactcctggtagggtgcgtccttgaacatg

SEQ ID NO: 28398 - DNA, 1017 bp, Homo sapiens
aaatcttcatgcagggatgagtgtggctcagaaccagacctggcagagaggctgctgagatgactagttctgatgggatgtggtcagtctgagctgaaagagctgtcaggctgggagctgcctatccttcatctgctcagctgcaggtttcttctgtgacacaggagaatgttgtagaaagagtaagacgaaatggttgggaaggaaatttggttcttgagatactggtcctgactcctgaagaaccaggagtgaagcccgtctggtgattgaaggcagggagcaggtgggcctgggcgctgcgggtctgccctggagctctggaaccggaggcttctgctctgggaggtgagggttgtttcccccaggtcctcccgggcagagaagctggggaatccaggttcttgtcttgcatcttctcctcacctttaacgtccctctgaaaccacagagcaagtctcacacctcttcttttcgtccgtttttgttggggacattaggactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgaggcaggctcgacgggttaccatgctgatacccagcaggtctgggattgttccctcaggcacccgaggtctcagcagctttccagctaacctgtacctgacaatgtccttgagcaagggatgcccctggctgtttcttggggcgattccccagagtagattacagctgtggttttgcccctgggctgcatcatgtctccgcagctctgcaagaactgctctgcgtcctggcagccacgctgaagccacaggaacttgggctttggtgaccaacagggtttgaactgttttctccgtgtgtgctgattctttcggtctgtctgtatgtttggggcagttttgatccttttcttaaacaagt

SEQ ID NO: 28399 - DNA, 1050 bp, Homo sapiens
ctgagctcgtgctgacagtagcgtggcccgttctggcgcttcctgcttgtgtgcaggtgtttcccatagcccgccttgaggggcacgaggatgggaattatttgagccgtgcggcagggtcagggttttgggtgttggggaggagccttggcctggggaggcacttagtgcttctggccaggagccggtggctttgtgcactgcccatggctgtgatttctgccttggtgccccagggggattcaggagaaggtgctccaaaatggtgccttggaggttgtccctgaggtgtgttccaggaggctgtcctgtgggaggggcgttctgagctcatcgccgcgggcccccattacagccctcctggagcgaggcctctggccagccgtctctggctgtggctctcagcccagggttctggtgcatattccttccaccgccctgctgtgggttttctgcactgaagagccccgggctggatgaaggggaccatgggacctcacagagggctcagacggagggacaggcctccacttcccctgccctgggatgtgaagcaccagcttggcagggtggcagggcccacagaccctcatgggtgggacctgcagacccttagaggagtagccccacaggcggaggggcttgccctggtctgggggccccagccccttttcttcaggcctccgaggtatccaggcgcctcagtggggtcctttgcatcttggctgctcctcaccatgttcctccctctctccaggaacagttctgtttttttggtgtggtctcctcagctcctgattggctggtgccctgcgtccctacccccaccccaccccgggtttgtgctggggcctgagtgcccatgtcatgcagatactgcatcctgtgacttggccgccacccttcaatgacccgcctggctatggaggtgaggtggcggcctgtgggtgcctgtctgcctggcttagtgcaacaccgccttcccaagatgtgtctcatcgtccgtgccctgcctgagtcaggaatagcactgcatgctgcgtctctggc

SEQ ID NO: 28400 - DNA, 1096 bp, Homo sapiens
attttaagtttgatgggaagccttaagggagcctttcttccttccttgcgaatgacatgatctgatttatctttaaaaagtaccactctggctgttgggcttacaatatgccaggctgttttaagagctttacatatattaattcatttattcttatgacagtccaaaaagtaggcattattatcattattcccatgttacaggggggaatacctaggcacagagtggttaagtgatttacccaaggtcacacaggaagtggcaatggcaggatgtacccttacctccttactgcagcttgctttttgcacctccactactgcagactggaggaggaatatcagcaaggagatcagttagacttttgtgaaagctgggtgactgtaccggcacctcagaccagggcggaagtggtgagatcagattcagcctactgaatttcagcatttgtaagatgccatcatttttaagttgcatcatcatttcttatgctgctaacaaagggaaaatgtagccaactagattgtgacacaatgctttcttgttacccagcattcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaagggccagatctggaggacgagggttgggtcattgtgcagctacttcctagatgatcttgagcaagcagtctaatctctgtgcttcagttttctcatctataaattaggaagaataaaagcaacttgtcagggttgttgagttgctaatgtaaagtacctaaaatagtacctgactaacagtatttaatggggcttactttgcttattatttttatgattagttatctgagtagagaaaggtgaatatggatggaaattcaaggtcaggttcaagaa

SEQ ID NO: 28401 - DNA, 1033 bp, Homo sapiens
cccccagaggaaagcaggtattgttgctttgggcctgttgcatgtatatgtttatgttccactgggtcagcagcattcagtgaaacacagttgcctgttaacttggtaaaatatcttaattgcatgagttttgatttgtttttgtgattatttgattttttcaggtttggagtttcagaacacccatcttctcagtagttcagccaatgcgatgaaatgtgaagaagccttccccagcttccttgcattctctccatcatctgtgcagtggagagtagttcccactgctgtggaaacattttccctttgctcttttctctcagggcaggctttcctgagtgcctgctctgtgtgagtcatcgtgggaggatgcggtggagaaggacagggaggaggtctgtgcttctttgaactgacattctggtggagaaactaaacagatcacagaggcagacaccgtgcctcacaactacacacggacccggcttatgatggttccagtaacaatttttgacttgactgtggtacccatacagtcattctgtttttcacttttggcatagcattcaataaattgcatgcgatattaagtactttgttataaaataggctttgtattagatgattttgttcaattgtaggctaatgtgagtgttctgagcaccttttaggtaggctaggctaagctttgatgtttggtagggtaggtgtattgaatgctttttcaggttaggatgtcttcaacttgcgatgggttcataggatcggaactccaccgtcagtcaaggagcacctgtgctgtctttattggcatgaccgaggagacagggctgaggtagatggcatcaagagggtggctcctggtggaggtatgatgttctgggaaggcctctctgagtgcgatgtggtacgctgaggcccagagggaaagcatgagctcatgtcaggaggggggacaacagccttctggctagaaggatagcctgccagagagcctgcttattagagtggccaggataggaccagaaccatt

SEQ ID NO: 28402 - DNA, 1035 bp, Homo sapiens
gggcagaggtggcagaactggagaaaagagagcaggtgtgaattcttggttgtgggcaatagatcaggtcttggagacaagggaagtggagggaccaagaagggctcttggagctctttggatggtgatgatgtgatgatgccacgttccagaggatctcaggttaggagtcttcaactagagacctcattttgtattgggttctgtttgagtctgcaaagcagttgtcatctaatatgtgactagcagaatatttgtttgtatagatacctctcaacttacgatgaggttcataacttaaatatattgtcagttgaaaatgcatttaatacacctaaccttcaaaattcaaagtacactttctattaaatatgtatcactttcacaccatcataaagtaaaaaaatcataagtcagactgttgtaagccagcgtctgtctgtaccttcccacggcctacaaaatttgtaatgcattgtttgtaaaacacagacacgtgcatttaaacttttattaggtagaactggctcttcttcagggtccttgtaattaagtcagttattcctctcatgacattcttgtaggaggtctcattacccctatttatcagatcagaaaactgatgctaaggggctcagtgacttcctaggaaagctggataatgtttaacatttattaagctcttaccatgtgtcagacatggtaaagtgagtttaatctagtttaatcctcatgatgatcttaggatgttgctattaagggtcactgtcatcatccctttttactgataacactggcctggcttacctgagtagcctcctaacagatctcttcttccacttctggtctccttcagtctgttcttgaccagcagtcggatctgagcctgtacatggaagacatcacgtcattctcctgctcagagtccccctgcggccttctttcctgctgtcccttcctgccactcagagccctggctccagctgtcttggggcctatagctagccctcacttcagtgttcatgcaccattgtg

SEQ ID NO: 28403 - DNA, 1035 bp, Homo sapiens
tctgtgggtgccgagccctctgggccacacagctgctgttctctgacttgtgggtttttctgccgcctcttgcgtttcatgctgtgactctggaactaggtcttaccctgtttggagtgaaggttcggggtgttgggaagttctgtcctcttctctcaggaagaggccctttgactgtgtgcccggaggaggcatgggtgcatcttttctccagggggctcctcaccaggggtatggggagactgtgctgcagcctcaggaatgtcagggtgaagaggccctggaggctgatgcttccggccaagggcttcttctggattttcagataaagtcccagaacagaattactttatgttttaatttcaggcaaatgtctctcatctgcccttttaagtacattaggattgggtttttcgaccctgcacagcacatgggggctcctcagagaagtgtctgaaaaaataaaattaaataactcgctttttagcacttcgtttttactggtgatttgttagtcattgattgaggtgattgtgattgatccaattatttgtctgcccatcctgattataactttttttatttacaggattttaaaagatagtttcttgatcttaatgttatatttaatgttctctttcataagatggttttttgatgactttgtgtttaaaaagtgagggtcttttgagaaatagaatatatcaaattatttgttcagaaacattcaaaagcattttttccaactctgcaagcagttgtctgttaaagcaattagcgtgtacccaattagagctctgttcaagatccctcactgataacctctgtgaggctgttggtccgtgtctttatcaagcagtagtgtggcttcccaggtactgtcagctcattttggacccaatactagtttattgcctgaaattacctttaaactggaaaatcttcaagtaaaatttttgagagtttttgattaatcccctaggatacttttgaatgataggttttggggagatacatttggttgttttggcacca

SEQ ID NO: 28404 - DNA, 1039 bp, Homo sapiens
tcacagtggtcagtcacggtgacagggtgtgcctgatacagtggagtgacagtgggccttcacctctgggggcttcatccccaaactcagtcccttcctgtaccatgagaaaaacatcagacagatcccagctgagggacagcttcctcaacagtcaaaaaccaagaagagtctgagaaactcacagccaagaggggcctagggagccatgacatctcaatgtcacgtgggatcctggacgactgaatctgacgaaagtgtggatttcagttaataacaatgtgttaattaatactggtccgttaaaccagcagtcctcaacctttttggcaccagggactggtgacaatttttccatgggccgaggtgggggctgggagaatggtttggggatgattccagcgcgttacatttattgtgcattttctttccatgattacattgtaatatataatgaaataatcatacaactcagcatcatgtagaatcagtgggagccctgagcttgttttcctgcaactagatggtcccatcgggggtaaggggagacagtggcagatcatcagacattggattcttataaggaatgtgcaacctagacccctcacatgcgcagttcacaatagggttccagtcctgtgagaatctaatgctgccactgatctgacagaatcagtgcaagaactgattctctgaagcccagttcctaacaggtcatggactgttacttgtccatggcccaggggttgggactcctgtattaaaccatgctcatgtaagatcttaataatagaaaatgggtgtggggtctgtggggcctttctgtcacatctgctcaatttttcttcaaatctaaaattgttctaaaaataacgtttactttaaaaataagtgttttttcaaaaacacttttttgtgtccttatcttctgctccaaataaataattatcctgacttttgtgtaagtggttccactagttttctttgatttcttaactctgtctgttacccttacacagtatatcctttggttttgaaa

SEQ ID NO: 28405 - DNA, 1050 bp, Homo sapiens
tttggcctaagtatgatacaagaggtggaaggctggtttctctgtttccttcagctgctcctgactggtcctcatctgttccttctcagatcacagttaactgaatatattttaaaagagaaaactcgtaagtgccctaaggaaataaggaattattttgaacactaaagctaaaagcattctaacattgtgttgcttttatgttctttactaaatttgcttcatgcacacacacacatatatgagtgtatttctcagtatgcagatgatttcaaggactggcttccttcgtgaaaacgtattgttggttgcaagaagataggggactggaaacatgattcgtctgtctgtagaggtgaagttccaagaagctcaccactgtccagtctttatgcttatgaacttgttgagtgagttctttttttatagtgtacccatgtctaggaattttggctgaaatcagcttctttgcttttttaggctttttgctagtgatagtgttgtctttgttctgtaaaacaactgtaaaggaataccaacaatctagtgcagaaattcttttgtaagaacaagctaccctgatgtcatgtcgtgttttaggactgtttgcttctcaacctgatgaagttgttcttagctgtttgctttgttttctcatccacagcagtattcctttctttgcctttaatgcaattgtatcttgagcaggcttgttaaatcccgtgggaggctttttttttttataggtcctttctctacttggctatgttgcctgctgagtttaaagcctttttatgatatttaacaaagccctctgtgttcagcgtgggttgtggttgtgtttaatgtttcaacctagactcgtgtattaagtacagatatcatctgtcacttaacttagccttgctctcagtgtgtttatcatcatgtctctaaggccatcctaaatacgtgacctggagagagagggggtggctaggccaaatgctgggatgcctgcactccgtttcttagccgtgagtctgtgcttggaaacccacgagaactctg

SEQ ID NO: 28406 - DNA, 1628 bp, Homo sapiens
tagggtccttccagtgggaggtacacaaatttaacttaactatagttaaacaagagccagaaaggtaaagaaggtattgttgagaacaaatacggctggatgcacttttggggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaaatacaaaattaatatgcaaacgtcaatgttattcatatatacaaaaataatcagaagatattatggaagagacaaccccattaacaatagcaacaacgagaaaatatttaggaataaatgtaatgagaactgttcaaaagctaagtgaagaaaacaataagttgagaaagacacagaagtcgccttgagcaggtgaagacaccttgttctcggttaagatggcttggctcattaagatgtcagttgtcaggtaattttcaaatttaatgtgatgctaatatttgaaagcaaaaagactcagcttttttttcttgggctggacatgtcgattctaaaattgaaatagcatgaatacctagaaaacttagaaaagaaagagccaagaaaaggagaatagctctactagatattaaaacatactacaaaggctatatggaaaatagtgtggcaaggttgcatgaagaaccagacagaccaatggaggaaataagcccatatatagatggaaatctagtatatgataaagatagtatctcagattgttgggtcaaagatagattgttagagtcaacgttcttgggacaattggactccattttgtaaaatacatcattaggatttatagcttacaccacatgcaaaaataggctgcaagtgggtcagagaactcagtgtgaaaaaggcaactgttccaatgttagacacaaacatggttgaatattacctatgtgttgggaaaggcttttttaaaggcgtaactcaaaattcagcttcaacaaagaaaagatggatgaatttgactgcattccaaaatactgcgaccagcctgggcaacatggcaaaacctatttttacaaaaaatacaaaaataatttgggtgtggtggcacacacctgtagtcccagctacttgggaggctgaggtgggaggatcacttgagcccaggaggttaaggttgcaatgagccatgatggtgccactccagcctcggtgacagagcgagaccctgtctcaaaaaaaaagtaacaactttgcctgaccaaaaacaaaacagaaaaacacaataaggtcaaaagacaaaaataccaattgtgtgaaaacctttgtagcatatcataaatgttttaaaagttgagggagaagaaacccgaaattctaggaaaatgggaaaaaggtatgaacagacacatatgcacatatacacgtacataaacatggcccatacactttacca

SEQ ID NO: 28407 - DNA, 1021 bp, Homo sapiens
aagtgttcttttaataaatattatgcttagtagacatactctacataccaatcagaggttgccatcctaaaccaaaactacatatccagcacattctgatattaggcggtggcttacaccagggaaggcttggaggttgttttggctcctaccctttaaaaggcttaccagcttttagatggagtcatagataagacatggatagtaacagaaaggaagcatggcttatcagctgtgtcaagtcaggacacatgtatccccattcacattgctgaactcaggaagatatccaagcaccattgtgacatacttgtccacagagaccgcagataaccccagcaccctctcagagtggtgccttggtgtttttgttcataaagccttgatgctcaggcccatccgtcatcccgggcaggtgcgtagcctgtgtggtggatgccagggtcaggggagggctttgcttttgcagagtctcgaggcttaggctgaatgtgtttttaaaggtccgactatactgaaacaaacattaaaaaatattcaacatcacttaatttttattgcttaagagcttatctggctctcccattggctcagtaatttggttgctattaataacgttgttgaggttgtcatcgtcaccttaacattgtcatcatcacctccagtaatagctaacatttattgagttcttcctccatgcaggaactgtgctgagttctttttctgcattattttattcagcctttgctgcagccatctgcagcaggcactgttactaaccttctcctgccagagggaacgcttgagatgctgcagggtgacagtagcctcagagccagggggctgcattgctggatcttcaagcaggcaaactgccaactctgtgttcataatcctggtcatgggctcgcactgacctgtagagagctggatatggggaatggattggagagcttttatttgaaacaacagcaaagtggcatgatcttttgggaatacactttttcaagtcatgtatcca

SEQ ID NO: 28408 - DNA, 1102 bp, Homo sapiens
tatgtccctggatttaaatatgctaattttgttatgatttttgtgtctacatttgtaaaagccgctgatagttcatgtctggcacattcttgacagattttactaccgagattatactgggctcgtaaaacgagtgggggatgttccctgtttttttgttcgctggaacggtatgtgtaagctttgtgcttttcctttattcagccagtgctttcacatgctgcttccttttatagccactcttttttgctacatattctttctctacaagagcacagttcttctggaatgtgtcccttaggattaactatctcaggtgtgatttgtgtgaaaacatctttattcttattgtggaaagactgttgttaggtggggagtttactttcccgtctgcacattgaagatctcatcctgctccactactggtctcttccctgggccctgggcatccgctctcagcctgactgtccccctgtgctcccgcatcatttctctgtgctgtgtctgggttcatgcttatttgtatttattctgctgcgggttagttggccgaatctgtttctgtgagagctcccatgcttttggtactttctgtctctcgtgtgtctctgcactgctttctgggttattgcttcggttctactgcccagtttggccattttctctttaactgtgtctaatatgctgctaaaacctgtccactgagcttttagcgttagtcattatagctattatttctggagggtctctctgcttccctgtcctgccaagtccaattggtcattcttagtttacctgtttactaactgtttgtatctcctttagccgttgttttctgtacgtatatggtgtgtttgacttttccagcatgttcaaggctgttttcccagctgtatcccctcctctcgggccatcaactttttgttccccattgttgctactaattcttaggactaataaagcacttcaaatggcagctactgtcaaaaattaggaagaaggcttctttgccgtagcagcctccagttgattactttctcttgacctgtactttacttgccacgagcatatcatgcctctgtacttgctgcagtaattactg

SEQ ID NO: 28409 - DNA, 1038 bp, Homo sapiens
agaaacccgctcacccctggacacacctcccagagacttctctttggaactctgcaatggagaaacccattgcagacttccccttcttttggatatcagtttgcttttcaggaagaaaattttaatactccatattgaggttttataattatattagcatgttgaaacattttctctaatggcttgctggttgaaaacgctttcacacagagcagaaactagatggagatactgtttcacaacctctgcttcagaagcagaggtggcctgtagcttccaaacccgggcagagcacgtgcagggatggtgcgtctctgtatctggactcacattcacatgtgtgcatgtgtaggggtgtgtgcatattgaattgtaaaaaagatgagtacgtgtgagattctgcctgagactccagtcctcagtgtgtggcctggtgccgctgatgccgagatgttgggctggcagcgatctgcctccgtctgtcacaggtgcctctacctgctgcaggcagacggacggagacgtgatggattgcgcatatcccctttacagattcggaagagtacatttaaaataacttaaatttgtatttagaagacttttcatggagagtatttattgttatagagttcacttctgaaatggtgacaaagcttttgatactgaatcaaacaagtgtgaagttaccgaatctctctgttacacagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggtgagtaaaaacctgtaaagatctgatcaaatctgactggtagaaatgcctttttcttgatataaaccgcttaattaagccttttggcttgcctttgaaagatgctttattgaatacttcccggcacagatgatctgttactgttggttgatttctaat

SEQ ID NO: 28410 - DNA, 1066 bp, Homo sapiens
ttttttacacaagatgaaattgaaatggccaatgagcacaccctcattcatccagcgagcattgaggaccccctagaggccaggcccatgagtgatgaagatcccgaggatgaagacgccttgccagccaggtcagtgggtgatggcatttgtggtcaggggcacccagcaccacacccctggctgccgttgacagctgggtgagtcccctgctgcctgggcagagccacctctgcagatgcccaggtgggtctcctggggcagggactggcaggctgtagcctgtgagcagattctgggacctgaaagctaaggatggtttttacatttttaaggagttataaaacaaacagaaaaggaagaatctgcaacagagaccataagtggtctgcaaagccaaaggtttatagaaatgggcagacctgctctaaggggcctgcttgctgatggggccttgtctggattgccagttctactaattctggaattggaagttctcatggaggactgtgtgctgggtaggatttccagatcccaagatgctttggctgcattcaaacccacagggcagagagagccctccgccctgttccttggcagaggcctccacactccgtgtgctgaccggcctgccagaatgacaacaactgtcagctgtctgcatcctcctggcaccccttagtgtggctgcatactgaggggagttaaaaccataaacaggtggagaatatctccttccagggaatctcagaggactcagtgatttaagaggaaaagaccaaactgctgctttcagcaggaccactgtgtgctgcctgcctgtcagtgcatacagatacggggtcctgagttggtgacctcaaaaccgtgagcggtagatagacagagtagcccctaatgaagcagaaagactagaagagacaggacctaatttaggtcgaaaagcaaagtgaggcctcagaagatgaaggcagagtgcgagaaaggctttctggaactgacaagtctgccatccacatttcgaaatgtattagaaaaattggaaaaaaaacatatgaagtgtaga

SEQ ID NO: 28411 - DNA, 1027 bp, Homo sapiens
aggaagttgcaaggcaacctggtttcagccggaccgggactctcccggggctgcgtcctgctagagctggcaggacacagaataccactagcagcctccctgggagtggcttggcgtcttggccacctctttccacggatgtggtggatgtgggggtaaactagagagactaaagcccactattgggctcagcttcctgtagaaatcaaatcagatgaaaaccctgacccagagggagaaggcagagagttggacttttgaaaacgtgagtgtgtccagcaaccaggcagcaacagtccttgtttttatcgaacttctataagcactttatttctccagaataatttcatcataaagaatccagagctcagacagctctttaccatctgtcttttccttttttcttaccctgtgtttggcttgatctggactgcacttaaccatgacaatgttaagtgctttcttctgggtaaaaattctggcttcttctccagaaattctggctccacttctcaaattgtttctgtccctgttaggagacccctggggcctcggctggagagacagtgcagctagtcccagcagccactgtgcttgggcctggccagcccctcctcaggggtcacggcactgctcacctggtgactaggtcttctcagccagatcagttcatgtgctctggtgtttttgagcttctggctagtcctcagtttctcagacctggttaatcacagtgtggagtcatttttcataactgtgcacctcacttgtttgatgcatggcaagggaataattaaattaataaacctacagatattcccccttacagttttcaaatacagtaagtgaatttctactataaaataggtccaaagaggttttattgtttcttatttgaaataattaaagaacatttatgtttcccttttgtggtttcttggttctaatcctgtgggttgcttttgacgtcctctgttggggatacactgtgcatccgtatttaacaggagatcccgaactcccagca

SEQ ID NO: 28412 - DNA, 1025 bp, Homo sapiens
ttactctttgcccctttacagaaaatgtttgctaccacttgatctaaaggattaaaaaataaaacatgtcattgggccagatgcggtggctcacgcctgtagtcccagcattttgggaggccaaggagggcggttcacctgaggtcgggagttcgagaccagcctgaccaacatggtgaaaccccgtctctactaaaaatacaaaagaaattagccagacgtggtggcgcacgctacttgggaggccaaggcaggagaatcgcttgaatccaggaggtggaggttgcagtgagctgagatcctgccgctgcattccagcctgggcaacagagcaaaactctgtctcagacaaacaaacaaacaaaaatgtcattgaatttgaagtatacaaaatttgaatatctttctatcaaaaatttgaattttaaggaaataacaaagcaaaaattataattttttgtgttttcaaaaaattattttttctaaattattaagttataagatataaagtagttaatgtgaaatgtttaaatcaaaattgtttaaagctgagttttaaatttaatactttgaaaatttagttaaatcatattaataattttataagaaataaaactattgataattctgatgtctgacatctgtctgattgctgacatggatcctgagtcttacagtgttttgagggcctccagctacattggggttccagtgccagagtggctggcagccccaccctaacgagaagtgaaggggctgggcatgctgtttccagtgctttcatgagatgctgctttgcctggcggtcgggcctgatgtctcgttgttccacctgtgaccaaggggtccctctggaaatgtgtgtgtactgacacatgccctggtggctcttgtctgatccatgtccaggttattcctgcctgaccgtcactcgtgccaggagcccaacacaaattcaggcacaaattcagtacaccacacaatgggggaaacatgttcaaagatttttacttacaggtcctgag

SEQ ID NO: 28413 - DNA, 1001 bp, Homo sapiens
ggaggcctggccgtgttggcttccaagaggccagatgggtgctgctcaccatagaaagtgacccttttccctgttcctgagccaacctgtcacttccatgcgctgtgtgtcactttgaaaactatctttgctttctgcaaaatgaaaggaaactttcaaaagtcaacgtattaaagcctgtttgcatttattcttttatgaattttgctcacattttttaattgggtgtttgtctaaagacaattatcgatcatagtaggctgctggaaggttgaccacagaaacctggttctctttcagggaggtcaccatgtctgcctccaggcccatcgggtaggggctgccttctgtcaaggcacatgctccaggtcccttagatggaaggaaaacacatggtctttatccagtggactcagggtgcaggtaactgaaggaattaacctccatcattttcacagatcctcgtagagctggaccgaaggaggtgggagatccctgccgggagccgctgcagtgggagggcttacagacgttcgcatagtctctttctgtttggttgttttaactcccattaaaaggagtggctttcagccttcttgcttactgtcttgtgatgtatgtgtgttcacatgttccatgcacatttgtaacgctcaccatgctctctgattcagctttgttcccttagagttgccccagcactgctttgccatgatgattgtgttttttaaaatacttccagttgcttacttctgtttagttatctcagtgctaaatattgttaattaattaaatataagcagcatgttctagattttatgtgtctggaattcttactaaaaatcttcctggatatgacttccagtcataacgttatggattttattgtaaacaaggtagaattttatttgccttttaatcatttcattatggtgagtgtcctccttacagagcgtgtactgaatttgggttttactccttttttgttcatttccacaagt

SEQ ID NO: 28414 - DNA, 1081 bp, Homo sapiens
ctgttgtgtgcgcagcccgtgcctgcctgctggtgattgtttttttcaggtttttatcctcatcaatcctgctcttgagatcttttaaaaacccagcttcatgtttttactgggcagttctactcactgtttccaagtttgtgacaagttttaagagagaggttacgtccatactcctcatttgagaaaatgtgacctgtgcttggcccgtgcagtagcccaccaacggagcatgtgcaggggtcctcagggcctctgtgtcaggactgtggcctacagcctacagctgcagtcacctcgcatagacagaggctttgtgatcgtgtaggttctggaactatccccaaactgatcctgtgatcacttgacatgataaagaatcctcccacatttttctgtgaagagaagccgatgttgtagtgctaaaacgtggacattctggtcctgtatttgtatcattttgaaagcaatgcaaagccctgtcatgatcagtatttacatttatgaagtgtagtagcatgatacagaaagagaaggcatctgttgaagaaaagctgtgaaagtggcatctttctctagttttagtattttcctttatgatagtagcattttcagtgacagtgagagtagtatttcagtgtgcccctgaggtgaataagaatttagaatgtatggaatctgtatcacagaaagtgtattcttctcaagattatttgtcaatccaatagtaattatttttatttctgaaaggaaagcatttggttatttcagaggttataaatatttggttaaatgcatgtccaaatacatttataatgatttgatttttgatattgataattgtttagcaacaaagtcaaaatgtaagcagtaatctagtatgtcatgttcttgctcagtttattaatctctgaattccatcttggctctattttttttaaccttttgttccctttgagcaccgaaaggagtaacctatcgagcttttgctggaggatgttataaatgaaaatttagtgtccattccatcagctttgtcaactgggagaagtggtgtgtgtgtgaggattattttggagaa

SEQ ID NO: 28415 - DNA, 1072 bp, Homo sapiens
atttacaagatcctgcaacgaaggcattgtaagttactctttctgggcaccacaggttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggtgaggaactatgctgctgctttaaaacacggggtcattgctcttggtaatgcttctagacagcattttagtttcaggatta

SEQ ID NO: 28416 - DNA, 1031 bp, Homo sapiens
ggaggggcctccaacaactgttctagggcctgccagttgcctgggagtctctactttgaatttcctacatgggctgtatgaggacttccccgcatgcccaggctggaggtggacagccacccttccatttgacctccccagcgcagtgaaatcaggatgaaggaaggggaagttccagggtgggcttagattggcttacgtgaaagagaaaaagtaaaggagaaaatcacctttagttctcatctctaaatcctaaaactctctgattatgtattccttcttttcttggaaatccaaagttcttctggtctattgcaaaagttatttttttgaccctctattcatttattactttgtatcagagtcttcttcactttgaagataacatgtatactacccttgaccacaagacttgaaggtggcttgtgttcccctggaagaatccaagtgtcttatagtttcttttttgctgttggctacaattagaacaacctctgtgcagttgtagtctgagatgaccaggagttctgttttaaaggaaggaaatgtattttattttgcctaaaggaatcaaatgcaacatcagtataaaataatatattcaaggtatttcactgatttttttaacgaaccaaatacttgcttcccttattaacctctcgtcaacattgtttataaggattattagtccatttgtactttaacaaatcagtgctactagatcccatgtgattttttattttcaggattactctttgctaaaatattaaagcctgagttcaaaatattgtctgatgtgacttgtcttcccttaatattgacagagtggcatataagaccattgaaatgacatcaaatgccgtggatcccagatgtctgaaccttcagtgtgtaggctaggagcaccttaggcggacgcagatcgaagtgccagtagagatgtcacccctgcctccctggcttggctgtgcgcctgcagtgacttctgtgtggagcatgaccagagcccctggcttgggaaggctggaggg

SEQ ID NO: 28417 - DNA, 1027 bp, Homo sapiens
acaggttttagctgacgctgtctcacgcctggtcctgggtaagtttggtgacctgaccgacaacttctcctcccctcacgctcgcagaaaagtgctggctggagtcgtcatgacaacaggtaaccatcttggtgttgtatgtaaccctgcctgttttcatgtctgacaaatgtgaaatgttctcaatcgacaaaaaccactgtgccacaccgacgggagatggttacttcttttcttcttcaaaatgtctgccatatgcaagtttacgaactgcacttacaagcttttttcccaaaatgttcatctttttaacctaagtttgttttatctggagaaagcacactatattaatatttgattcctgtcatcttcatcctgtgaatggcctcaatctgctctggaagatggcaaggggcttactaattcttcctttatttgaaagtagagcctatctattgtatcagttaatgttaacgatgccagataagtttcagtgtgacttcctttgaggagggagagagctctagcaagagtagaaaatccgtggggaaaaaaagcacaatttagaacgatagaagaaaccctattaaattagtctagaagttcccagtagcaaaaggaacccccgagtcctctccccacatcccgcgagtgagaacacgcagcagcatctctgtgggtagctcctgggaagggaagccacatccttggccagtgtctggcaccccagggtggagcaagactcagggagaggacccctgtcatgtggggccgtctctgtacccagcatctgctcagcccagcctggacagccagatgcaggaagcagaccctagaggtcagggaggaagctggggacagtttctctgtctacatccaccagcccaggagaaacccccagttctcggtatgtgactttcttgttctttccccctgaggggtcacctctatcagactctgcagccctcttcactgacccacctcttgctgccctaggaaacctggctgctctgctcatgaccattgt

SEQ ID NO: 28418 - DNA, 1802 bp, Homo sapiens
tccgttatctctaatcttgatagcctaaagcacattaccaaacccctcccctggtccccgctgcagggggctgtgccgagctgattcagcagcagcagagagagcctgggttggagccatgaggctgcccctgcgtcagctctgcctccttggaagcttctgtgtctcgggttcttcatacgcccagtggcagggatggaccaggcaccccttgcaatccttctggacaaatgtgccactgtcctatgaaaataaaaggacaccactcaagctccaggaggcagaaccttaactcaaatctgagccaataaacaatgtcactctagcaccaaagtctatttcaaaatgcaaactatttgaaatatcttatttttggtaaatgctttattttggaaatgggtttttgttgttgtttccctgaagagagttcagatcagcaaagcaagtagctttggagaagacacctttagacgaggactcctgtgaatcagcaggacagcgtagcaggacattaggtgagccacagggtggagcaggatgggagggcagaggcttctgcttcagaattgaagccgaaggcaagtaatgctgtgggtgttactggagacaaaaggaaccaaacaagaaaaatctggagaggcaaatgttgatgtcttaatagatttgggaggtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcgcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctctcgagctttctcagactttctctcaaatgagtttcacatccagcacttgcaagtttcaggacaattccagcttcttatttatgtccattgatctcctgagtgtgagctcctcagctggcccagtttgttgtccaacgctcactaagataaaccaagaagaaggagcagggtgcccaaatgccgcatgcgatggctctggggaccttgttgacagacagcctgctccggggtttgcagacaaggcttcctatcctgctggttttcatgttgaatgttggcacgaaacgttaacaaacaaggctacatgatggggtagggtccttgtgaagagcttgcatttaggtatctctgggaggacagcacagggacccaagggggctggcagcaggcccaggtgtgtggcaggaagaaggcaggtgcctgctgagctgctatccacccgagaccatttgacattatgggcaggaagagcaagggaagctggtttaatgaggccctggctggagtgagagagaaggaacatcactgtgagagtgtggaaagtgtgtgtgtgtatgtgtgcgtgtgtgtgtgtgtgagtgcatgtgagtgtgtgcatgagtgcgtgtgtgt

SEQ ID NO: 28419 - DNA, 1021 bp, Homo sapiens
ctttcctacttactaccctgaaccctctgatctggattgttgagtcttcacttctgagaagtttccttctgtcctgtcacttctgctagaagcatcttctctgccctctctgttgtccctgaaaatgctgctgagcagaactcacaggcctgtgaccagtgtctctcctctcatctgatgtgcttttttgactgtactgcattctaagagaatgcctgacttctgtcaccatctcaggagtgaactgttttccccgcggagcaggctccccgggagctcatgcctggcccacttccctgcaccacggccgccacacggctccgtctcttgctctagttctcctttctgggagagtgactccatttggggctcgtcatctctgttgggttttcagtggctgcatttggggttcctcatgtctgttgggttttcagttctccttttgcatactgagagaacaactttctagtgattggaactgtctagaaaagtttcctgaaaggaattgagctcccctgactggaagagttcaggttggaattggatggacactgttgttacggacacggtgataggggatctggctgaaaggattaacccacgtgatctccaggtgtcttctaaactcgagatcctacggagtgcagtttgcttgtttttaaattctctgtgcagatgactgtaatgctacagtacagttaccattacctattgtatcaatgacacttttgaaggtttttaaaaataataatagttacacttcactgactgccgtcctcaggccatctcccgggcatgcatgtgctcaagtcaggagccagattcttacatgcttccctgaatccacgccgcagccctgtgggccgggcctgccgtcacccttcacagtggaagcagccgcagccggcagacaccacgaggcttgcagctcacagccatattccactgtccctaggacaagtacagcttgaacccacatcccacctttcaccaccccaagccttgcctcccatggacgaag

SEQ ID NO: 28420 - DNA, 1047 bp, Homo sapiens
ggtgttgttttcatctgttacagcgtcaacagttgcatttgtttttttatcccttcacaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatac

SEQ ID NO: 28421 - DNA, 1035 bp, Homo sapiens
gtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctag

SEQ ID NO: 28422 - DNA, 1041 bp, Homo sapiens
cactgcagagcccagagggacatcctccaccgtgggcctgggctcaggtgtgctccgcgttctccggcccctcctccaggtgcgctgctcacagcacacgtctccacgtcctggcatcccgggcctccctgggctccgtggccccggagggtgcccctccctcagccagtactgtgggaagagcccggtccctctggggccagatgagcagggcagagtgagcaggtccccctttggtggagattcacgatctccaccccgcccagcagccatcccaggccgcagtctgctgactatccccagctcacacttctcaccagctgacacggtgatctggccgggcacctgcccagggtcccacccgcagaggaacccgcctcttccaggttggttccgggctcctggacggatcacgcgctgttgacatgcagttgtagcttttttcttgtgggtgggagcaatgctcttcccagctccacctggaattccaccagggatgggtgcagcatcctaaccccgccttcccttggagaattcactgctctggacagacgcctggcccaggatttcaaaggcgcatctgttatggaccgggcccccagaggagacgtctttttgccattttgttttctgaccggagggttttttggaggttgccctcccacccaccgggttgctggcagcccagcccgtgctgttttcagtggacccttttgcaaatgtcttcacaggctcccgggaagctgagctgaacagtgacctcagccttgagcaatcccgaggatgtgtttgctgaggaaatcattaaacagggagatgagagcactcaacccccaacatgccaggctctgcgggaggctgcttattcctgtggcctcgggccaggtgccccagcgtttgctgcccttggtagacacttgtctggcctgagccctcgggcaccatacaccgacatggttagggcagccagggtcagcccgggcccctgggagagctgagtggagggaccactggccaagcacagagggtgcagggtgccca

SEQ ID NO: 28423 - DNA, 1046 bp, Homo sapiens
tggggtctcagggaagcggcacctcctcaggggcctcccagccacctcacgtcacttcctggggtctcagggcagcggcacctcctcaggggcctccaaggctgtctctgctttagcgttgggttcccgggtccctcccaccccgacctcctgtgcctgcggccctgcgaggcgtgatggccaatacacaccctctagaggggcttgtgtcatgtggaaccagccagaccccccggacggcttgcaggcagggagatggagaagcaacccctccatggggcagacagtgccatagtcttcaccgcctcagtctgggggcatcagggctgcaggtcagctcttccctgtcttcagtaaaggatggacgcgaggaccagggtccccagtgtcagtggcgggtcagggatgccaaagtgctgagcagaagttggccagcccttgccagaggctctggagctgggccctgacacacgatgccgtgtgtagtgacatgcaattccatgtagtgacgtgattccgtgtagtaaggcgatgccgtgtgtggtgacgtgcagttccgtgtagtgacgtgatgccgtgtgtggtgacatgcagttccgtgtagtgacgtgatgccgggtagtgacgtgatgccgtgtagtgacgcaatgccgtgtagttacatgatgctgtgtgtagtgatgcgcgatgccgtgtgtggtgacacgatgccgtgtgtggtgacacttaatgtcatgtagtgacacgctcgcaggatcgccaaggccaggctggctccaaaggcttgggtctggcttcctggggccactgggtgctctctgaggccgcccatcactgttcgggccctggggtgggagctgggctgcaaagtggcctggactttatgtcctgccaggtacagtgtttccctcagcagatttatcaggcgttttgggtgtaaatgccaggaagcctggctggcgctgaaggaccctcctcaaagccacggatgggcaccatgcttaggggaggacctggggccacttggttgcattgtgaaatgttca

SEQ ID NO: 28424 - DNA, 1605 bp, Homo sapiens
agactctggccacccccaccccacccagccctgcctcgaggtcctgcactggtccctgcccggtaccgggtcagctggtgcctgcctgtcctgccctgcactcctcaggctcctcaaggacagacggacagacaggcactctagagaagggaccttggccagacggctttgccgcccccacccccataggtgcttgctttgagccccttgcaaaggtgaagccagatctgggatcccagggcctggtgcggctggacatgggaggagggccacggtcacgcttgcacggggcagagactcccagaaccacaggcctcaggagagctgggaagggaaggagagggcactgcggtgcctggagagccagagtccgcccgtgtggaagtgttgggggctgtgttgcagtgacagccctggcgtctcaggagcggagcaggacaccgcgtttctggctgtgcaaggctccacgcgggtcagcagcccatcctggcttgtcatgctgttaattagattggaaaacctcggccttccatttcttaaattgctcactcctgcagtcctcttctcttgcctgcaggcctggaaggtgtggagcgggtcaggtggctggcaggttgccaggaaggaagctcacactgtttcagggttggccgggtacttgccgtgcctgcctggcacagagaccctcattcctgccacctcccaggcagtaggcagccaggtggaccaccgagtggagagaacctttgaacacctcagcacctgaggctcagggccctgtgacaggacacagcccggggtcccccagggccagttgcacccctctggaattcctgagcactgtgactgtgacctgtgtcatatgtgcggcctctcagcttgcaaccctccattcctgcctgtggtgtggtgccatcttcaccccattccatgccaacacactcacacagacacacgctcgggccgatacgcacacatggctgtcacacacacaggttcacagacacacaggctcacgcacacacaggttcacatatacacagctcacacaagctctcacacacacacgttcacacacacaggctcacacatacaggttcacatacacatggctcacacacatgggctcacacacacacacacgcatgcaggcacacacaggctcactgtgaggtttaatctcagcaaagtctgagcacctggacttggctcagggaccctggcacacccgcttgctctctgtctgtagaggggcaggaggccctgggtttggtgggctctgtctgtagaggggcaggaggccctgggcttggtgggcaggcatttggagtgcgatggcggggcctcgcctgtgggcactgagggtctcacctcttcctgcagcttttgaagggatgggaggctccaggatagagttgcaggacagaatagatggcagaagccaggagccggggcctttgcgtggctgcctggcctgacgcacctcgcgccgtgccaggacccgggcagggcagcaaaaggcatctgtgagtcgccgtcctgtgcgggtctcagggcacagtgggtggcacgggctctcccagccgtcggttggtgaaaaacggg

SEQ ID NO: 28425 - DNA, 1947 bp, Homo sapiens
gctcctttgtggggctgccctgggaagccgggatcacgaggctctgccggccgtggtcaccccatgaggcagggtcagctcgggagcaaggcggatcagatggaacagaacacgtagaccacctcgcccgcccttagtcagctgggccattgaaaatcaagtccgtagaaagacctagaaataagtcccggggtgcccttgcctgttgacgggcgggccgagcaggactgttctcaggcaggcactggtctcttggcttccaggtggtttgtttgctggtttgaggctgggggtgacgctcctgtgcgggaggaggtcgcattccattcatagcggcttatctgggctgtcaggcaggcctgggagggagcctgcctctgtgctctccaagggtgggcgacggacagacagggtgtcccaccccttctgggccaaggacagagggtcagtgtttgcagagacctggggaggcccaggtgacctccaccgagcacctgctgtgtgcagggccagtgctggctgcagagacagcggagcgtgtgtggacccggcggcccaggggaggggggcaggcaggacccggcggcccaggggaggggggcaggcaggacccggcggcccaggggaggtgggcaggcaggacccggcggcccaggggaggggggcaggcaggacccggcggcccaggggagggggcaggcaggacccggcggcccaggggaggggggcaggcaggactcggcggcccaggggaggggggcaggcaggaccaggcggccctgggggtcaggggtggaggccaggcctagacggcccacaggagggtggactcattctgaccgattcctggaagcccccggaaagtggtgatgttctggagggcccagcagaccccaaggcccccaagacaatcccagctggctctctgcggctctcggtgtctgccatttgagacaatttgggcacaggcagggcaggccgtcgcggacggtctaagccgcgcgcattggtgggggcagcagagcccctgctctcagctcctcggggtacagcgggggtaccaggcgggtgagtgggtgggtggtcactgctcctgccaagggcagccctggtttggtttgcacttgctgccctggtgacggctgctctcattcctgccccattgctaacaagggtgtcataagctactttcccggcccacatcctattaagcccatggagaccctcccacagctgagcctgctgtgggctgcaggccctgggcggtgcccacctcggtccccactggcctccttccagcactttagagcagacacaggttggagataaggaaagttccagagcacagactggaacaagccccaggcctctccctgccccagcagggcctccctggatttgggggacaggtgccctcatggggggtcctgaaggtcagagctggggctggggctgggctggcggaggtggccttggcggaggccacattccagggtctcagtgagagtctgtggcaggcagccttgcagatgccgctgagggaccccccacttcatgttgtgggtgatgtggtccattgattgcctccaggtttaaatcaggtggatatttacctagcggcctcctctccctctgcacagggcctggagtgggatggactggggtgctcagctggaggctctgcagacacagccccctgggctatgcaggccctgctgggagccacattgccatttttcatcacccactttttgggtgagaaccccctcgagtcctaacatctgccgcatctcagagcctgtggctccagtcagagcatctggaccatactgctggggtcagagcgcggcaggacaatggccagtttctgtgtgattgctggcgggaatcttgagccattccgtgggtccgtgggctgggatctggaagcttccttgaaatgtctct

SEQ ID NO: 28426 - DNA, 1075 bp, Homo sapiens
gctgacaggctgtggcttgagagcctgggtcgggaaagcccagtcagaggggaagccgggggctggttctgaccctgcatggtttcctgagggacgtgctcagtgggatttgtccctggagcaccaagggctgaaggaaagccactgtcctgctttctcgcagccctggtccccattcttctgtgggtgcaggtggggatggtggggtgaacccgccctcctggggacagatatagggatgccgggatgccgcactgcaggtgtgagtcctgggaagtgggtagggggtcgatgggaggaagagaggaaggtggggtgggggcgggaggagagaagaggaagaagggggtggggggagggaggaaggaagaggaggaaggtggggtgggggtgggcggagggaggaggaggaagtgggggcgtccccatcagagacctcctgcagacctccagctgtttggtccatgggtgggttggttaggtctgggttcagaagccccttcagtgtaggtgctcagctgggccatggagtcctggccttccctctgagcacagacccaccaggaatgggcagcccgttcttagtgaccctgggggctggggagcacccaccctctgagccccagctcggcctccatgtgtcaggtgggaggcacgggcagggccaggctgtgggagtccgggagggagtcagaggttggctggggcagaggtggggtcagggagcaggaagtgagcgtttgcccactggggtagacgctgggtggatggggagctgggagtcctatagggtgaagggtctgccgtgggctgaggcatgttggggcatcccgagtacctatgggccccttggacgtccccccggcgctccctggcacaggtctgctcggagggtgtcggcctcctctgcattcaggatcgtgggtctgtcaattgggacacctatgaacaaatgctcttcccatcagtaactccgtgtgcccctctcttgagcccctgtgagatgcaccctggggtcccagcctcacccactatccttcacagcagagctgtgggtccatggcccaggcagggt

SEQ ID NO: 28427 - DNA, 1030 bp, Homo sapiens
ctggcgccaagcacagagcctggcctctaagatgctcgggaaatgccgctctctgcgcccctgagtgctcagtgcgagcctgtgaagtccattacagtctccggctgtgaatgtagcaaggagtgggaactaggcctgggagatgggagtgtttgtctgatgacttcctgagcgaaagcaaactgggaaatctcgggctgcgcgctggtgccccgactccgcacctcccaccccttctgtggggccagcacccagaaagcgccagcggaggctggcaggccgtgggccgcatgggcggaggggccggtcctccgatgatggggcaaacgtctccggcctagcccccgacgctcggggatgtaagggcaagggctgcggggtcggaacgtcggctgtggctgtggctgtgtgactgctccgcaccagctcagcttcctcacctgtgcacacaggctcccgctggaatttgctgcgttctccaagctctgcaagattcagaagcagaggcctccctgggctctcacagccccttagcttcttgcccacccacggagagggtccagagctgccccttgctgtctgtgaggaaagcgggtgcttcaggcctgccaggggtccactgggagttgctgggtgggctcctcaggccctgcccagggctgacccctggctccaggtcctgggcctccgtgccatgttccccgcaagcagtcggggcctgctggggtttgagccacgttccccggaagcagtcggggcctgctggggtttgagccacgttccccggaagcagtcggggcctgctggggtttgagccacgttccccggaagcagtcggggcctgctggggtttgagccacgttccccggaagcagctggggcctgctggggtttgagccacgttccccggaagcagtcggggcctgctggggtttgaaccacgttccccggaagcagtcagggcctgcgggggtttatgtcacaccctggctgcacgtggggatcgtgtctaagctttttggaaatgtcg

SEQ ID NO: 28428 - DNA, 1683 bp, Homo sapiens
ctcgataaatgccagctgcgagcaccgggggccagcacgagagcagctctgagagcctgggtcgtgcagggcgagagaggctccggggagtggaggctgtgagccagggaggaaacactactccacgtgttaggaggaagccacgtgctcctcgaacatgctggtactaggtttgaaaaccaacattagcagcaaagatgactccgtgtccataccctagtttttaaaagttgatatagcccctctaaaaatgagtttgaaagcacaggaatttataagagaaaaactttcatcaaatacatgaaaaaaatcaatctcactcaaaatggaattaataagaaatcaagcagcattaaggattgcgtggtttggaaaatgtgatgtgggtctcccttgattgttttgaatggctttattgagatgtaattcacattccgtgcaattcactcgaagtgtacaatccagtggttttcagtatattcaaaaatctatgccaccatcatccccatcgaccgtggaacatttcatcactccagagagaagcctttccgccgccctccctccctccagtcctggccaccggtcatctcctttctgtccctgggttccgtcttctgagcttccatacgaattaaaccatggaacgtgtggtcgtttctgtctggcttcttcccctcggcctgtggtttccgggttcgtccgtgttgcaccctgtcccagggcttcattccttgctgtcactgaataatgtcccaccaggtggaggcaccatgctgtgcttatggattcagcatttggtggacttctgagcggtgtccaccttttagctgtgatgaacggtgctgttgtgaacacttgtgtacaagtttcagtgtggacgtgtgtcttcgtttctctcgggtatatacctaaggtggaatcactgggactatggtaactgtgtttactcatttgagcagccgccagcctgctttcccaagtgtctgcaccatctcacgtcccttcctgcagccttgggagttctgatttcgccacatctttgccatcacttgtttttctctgactttttgtttccagcccatgttgggtgtaaagcagtgtcttgtggttttcatttgcattttcatgatgactgataatgttgaacatctttttttgtctttcttggcgatctgtatttcttctttggagaaatgtctattccgattcttgcccacttttagttggattattgtctttttgttgttgatttatgagttctttacatcatctagatagaagtgcttcctcacatatatgattcgcaaatatcttctcccattctgtgagatgtcatttcactttcttgatggtgtcctttgaggcacaaaacttttaagtttttacgaagtccaatttatttttcttttgtcacttgggcttttgctgtcatatgtaagaatcttttgccaaatccaaggttatgaaaaagaaaaccttcaaaagtttttttattttagctcttttatttaagagctaaaataaaaattttaatagctgcatgtggtgtgaagtagggatccagcttcgcccttttgcgtgtatctgttcgttggcccagcaccgtttgttgaaggctgctctttcctcactgaacagtctcgacattcttgtcaaacatgagttgcccgtaggttatgagtt

SEQ ID NO: 28429 - DNA, 1051 bp, Homo sapiens
tatttccatgttgttcatacatcactttcttgactttctccacaccttcctgtagttctttgagcatctttaagacagtcattttaaagtctttgtctagtagatctgccatcaggtcttttgcagagacagcttctgttaatttatttttctcctttgaatgtgctatattttcttattgctttgtgtgccttgtgattttgtgttaaaaagtgaacatttgaactcagtaatgtggctcttgaattttgcccttcaccagcgttcgcttttttttgttactttttaaaaaatgttttgtgtctgtgccagaaatctcccttaggtgtgaacttcaggtcttctcaggtcttttctgagcctgtccctttccctgggtgtgtgcagccactttctaattttcctcttacatgctgctgtttttcaatgtcccgttctttcatgtttggctcccaaaggaggaataagataaaaatgagggagaaaaaacagtgccagccctctaaatccccttcaagtcacttcagctggaaggggcagcttgcaacaacagagggagtgtaaaacaatggccccacctccctgtctgcacatctgtgatcccaggcaacctgatcagagcacaggttctcgatgtctgcaggacagggtcctttttgccgtcctgtttcccacaagctgtgtggctgctgctccaggaactcgtgcatggcacctgctatgggaatgggggtggaggatggatgtgtggctgctattgtgccaagagctggggtttagctaaattaaccacccgttaccgtccaagccttcctgtggacattgcaagctttcagtagactccagagttccaaaagagttctaagacaaattctgcccatgcacttgttaattagttggggagatggattcctggcgctttccatctgccatttaccagagtactccagaatcattttcaaacacgtttctttctgtcaagaaatcaagtcttggccaggcatggtggctcacgtctgtaatcccagcactttgggatgccgaggcatgc

SEQ ID NO: 28430 - DNA, 1017 bp, Homo sapiens
ccatgtctcctgcagacaccatgtcccctgcacacaggtttctgcatggagcctgcctgtcgtttgggaatgagtgaaccagggtggccgttgggtggctgagcccaggggatcagggcaggctgccaggcacgtggagagccctcccagactcagtttctcctttctgcccctgcctggctgcctctccaggccgcgtcggtggcccctggttccgtcctgcacagccacctcaccagctgtctttctttttgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccaggtaacccccactgtgccgtcgctgggggactggagcagctgggatggggtggggtgggggtggccactgggacagggacggagctgtggccggaagaggagagcccccaccccagctgtggtcagcccgggcctccagcgcaggcctcctgggttcttggctgctcagccctggcctccggcgcaggcctcccgggttcttggccggcctggctg

SEQ ID NO: 28431 - DNA, 1049 bp, Homo sapiens
tcaggtgtcaggaactttctctttgggtcttagatgagattccagctggggagaggagaagcatgcttgtgtggtagaaaagaagacagacttgttcagcacaagattttctcagacttctgaattgagatacttgggaaagaaacattcaagttgtgtgactcataatttttggcagaaacaagcacagagctttgggagcagggaggaaaccgaggcttcctcctcctcagcctctccacaagactgcatcgaccctggcgctgccacagatggtgcctgggacccccggccgcagctgggtccaacagagccctccggagcattggttgtgttcctcgtcctaagagtccttgggcgttgttggtcttttcaggttcactttcttgagtcaggtttgtcagtggtcgtctcccgggaaatcatgcacccctcccagctgctgccgttgccttgaacgtcatttccagctgtgtcctgatttccagctgtgtcctgatttccagctgtgtcctgatttccagggcgctgaggctgcagcgtgtcgggaagcattttacatgctcttccctcacagaattcctgtgagctctgtttcaggtgtctccggatttcataactttcagtccgaagtcccttaaatatttacaatgggcctgtggcttttgcactagcgcctcctgccccacccccggagccagcggccaccacgggctcagagcttctctgccctctgtagtcgccccccacccaggcaccctgtagccccgtgcaggaggcgtcggcccctcgggggcactctcaggagagcgctgtggccacctgtgggggggtcagggcctcacgggcctctctggacagtgcatgtctgtgtggggatcgggtgtcaggaatgcccagtccctccccgacaccaagaccacccaagatgcaccccccgcccgggctgccccagtggagaagcgcagttttttttttttgttttttttttgagacggagtctcgctctgtcgcccaggctggagtgcagtggcacgattgcggctcac

SEQ ID NO: 28432 - DNA, 1045 bp, Homo sapiens
tctgtgtggtgtgtctctgtgtcttgtgtggtgtgtctctgtggtgtgtctgtcttgtgtgttgtgtgtggatgtgtgtgtgtctgtgtggtgtgtctgtcttgtgtgttgtgtgtgttgtatgtgtgtctctggtgtgtctgtcttgtgtgtcgtgtgtgtctgtggtgtgtctctgtgtgtagtgtgtctctgtgtgtggtgtgtctctgtgtgtgtggtgtgtctctgtggtgtgtctgtcttgtgtgttgtgtctgcatgtctgcatggtgcgtgtgtctctgtgtctgtgtctgtgtgttgtgtggcgtgtgtgttggtggggtgtgtggaatcacgtggtacccaaggggagaatcccccagccccaggtgtgaggaacagcagggaattctcactcaggggcccagatcacaacatgccccacgtgaacatggacccacagcctcgctcctgggggcgtgggcaggagacgccgtggacgtggacccacagcctcgctcctgggggcgtgggcaggagacaccgtggctggactgtgggcagtgtgtgaacatccatgttactttcatgctttttctttattttgcccaataagcccgttgtttttgcctggaacatgccagaagacgccagatcgttcacatggcggccatgacaaggctgcgccctgggacagcttgctgggtgcggggggtcgccgaggcgccgcacccctcccctggcctgtcttgccctcaggggtcagtagcggtccctgaggatgtttctcctccgggttttcctgaagtttaaaacatccagccgccttggcgcgtgttcggcccagccgggcgtgcgctggggaaacctgtgcggggagcatctgcggtgcggcctcctccagggcagggctctggccagaagagaggagcgcgttccccctcccgcctccgcatgtctgaccaccggccgaggcaggttcagaagcgtcactgtcctcgacccgattggacacgacttactgaagctcagatggtgcctgggcagggaaggccagcgt

SEQ ID NO: 28433 - DNA, 1047 bp, Homo sapiens
gtcatttcccatcactaatggcttctcttgcacacccagggcgaccccggtgaagacggaaagccggtgagtctgcttttctttctgacccctgtgttatctgtgatgtttgcttagaccccagggctttgttgccagtgacactctttttaaacgcgacccagtgaggagactgtacagcaaaaccattttgaaagtggaattttgtaaagaaaagatgagtgtaactgttgatgggaaatagcagttatgcatttgtgttgagacatttgggccacaactaccatgaagaaggaaaggaagtgagaaaaggcagagcttccaaacccttagagggaagacgcacagcaaagaaaaaggaagtcgggcggggcagggggtggtgcaagtcggcgggggagggaagcacggggcgacctgagactctgtgaagtccgagcttcgtcgcaaaacacgcagttcagtctttaaaaatcagcaaacaccgtttccaagcacagtaatgacgtgatcgactgcgaataaagacctgggaacagcctgcccagcaaatggtaacactcggcagaaagtggggccgtcacgaacgctggacaggagggttcaagttaaaaacagtctagaaggtctgaaaggacagggagggcatctcatggtgcccaccgaacggtcattaccgaccgcctggcaccccacagccaagctgcctgcgatgaggaccacggcagacaaaggacagtcggctggggggcggcacggggcccacccactgcaacagggtacacgcacgcgtgtgagtgtggggtgatgatccacggggcccacccacagggcacacacacgtgtgtatgtatgtgcatgtgtttgagtgtgtgaatgtgtgactgcgcgtgtgtgtgggggggtgaggatccacacgtacacataccacacatgcacacacagcacatatcacacaccacacattacacaccacacgtggacacatgcacacacattacacacatgtgtgcacacaccacacattacaccacacgtggatacact

SEQ ID NO: 28434 - DNA, 1030 bp, Homo sapiens
tgcggaagcacctgagtggccaccccatggttctaggggtgctgaccagtgggggtgaccgcaagcaaggcctccgacctctctggccctgtgggtccacggactgcacagagagcgtctccatgagcaattcccatgggtgggtgtgggagggccgaggtcagcattgctggagggccaggggagggaggagcctgcttggccaacgcggctcgtagggtctcaggtccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctggggtcactcggtagcatgccatgacgtgcagggcagggagtgtggggttaggtcacccatgacatgcccctgcctccgtaacagtccctacctgagccagccaaccctaccgatgggcattcaccgtcaccatcggctctgaggcctctctgggtgccgcatggcaagtgctccccagaatccattctgaggggaatttgggcttaaagaacatgcctaatccatattcacgcatgtggccagactgcctctcagagggagcagcggctaccccagccctggtgtgcaagcatcttcccgccgtggtgctgtcggctctgccatctcatcctgccaatgtggccgcgaaactgcgggctacgcaggctgtggggtctcccgtgagccctgggactctggccctgtgtctggggaacgttctgtgtcctgccttctggaaacctgcggaagcccagataacctgttaacccagaaatcgttttagtggccgaatgccatcaagacccactatgctctgctctcccccagggacccccaggccctccgggaagagaggggcccccaggaaggactgggcagaaaggcagcctggtaagtcttccctcgagtccagggtgagtgggaa

SEQ ID NO: 28435 - DNA, 1032 bp, Homo sapiens
acctcccgctgtgcatgtgggcctccccctgtgcatgtgggcccaaccccgaccaagttcgggctccgtggctctctcctcagttgtgtttctgtgtggctgaaatcgtgtcgtaaagttagaagaaaggctgctgtggggcctgcgttgcttggcagaatgttccttaccttttgatttgcagggtttagaaagcatcataagaaaacgtgtctacgctggggttgcagggccagcgggggctgggctgggtcctgacacgctctcctcaccccacgcaggggagcaagggagcccccggtcctgctggtgctcgtggggagagcggcctggcaggagcccccggacctgctggaccaccaggcccccctgggccccctgggcccccaggaccaggactccccgctggatttgtgagtaccgcctacacctgaccccctggagagccgggggctgccgttgccccagccctactacccctggcatctcactcacagagcagcacgtcctgggcggtggccttgctggcactgcctcatcctgggattccatattccgcatggtggggctcgagtctctcgcccgtcgcccgtgccccacggtgctgatggggatcttggcccagccatgccccagcacccgtgccctgaccaagagcgaatgagctgacccgagacgggctgccccgggggggctccacccaggccctgccaccaggtagacagtccccatctgagaacggcggctccccaggccaccgtggccccaaagcatgtcccaccctcctctcgggcagtgccaccccagggaggggtccttccctaagaagggacacaggcccctacgtgtctcgtgtgtctcttccaggatgacatggaaggctccggggggcccttctggtcaacagcccgaagcgctgatgggccacaggtagtgttgtgagctgggcgtggccggctctgaggggtaagggggtgttgcctggggcaggagagtgtccctgagagccaccggccttgcatgggatcggaa

SEQ ID NO: 28436 - DNA, 1407 bp, Homo sapiens
aaacaactgtgctcagacagctcagacgtgccaggggcagacccaggggccacaagctccttcctcccctgcccccactgtcccctccacaccaccagcgctctcgtggcgccagcatggaggagcccccggggccacagccctgcccaagagacacgtggggtggctgaagccacagcgtccagcttcatgctcagagactcagcctgttgagagcacgggtggctgggacacatttcttacttggagcaaaacgaatgagaaatttcaattaggcagaaactaattgattccatagtaagttagaatggctttaccattttaacttagtacatttccttttacacacgtattttgaagtcttgactgttactagcgggcttttcttgcggcagacgcatctcacagcagggcctccagctgcactaacactgtgtctcctctgccctgacagggacctcccggcctgccgggacttaaggtcagtgacggatatgtctgggtttctgtggttgctggcttggccctgtctcgacatcttggggctgggggagacagggccttgcctcgggttttctgatggcaggagtaggatgaattcatcctgggaagtttgcaaaatacagcaaaaaagcctgacagggaaataatcgcacaccaaccccaacctagacttccagcgttaaggggccattgtcccgttctctctccgaagcccaggaatcaagattcctgggttcacacacctgaagcatattctcagacttgggccgaaaagaggggcataggggaagaactcagggtccccacctcagcctcagggacaggtggactcctgggctcagggacagagccgtggtgaccttgtaggacccaggagctttgtcctctgctccccccatccctgggggacactagcccccagcctggccccgaagaccccaccccacccaggccccgaagctcccagggcaggtgcctgagcagggagcctggagcctcctctcctaggccctgggcagcagccgcctttcaccccgctgcgtgctcatcaaagcgtcctctgctgcgtgcggggccaagggcgcacggggcccaccctggggctgcactctcacgcgtcaccagcccctgccatggcacctgctcctttgagctttgctttcatttgcaagacatcgggacactcaaaaggctgacttatgggaagggccgtgtgtttgctttcttaaattgtttgaatgaggccgtctcagcggggttcctcttgcagtctgcagtcctagtgatggaatatgtccccaggttccgcagccgtcccggccgggtgccttcagccagcctgggcccacggggtccctgcacaagttgctcagtgtccctgggacccctcggctctgggctggg

SEQ ID NO: 28437 - DNA, 1774 bp, Homo sapiens
cagggagatccagggaaggacggagtcgggcagccgggcctccctggcccccccggacccccgggacctgtggtctacgtgtcggagcaggacgtaaggacgctgcgtgggtgggcacccaatctgtccagaccccccacggggtgcagagatccctccccgagccccccccacacccccacatcccccaggtcaggacaggccctgactgccagtctacactccacctcctcggtgggggctgcagacgccctcggtcagagacgcctggggagcccagctccatgtggtgttggagacaccgaggagaggggagggcctgcacaggggccagtgtttttacgtcaaaggctcccattgggctcactccctgtgtccttgacactgtggccccaaagctgcatgtagtcacccagctgccccgtcagaagaagcagatgcacccttggcccctctggtgaaggttgtgttggttccggaaccttcctcccccactgcggcccgtccatcaggcctctcagctgcaccctctgcgcctgccagcagtgcatcccactggtccctgtgccaccctggcctcacagaggcagacgcatctccgcccagccacatggaacacagggaccaagccccactctgggcagggagctgagccctgggcagatgcagggcccagggcagcagagctgggtgtggccaggggttcagatccctgcagagttctctgtggccaccagtggaaggggggctgcccggggcagagctgagagcaggcaccgtcagctgtgtgacactggacaagttacctaacccttgtgctccagctccccacctaggaggtgggactctaacagtcttgagaggaggggtggagttgggaacaggcaggagagggcttgccccagcacggctttgctaggagcaggcagacaggcatcgggaggcaggggcagcccgagaggccacagggacctcggcgtgacggtcaagacatcagaacatcagaaaagcctcccgtaggccgagccacctccgccggcaagcaagggagcgtctagcagaggcaggagcattttaaaacaaaatggaagtaaaaaccatggcccttagggcgtctggagtctgcatccagctgctctgagctgaggggcgtctgtgctgcaggagggatgccccaggcccaggaagactggaaagcaacattttccttgaatttcctggtttggtgttttgttgatctgtaagtcgctcgagtccagttgaattttaaacgcggctctttgtttccgatttttccttttgctcgtggacagggatccgtcctgagcgtgccgggacctgaggtatgtgcctgcccagcttctaagagacgggcctgcggggacctgggtacaaggctgggtggggtccgggcaggcgcgagggtgcgtgatgaccccagctgacgccgtccctctttccccagggccggccgggtttcgcaggctttcccgtgagtaacctggtgccagagctgcatgctgcccggctggggaggggtctccacctggtagcacagagcagcccggtcgagctggggtgggccttgtcaggcccgagggatagcgacagtcactgcccccaaggaaatgatgggagtgggatgtgggcgagagccgctggcaggccctgtgctgggtgggcacccgtgagggtgaggcagctccttgcacctgcagaggcctgcagtgtccagagtgaggctggggccgggaggtgtcctggtgggggtcac

SEQ ID NO: 28438 - DNA, 1031 bp, Homo sapiens
gcccagtgcacccaaagggaccacagcggcccttagggaggctatcaggtggggcacaagccgccacctaaccgtgccttcgccacaggggccctcagagaggctgccaggtggggcacaagctgccacctaaccctgtcttcttgtttttttgctcagggagagccgggcttccgaggacccccggtaagtcggtccctggctttctctgcactgagctcgggcatgacggcccccaaggacacggtcgcccgcggctgctgagcttgtgctgtgcggcccagggctcatctccctagtgcagttttaaagcgtgtggggcaggtgtcggcgtgaggctgcagtgggctcctccgagctgatgggtggcccagggtgctgtgctctgcatggcccctccccttccccaggaccccccaactcgtggtcaagggccagggtctgccccactaagcctggcccccttcctcttgcagggtccatacggacggccggggtacaagggagagattggctttcctggacggccggtgaggacctggggtctccagtgggggcggcagatggggtctggcaggtggggagcagcccaggcccacgggggtgacatgcccagaggggagtggacggccgccgcacccactgtcctcccccaagaaccggccctgcctgagcgcagctcttgtcctggatgtggctggcagtaccccacgaggggccagtacccaggaggaagccctggaggcagacagggcagtgggcctgtgtgtgctaggctcagtcacctcctcccaaaagggtccttgtgcaggaaaggggtgagaagggccggggtagcctgagagctgggaacgtgtgaggctgagcgtgggccggccgggcctggcgtggggctaacggcaggcaccctgcgggaaggtgtctggtaatcatcagtgcccagcagtccccaccccctgtgctccgccccagggtcgccccgggatgaacggattgaaaggagagaaaggggagccgggagatgccagcct

SEQ ID NO: 28439 - DNA, 1140 bp, Homo sapiens
ggggcccaggctgggctgaaagcaggcctggcttccaggaactgtgaccccacgagtgcagtagaagcaagtgggaagtgcccacagggcagtggtcttccacgtggctcaggaatccaggagaagcaggtggaagtcagaaacccctgggagcttaggtgcgtccagggcatcctcagccctcacactgcagccgcaggggccttgccctgcacaatccccggtctcccaggtggtggggcctccacagccggtcacctccctctgcagaaggacccccaggggctccacagccggtcacctccctctgcagaaggacccccaggggctccacagccggtcacctccctctgcagaaggacccccaggggctccacagccggtcacctctctctgcagaaggacccccaggggctccacagccggtcacctccctctgcagaaggacccccaggggcttcaaagccggtcacctccctctgcagaaggacccccaggggctccacagccggtcacctccctctgcagaaggaccctcaggggcctccgcagccggtcacctccctctgcagaaggaccctcaggggctccacagccggtcacctccctctgcagaaggaccctcaggggcctccgcagccggtcacctccctctgccgaaggacccccaggggctccacagccggtcacctccctctgcagaaggacccggagcagggcccagcccgagagggagcacgggtcctgacagcagcagtgacctccaaccccagggacggctcctgtgggatggggggccctgggggtgtggagccacgtgctccaaagcttctgggttacagggcatgcctccaggggtgaggtggtccccaccccggtcacggtttcaggggaacagtcacaggagaaggtttgcccagggccgtctaaggtcccacctggaaggagaaggggttttgtcatctccgttgacaaaattacagctttaagtagtacctgtttctacacatcagcctaagatgttaaagaacaaacagcatttaaagaacaacaaacagttatttgatgaaaatagatgggaagaagtattaaacatcaaaaatgagtgaagagaaattgcgtatgttttatatataaaaa

SEQ ID NO: 28440 - DNA, 1074 bp, Homo sapiens
tgagcattttttcatgtgttttttggctgcataaatgtcttcttttgagaagtgtctgttcatgtcctttgcccactttttgatggggttgtttgtggcacatatacaccatggaatactacgcagccataaaaaatgatgagttcatgtcctttgtagggacatggatgaaattggaaatcatcattctcagtaaactattgcaagaacaaaaaaccaaacaccgcatattctcactcataggtgggaactgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacatcatgcacatgtaccctaaaacttaaagtataataataaatttaaaaaatttaaaaataaaataaaaataaaaaggcaccattaacaaaaacatcagaaagtatcggttaactaggaagaacctaattaaatacgcgatctctaccgcgaaatggctagaagggcctcaggcaaacccaccagtgctgggggctgcagagggaacccggcgctgtcagacaccacctcagcgagaccccgcctgtctctctcttgcagggcagtttccgtttgactttcttcagttggaggctgaaatgaaggtgggtgacctccctgtggggttgggggcccccaaggtcctgtacatcccgctgggtggctgctcccaatttctcgccccatccggcccaagcccccttcctgttcagccctgcgaggggcgctggctccagagggtgtcgagggcgtccctcaggatgttcctgtccccggctcagtttttgggggactcggctgatgcagtgggaggtggggagtcgagccctattctatgcagccagcagctcccaggcctgggctccggaagcttctgactgcccagccctggctcggggggatgggaggccacctgtggcttgtaggggttcagggctcccgtgtaacaagt

SEQ ID NO: 28441 - DNA, 1039 bp, Homo sapiens
ggccctccagggccacgtgacgtccacagcacggccccggctggggggcaggctgtcccgtggctctgcaccccgcgttataaacaccaaggtgggatgaaatgcatcctctctgcttagcacgggccttgctcaccagcctggctcctcagacacacctgggattgccccttccaggacaggccagcccctttcctgctttcccaaaatggtctgggtggcaggagtggccgctctgatccaggtgggtgcggccatgcttgcagggccccgggaaggtttaccttcgtgtggcaaaggtgaggacgggtagaagccccatgccgccgaaacggcctgtgacatccgtgggagcctccatggcagaacactgcacactgacacagccctgactcctggagccctcccaccttccaacacacccaccttccttctagagccctcccaccttccctctggaaccctcccaccttccctctggagccctcccaccttccctctagcactccctccctctcgccaccggccccctcctaggcctggccagcccctgcagcaccccagacagtgaatcccactccagtcccttcatctggccagggagaggctgccagtctcatagcagatgctgagctggtgcccactgtgtgccaggtgtgcttgtaggcacccggatgcagccccatcctaactttcaggggctttggtcctgacaggaggaggcaggggatggcatcctagcaaacgcgtgctgggagggctgggtgctgggcagggagggcaacctgccgtggactgggagggctgggtgctgggcagggagggcaccctcctgtgggctgggagggccgggtgttggggagggagaggcgggtgctgggcagggagggcaccctcctgtgggctgggagggccgggtgttggggagggagaggtgggtgctgggcagggagggcaacctgctgtggactgggagggccgggtgctgggcagggagggcaccctcctgtgggctggcagggccgggtgctgggcaggg

SEQ ID NO: 28442 - DNA, 1024 bp, Homo sapiens
gtctcagtcaatttagaggtttattttgctaaggttaaagaccatgggctatgacacagcctcgagaggtcctgagaacatgtgcccaaagtgtgggttttatactgttttctgtttttgacactctgtactctttctcacggatctgagtttccatctggcatcattttcttcagtctgaaaattttcccttaacattgtgttgttgtcgtttttgagatggagtcttgctctgttgtgcaggctggagtgcagtggtgccatctcggctcactgtaatctctgcctcccgagttcaagcgattctcctgcctcagcctcccgagtagctgggatgacgcccaccaacacacccggctaatttttgtatttttagtacaaaccgggtttcaccgtgttggccagaactgctggcctcaggtgatccgcccgcttcggcctcccaaagtgctgggattacaggcgtgagccaccatgcccggctgtgaacattttttgtagtgcagttctgctaggtatgaattctctccatttttattgattgataattttgatgatgtctttattttgccttcattttgaaattctctctaaaattttaggttagaggttttgggattttttgcccatatgtaatatgtcattcctttgcctctggcttccactgtttttgatgagaggtcattccttaccctgttcattctctttgtgcaatgtatttttttcctattgctttgaaaattttctctgtctctgattttcagcagtttgactagaatgtgtgtgtatatggttttcttctcttctgtttttttatgggagtttgttgagcatctttatatgtgtgattgacactagccatcaaatttagaaaatggttagccatcatatttaactttttcccatttcagtctttcttctcttctgggactccagttaaacatattttagaccactcactattgtcacgcaggtctctcaggttctgttgttttatttttaagcttttttttatctatctgtg

SEQ ID NO: 28443 - DNA, 1017 bp, Homo sapiens
ctggtgcggggctgtctcggcgccccgtgaatccgtttgacccctcacctggcagtgagtccagacgcacggcccccccgacccccgttctagaagaagtcgtgcgctgctggttctgaatccagcgagaaaccttcccgtgaggtctcacttgtccggtcccgtgccggggacgccctgcccttcgggggaggttgtgaaggtttctgactcccctcgaggcacaggagcggtttggggtctctcactccaccccctccccaccgtccccaccgagggacgtcctgctgccttttcccgggagagcctctccgggcccggggctctgtgctgcaggcgctgggctggccgggagggcaggcccagcagagactcggggaatggggcgagagcttgaaggcccctctcctccatcttcggccagactgccccgtggacctgttctttgtgctggacacctctgagagcgtggccctgaggctgaagccctacggggccctcgtggacaaagtcaagtccttcaccaagcgcttcatcgacaacctgagggacaggtaggagggacgccccgtgaccttcctcctgtgcttctgggcctcttggagggaggggtgggggcccaggggaacacgggtgcgacggcctcaacctcctaaggttgggcgagcgttgccctgaccggggcccctcccggcgccctccagagtgaggccggggccctttccggcgccctccagagtgagctggtctgagcctctcccagcgccttccagagtgagctggtttgagaccctgctcgcgggggtggcacctgttcagcagggccgaggtgacagtgaggctgagatgtagggaagagaggctcccgcaggctgaccgagagggctcagcgcactggcccagacacgcagtcctgcctggtgcgcgggagcccctcactaaccacctggaccctggtttgttccgtgggcagtgagagcctctacctgggtcctggatcccacgttctgaaggtcc

SEQ ID NO: 28444 - DNA, 1053 bp, Homo sapiens
cctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctccctgtggttatcttccccacaaagtaaaatcctgccgtgtgccccaaaggagcagtcacaggaggttggggggcgtgtgcgtgcgtgctcactcccaacccccatcaccaccagtcccaggccagaaccagggctgcccttggctacagctgtccatccatgccccttatctgcgtctgcgtcggtgacatggagaccatgctgcacctgtggacagagaggagctgagaaggcaacaccctgggctttggggtcgggagcagatcaggcctcagtgggctggggccggccacatccaccgaggtcaaccacagaggccggccacaggttctaggcttggt

SEQ ID NO: 28445 - DNA, 1033 bp, Homo sapiens
gtatatggtggtggtcatttactaaaatagaggtgtcttttatttatttagtgacaggatctcagtctgtcacccaggtgggaatgcagtggcacaatcattagctcactgcagcctcaaattccagggctaagtgatcttccgggctcagcctcctgaatagctgggactacaggcgtgtgccaccacacctggctgatttttttaaagtttggtagagacacggggtctcgctatgttgcccaggatggtctcaaactcctggccacaaggaatcctcccacttcagcctcccaaagtgttgggattataggcatgagccaccacacctggcctaaaatagggaaagtttgattggaaaattcagattaaagtggggacaagttatactagagatgcttattagacattcaagtgaaatattgagtaggctggcattcaggagagaacataatgctagagataggaatttgggagtcatttgctttcaggtagtatttgaaatcatgagattggacaagatgaattaggaaatgcacataaaaaagagaagttctagaatgagccctggggcaccgaccttttccagtatagaggaatggccagagagaggaggaaaaccagaggaatatgaagtcataatataagtgaagacatggtgatctttgctgaggctttgaagggattgcaaaatgaagacagaatttattattggatgcaacaaaacaatgtattggtgactgacaagagctatctaaagagacatggggggaaaagcctaatggcagaattttgaaagaaattttcagttaaacatggcagactgagcataaacattaacctccatttcctgcccaaaccctactcacataaagtaataaaagaccaaaaaaaccccacaaagaatgggagaggagacactagtaagcaagagaagtcaacaaaattatagagactgggaatggatggagaagtgataactgagttagctagagaaagttgagacttacgtttgtgggtgaagccaacaaga

SEQ ID NO: 28446 - DNA, 1018 bp, Homo sapiens
ccactcacttctgacagacagaagccaacaaaagcaacaggatgtcacttctaagtttaggttataaacacactcagacttccatctaggctcacctcttgctcactctgatgaaagccagctgccatgctgtcagctggggagaggcccatgtggcaggaactgaggaagtctttggccacagcctgcaaggaagtgaatcctgacacaagctcactagagtgagctgggaagtagatacccttcagtcaagctttcagatgaggccacaatcctagccaacattttcatttccacccatgagaaaccttgagccagaagacccaagctaagctacacctggattcctgacccacagataccatgataacagacattattttaagctgctatgttaggagtaattagttatttaggaataaggtaactaatacatttatattaatgggaagtcagcagagaacatttaaatggataaactgagaaatggctgtgtaagtgtgtgatctggaaacaggagaaaaatgcagccctgaagaaaggagttaagagaggaaggaggagctactatgtctcattttaaatcacgtgggtggcattatttgacttctttttaagtacacggaagtgttactttcttaaatgaaaatgaaggtaacagcagcagtaaactaatttccagtagatgaaatgtgactttgtaatcccaggaaaagggaagaatttgcaccaagaagttactgttacctcagaatggcaagagcatggatggctcttatcatcatctttatacttcttttacatttcctcattttttaaaagttttgtgtacatattacatttaggaaatccaatatatagtattaaaacagaaaaagtaaagaagcaggctgggcttggtgcccactactcaatttgactggcttaaaaaaattttttaaacgacatgtacggacagacataatacttgcttctgagcctcccagtctttcaaaaccacattagggaataagcagta

SEQ ID NO: 28447 - DNA, 1044 bp, Homo sapiens
agtgaattagaagagagaagcaaactgcttctgcaatatttttgcagttttaagtgggattcgttaatgaatatgtgcacattggaaaaattaaaacaacactgaaaataaacagactggggtaaatatttccaacaaactcaatgtaatagcagtcaggttattatctacattctgtagatgacttcattcaaggcttcccacattgtagcagcaggaattggagcaatcctttgggaaagcaacttggcatttcaaacacatgtatcctttagtcctgtggtgacacacccaagacaataaaccaaaaggcagaagaggccgggtgcagtggctcacgcctgtaatcccagcactttgggaggccgaggtgggtggatcacgatgtcaggaattcaagaccatcctggccaacatggtgaaaccccgtctctactaaaaatacaaaaaaagttagctgggtgtggtggcatttgcctgtaatcccagctactcgggaggctgaggcaggaaaatctcttgaaccaggaagtcggaggttgcagtgagctgagattgcaccactgcactccagcctggcgacagagcgagactccgtctcaaaaagaaaaaaaaaaaaagaagaaaagaaaatgctgaatcacgtaaaaatgtattgaaatgttaatttattggctgggcctataatcccagcactttgggaagctaaggtgggaggatcacttgagcccaggagttcaagaccagtctgggcaacatggtcaaaccttgtttctacaaaaaataaaaacaacaattagccgggcatggtggtgtgcagagctgtcgtcccagctactcaggaggctaaggtgagaggatcgcctgagctcaagaaactgaggctgcagtgagccaagactgcacctctgcactccaccctgggccacagagtaacaccctttttcaaaaaaaaagttaccattttctgtaataggaaaataagaggagcatcctaaatatccagccataggtgactggcttagtgtgaacagtccttaacta

SEQ ID NO: 28448 - DNA, 1032 bp, Homo sapiens
aaattggggcaagaagggagagatttagcttttatatcattttaaaacttaaatatgccttgattaagctatcaatcttttatacaaattttttttaaagttttatttttctgtaaactgccaagggctaggaaagctattctgccaatcagccgtatggttttctttaccaggcataattagcagtcctcattgttagaccccttggatatagatattgatgaaggcagtgtttgtggagagccatctgttggccaggtgtggcagagtagactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcaggtagatttgctcaatgttgtatttgaacatttcgcttatcttctagtgatttctagtgtgatttactaaagatggtctttggtctgtttttgcctttcaaaagtgaggaaagagggtgttattttagtttataaaaagtgagggccgggtgcagtggcttacgcctgtaatccccgcactttgggaggccgaggcaggcggatcacctgaggtcaggagttccagaccagcctggccaacatggagaaaccctgtctatactaaaaatacaaaaattagccggacatctggcgcacacctgtaatcccagctactcgggaggttgagggaggagaatagcttcaacttgtgaggcagaggttgcattgagccgagatcacgccaatgcactccagactgggtgacagagcgagactctctctcaaaaaaaaaaaaa

SEQ ID NO: 28449 - DNA, 1024 bp, Homo sapiens
catacctcctcttcctgtccattggctctaaaatggtgggcaaaggtcaggtaccagtcagctttttccacagaattcctgacattttaataagctaaacatgcagtcatcaggtattaacccctattggatcttggacatcagctttttcccccttttttttgagatagggtcttgttttcttgaccaggctggagtgcagtggcgcaatcatggctcattccagccttgacctcctggcctcaagtgaccctcctgcctcagcctccctagtacctgggactacaggcatgtgccaccatacctggctaacttaaaaaaaaatttgtagagacagtgttacactgtgttgtcagggctggtctcaaactcctgtgctcaagtaattctcccacctcggcctcccaaagtgctggaattataggtgtgagccatcccacctggctaaaatttattttctttatacatgtataggtaaactaagtagtatgtgtagaatagagccattgtctttctgctgtacactaagttaggaatcaaatttcttaagccattttgtcaattatgtatataaaaaccattggtgctttagaagcagatatttcattaacttttttctgattatatcattgtacatcatcagttcagtctaaaaaggagtttttttcatatgtattataaaatatttcatgatatttgagtttagtatgcctttaatccagttgtagatgttaaaataggagtaattttgtgttcaaaataatgatcttctgaaaagtgaaattctaggaaagagtccactgtttaaagctagcagctggtggccgtgtggccgaataatgtcccaggccagggcactcccctctcagatggttggtcatgctgcgtcggagatcaggaatcctcaaggaacctttatgttatagttgtaccagtgctttaaacataatgaaaggtgcatttgttttattttacccatctataaattgtgagaggtttggctatggagagtctagtgagctta

SEQ ID NO: 28450 - DNA, 1050 bp, Homo sapiens
ctggatgcttctgcttttctgtcctgccagcattcaggggagagactgggtgtaaggcctgtcaggacagtttagttgggggccatgactgcccattcttttttttctttgagacagggtctcattctgcctcccaggctggagtgcagtggcacaatcacagctcactgcagtcttgacctcctgggctcaattgatcctcctgcctcagcctcccgagtagctgggactatagttgcatgccaccacatcccactaatttttgtatttttttttttgtagagatggggtctcactatgttgcccgggctggtctgtaaccctaactcctgggctcaggcgatctgcctgcctcagcctctcaaagtgctgggattagaggcatgagccacgttgcctggcctgctcagaggttttgactgtgtgatttaaatttctttagcacagataatcaactattgagtttaatttttttttcttttaaattagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgtaagtaatgaaaatgagcaagtttggagtgggactgaattttcctaggtagtactggaaggaatgtcgttcatgtcaccatgcgtcattgcgcacgtttcctaccttctaaatgctggatggccccatgcacgtgtgacacgctggtggccgtcatgggtcacaggtctctcagggtccttaaaccttcctgatctttgtttcagagatttttcttggcatgttcagttgctaaattattacaaagcagcagctttgtggttgttcacttttcatactccagggttgtgtgttccagcttgaccctcatggtgggtggcatgggtaggcgatgtcccctggtgctatcaggcatgtgaggctcaaacgaggggcccgggggcgcc

SEQ ID NO: 28451 - DNA, 1081 bp, Homo sapiens
gatctcatttctagccataaagtaaggttttgaacctgaaaggtttgcttggtgaagagggactgctcctgagaatgggtgatgcagcgccggattctgaggttagaaatgacttgtttcttcacgtggacagctctgggtgctgcccagtgtggacactggcccctcagtcctgaggcacagccctgagacctgcaccctgctgggtatcgtgtgggtctgtcttctctggaaaagtcagattctgtctcgcttttccagggactcatgctaaagaaattctgtccgttttatctgtgcatagcacaaggaggtgttcgttttctgaaatcgtgtgtcacctgtgtcctttaacctgtacttttgttcttctagggtgactgttgttgttgttgttttggagggaggatcttgctctgtcgcccaggccgaaggtagtgatgcaaccacagctcactgtgaccttgaacgcctggcctcaagtggtcctcctgcctcagcctcttgagtagctgggactacagatgtgcaccaccatgcctggctaatttattttttgtagagatggggtctcactgtgttgcccaggctggtcttaaattcctggcctcaagcaatccttttgtctcagcctcccaaagtgctgggaccataggcgtgagccgcgcctggcctggactattatcggaatactcctagagcgtctttgcagtatttttgtagttgaggtacaggtttgcgcgagtaagttagctttttactttgctgctagggatgtgcatgtcaatactctttttttttttttttttttgagacagagtctcgctctgtctccaggctggagtgcagtggcgtgatcttggctcactgcaacctctgcctccctggttcaagggattctcctgcctcagcctcccaagtagctgggactacaggcatgcgccaccatgcctaatatttgtatttttagtagagatggggtttcaccatgttgcccagggtggtctgatctcttgacctcgtgatccgtccgcctcaccctccctaagtgctgggattacagatgtgagccaccgcgccc

SEQ ID NO: 28452 - DNA, 1054 bp, Homo sapiens
tttcgacatggttaaccctgccctagtttctcactctggtttgttttctttcctttcaccctggctctgcggttgtgtgactctgcgccagctaccggccctgaccactctcccggcagggcctaggctctgacggtggcgtgaacccggccctggtgtgcagcggccctgcctcgccgtgttgcgtgacgcccccttcgctgtgtggtgttttgtggctctcttcaggtgttgccatctgtcccttttgttctctttgtctccttgaaaagttgatgggcctgcagccgcacaggcagttgtgggcatggtgggcgctgagtctggaggttgttcaaggccagcagcgttgcccagagccctgctgctgacgctgccgtcactggttctagctctcacattctcagctgcacgtttctgtttccacctcagtaaacgcaaactcttgttcataggcacagctgtcactgcagcacacaaggactcaggtttgtaaagacaaacgattgatttgtgtgtgacgtgctgtttgtttgcactggattttgcaaattatttactaaagaaaagtacttcagaccttttgtggcaaacaataaatacagcgatactctaatcttcagtattcataaaaatgggtggagttgtcccattttaacgccccagcaaaacaggagcatttctctaacggtctttactacagtgcctaagctacagtttgtgctgcttttcagaaactgatgtcttgtgatagttacagctgttcttgggctgggtcccagctctggtctccagggagggcctgggccccctggatcccctgtgcctgttcagcgtgggtgtcacctgcttcgccagctgggattgcgatcctcgtgtgcctccctgagtctgcgtgcatgtcagcaggcaccctgccccagtgcccctggccctgaagatggtgatgttctgggccaagcacagcccaggtcgtgtccaggcccagggagtgcagtcaggggagcagctgccctcaggcctcgccgcacgtctcaggttgtgaatgttaccg

SEQ ID NO: 28453 - DNA, 1044 bp, Homo sapiens
ttgacaccattcaccgagcctgactctctggagattgatccaggttactgagtgtagccatagtttgttctttatgttgctgagaagtattccattctttttttttctttttctttttttttttttttttgagttggagtctcatgcagttgcccaggctggagtgcagtggcgcgatctcagctcactgcaagctccacctcccgggttcacgccattctcctgcctcagcctcccgagtagctgggactacaggtgcccgccaccacaccccgctaattttttgtatttttagtagagacagggtttcactgtgttagccaggatggtctccatctcctgacctcgtgatctgcctgcctcagcctcccagagtgctgggattacaggcgtgagccaccgcgccggctgtagtattccattcttttctatcagaatagatttcattttcctaacaaattctgtattatagagaatgcctttcttaacacaacatcaccctatacttcctttagatctctgttcagcctctgggtctaggtctccctgtgcagcctgtgggtctgggtctctgttcagcctgtgagtctgggtctcttttcagcctgtgggtctaggtctccctgtgcagcctgtgggtctaggtctctgttcagcctgtgggtctgggtctctctgtgcagcctgtgggtctaggtctccctgtgcagtctttgcgtctgggtctccctgtgcagcctgtgagtctaggtctccctttgggtctaggggagggcatagggcatctattttgtctctgttgttttgggtacttttttgtttggaaaatgggtttttataaaacattctattgtattcctcaagcattttttgttgttttaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccag

SEQ ID NO: 28454 - DNA, 1105 bp, Homo sapiens
cggtgaatgaacacagcgtgggagaattgtgtgtgtggtgcccacgcggcacgtgctcggtgaatcaactcagcgtgggagaatcgtgtatgtgtggtgcccacgcggcgtgtgctcggtgaatgaacacagcgtgggagaattgtgtgtgtggtgcccacgcggcgcgtgctcggtgaatgaacacagcgtgggagaattgtgtgtgtggtgcccacgcggcgcgtgctcggtgaatgaacacagcgtgggagaattgtgtgtgtgtggtgcccacgtggcgcgtgctcggtgaatgaacacagcgtgggagaattgtgtgtgtggtgcccacgcggcgcgtgctcggtgaatgaacatagcgtgggagaattgtgtgtgtgtggtgcccacgtggcgcgtgctcggtgaatgaacacagcgtgggaatgctccctgagtgaacacagcgtgggagagtctcaaaaaacaacaacaataacaacaaaaaaaattttcaaattgattttccatttttccaatttaaaactgtaggcttatttaattaggacatttcatatctgtagggtcagtggaatatttccctattaaggttctgtcggctctgttttgatatggttgttgttattaccatttccaccggcatttctgcccaacaaagaagaggagatagtgcgtgtgaacgagcagctctaggcaccgcaggtttacctcggcgaggtacgccactccctggtgctgggggagaaggggctcttctcacgcttctggctacgcctgcgtctcctgtacgaagtcctcatagtttctgggtgtgattgactggggccttggctttccaggatgacagtcttctgtttcctcatacaatatttataatacttttcaaaattaattttatcagttgggcacggtggctcaaacgcctgtattctcagcactttgggagactgaggagggtgggttacttgagctcaggagttcgagaccagcctaaacaacatgggaaaaccccatctctactaaaaatacaaaaattagccaggcatggtgacacaccactccggagactgaggcaggagaatcacttgaacccaggagatgg

SEQ ID NO: 28455 - DNA, 1083 bp, Homo sapiens
tctcccgcctgtgcctccctcctgcctgtgccctgtagagaagccgaggcaccagacgccgcagtgctctaggactgagccgagttctcttcagacgatgggagagaagccactcagcctccttggaatcaaccttgaaggcagaattttgtggaacttttcataggttttctttcctctcccagtttagcagatcattttatggcaaaaccattgacaaaaacttggctaaacaagtgagtgatagaatgatgccactacaggagcttagtcaagtggtaaacatattcccaaacaaaacagtcttcacatcagtgaaacctcttctgagactgcgcagtaagtcctcacttagcgttgccccgaggttcctggaaactgaccttgtaggaaggacactcctgtgctgctggccgcagctcccgttgtctcagagggccctgagggtgcctttgttacatgcgtttaaaagtcgcggtttccaaaacccatccatgacgttaagtgaggacttactgcattcagaataaaacttgttttactttatttggctgggcacggtggctcatgcctatgatcccagcacttcgggaggctgagacaggaggatcgttggagcccaggagttcaagaccagcctgggcaacatagtaagacccctctctgtcagaactgagtcagttaaacctctttttttcattaaaataaaaaaacttattttactttcttaaacatggaaattggagattttttttttaatcagttttttatatcttctttgcatttcctttttttttttttggtgagacagagtctcactctgtcacccagcagtgcagtcacagctcactgcaacctctgcctcctgggctcaaacgatcctcccacctcagcctcccaagcagcttggattacaggcgtgagccaccacacccagctaatttttgtattttctgtaaagatggagtgttgccatgttacccaggctggtcttgagctcctgagctcaagtaatctgcccacctcagcctcccaaggtgctgggattacagtgtgagccacagcgcctggcctcaaattttt

SEQ ID NO: 28456 - DNA, 1029 bp, Homo sapiens
tgtgcttgggtgtgtgctcatgtggtggtgaccgcgctgagcctctgggctctgggctctaggctggtcgtgacaccagcttctccatagggccgtctgcttacccctcagcctctctggcgagacagtcaagtgtgtgtccggacaccagctgctgcgtaatcggtgggataaagcagccgcctcgtgttcacagacctgtgggcagggcctgctggggatggttttctctgctccccgtgcccagcacaggcagcttcaccccacgctggtggtcggcactggcctcagccggaccacgcacagaggcctcctgggtggccatcgtgtggccttctcgtagcgtcccaggtgggcagggagtgtgtgatatgtttgtgatctcgctgtggacattggcctaaagccctgccctgagctttgtccaggcttaggcgggggacggtgtccccctcagggagcaggtggagtggaggaagtggcggggccatctttggagtggcttatagagaaattcactccaagcctggcttccgtgttgtctctctgaaggtcgggagaggtgggcttgaaaaccttgtagcttgagaagtgggtgccgcctgtacgaagccgaggcggtgccctccctctccacagctgcccgcccttcacagagtcctggcggcagctcggggccgcaggtggtgtagagcgtggctgtgtggggtggcaggcaactcccttctgacgcgctttcccgccacaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggtttattttgcccttcacacacttcttttccaaaggatttaaggagcttgtggtaatggccgcgtccttagggccacgtggacactaggatttctttctttttttttttttttttttttttttttgagactcggctcact

SEQ ID NO: 28457 - DNA, 1656 bp, Homo sapiens
gcatgccaccatgcccagctaatttttgtatttttagtagagacgggctttcaccatcttagctaggctggtcttgaactccagaccttgtgatccacccgcctcagcctcccaaagtgctgggattacaggcatgagccaccgtgcctggcctaggattttttttagcacggccaaaaagactgaggtccaagaaccctggggaggccttcccatctcccacagccagcgcaggctctcggggcaggttccctgcgggacgtggaggtgtgtggggggcagaagggctcagggctttcaggcctgtgccctgtgtgagcctgcggggaggctgagagtggtccctcctggccatgtggccctgcggactcggcccattccagcacttgtcccccagggcctctcctcctgccactcgggtgacttgccctccggcctcattcctccccttgggtctctcctacctccccctccacaccccaagccccagcaactggacctcagggcctcacctctgtgctgtcgaccccgcaccccacttttccccaagtcctccccatctccctgcctgtctgcttccatcaccagggcttgtggaggttgtggagtgggtgccaactcccatcacgctccctcccatctccgtgcccaccctgtcctgcccctgtgcctgcctctgactgggatcaaagctttgtgagggagggaagggctttctccctgtgcctggaacgcacagggtgtgctggtgccatggagagccggtgggagggtcagccccacccgcctccgctcgcccctccagcaggccctggttgtgtgcgagcggcagcctggctggcattcaggaggctcattggtgctgcacgctgcccctggggaccagcgggtagccccttgcagccttaggtcccctccaggccctgggccttgaaggcacagcagcaggaaaagagggaaggagctttgctgacattttcctgaccttactttatcgtctttttcagtctcttctgtgctcatgatggcagcctttgcttctcgtgccttgaatggccctgggcagtgtgtgtcttctcttctgtcagggtcatttctgtttgaacggctgtcagtctgctcagctgccgtaacagaacaccccagaccagggggcttaaacagcagacattgatttcacctgttgtggcatcagggtgcccacagggttggattctggtgtaggcgcccttcctggtttgcggacagcgtctccgtgctgtgtcctcatatgatggagacagcgagtgagctctggtgtctcttcctcttcttaagaggcctcatttaccctgaatcacctcccgcaggccccatctccaaacgcagtcacactgcgaactttagggcacaaggatgcaggtgcatttgtgaggacgccacgtttcttccttcttcctttaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcaggtgagtgtcagctctgccaccaggcctcagtttgcccca

SEQ ID NO: 28458 - DNA, 1053 bp, Homo sapiens
ggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgaggtgcgcctgatcccccttcctgggacactggcgggagtccccccgttgtgccatgttttcttggtgatgaagggagacagaacctctggtgggccgcagttgggcagccccaggggcaccgcgccctgctgtccctgggttgataatcctgtggtggggggtgaagcacacgtgtgggacctggcagggctctgcctcccctcctggagctcccagcccccgggaacacactctggcccacgtggtcagattgttctgcgatgtctccacgcagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggtaacagggtgtcagggcaaggcagccggcatgggctgtgtgcactggaagcctgaagccatgctcctctttcatccttcttttcctgttcttcatggcagtgcacccagttgacagcagtgtgacgtagcaggatagggctgtgtttgcaggtaaaattgcaccttggtgtagtggcagccaccacagggcgaagagtgcgatgacccgtggtggcacgatacccctgctcggagcccccccccgtccctgagcacttgctgtggagatggacacagcctcctcgctggcatccagacagagcacagcctcagaggtctgtgcacaaggcaggctggtggtggggcctctgctttgcatggcggaggcccagcaggcctgctgtggcttctgagcaagtctgtgccagttccatgggttatggctttcaaca

SEQ ID NO: 28459 - DNA, 1029 bp, Homo sapiens
cgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctggtgagagccgcctgccggcggacgtccacacctaaaaacgataagcaattggagttaggatggttcacgtgggggacgcgagatttatgtctggccctctgacctggtctgctctggtctgtgtgccctgacgctggcaccacactgctgttactgtagctttctagaaagtattgaaatcaggaagtgtgagttctccaacttcgttcttcctcttcaagatagtttcagctctgtggggcttcttgctattccacaggaatttgaggattggtgtttgtatttctgcagaacctgccactgggattttcttagggatggcattaaatgtgctgattgctctgggtagtattgacatctggacagtgtgaggtcttttgatccacgattacagaatgtgtctcttcatttaattaggatttttttgagatagggtctggctctgtcacccaggctggagtgcagtgatgtgatctcagctcactgcagtcgccgcctcctgggttcaagcaattcttctgcctcagcctcccacgtagctgggactgcaggcacatgccaccacgcctggctaatttttggattagtagagacagggttttccatgttggccaggctggtctcaaacttctgacctcagg

SEQ ID NO: 28460 - DNA, 1033 bp, Homo sapiens
agagcaggccgggcacggtggccgatgcctgtaatcccagcactttgggaggccaaggcaggcagatcatttgaggtcaggagttcaagaccagcctggccaacaaggcgaaagcccatttctactaaaaatacaaaaaattagccgggcatggtagtgtgcacctgtaatcccagctattcgggaggctggggcaggagaattgcttgaacccgcaaggcggaggttgcagtgagccgggattgcaccgctgcacttcagcctgggcaacaagagcgagactccatctcaaaaaaacaaaaacactctttggaatagtcgtagttttttttatctccagaagccttggagagtagggaggtggtttggtggtacagacagtgtggccaagcatggcaggggcgtctacacaggaccccagctgagggtgagacgtggtgtgtgtgtttgcctttctcctgggcaagagctcatcctttgatggaatgctcaaaggagtctttactttttgagaacttcctgaaaccacgcctgaagttgccagccaaaacctttaattttgattgtttcttaaaaaaaatagtaacatgagtgcttagaaaatattttctaagttgcttgcttcaggatgcatcttgacctgtattttgagtgaggtggcccttccagagtgatttatttattaattttttttttgaggtagagtctcgctctgtcttccaagctggagtgcaatggcacgatcttggctcactgcaacctccacctcccgggttcaagtgattctcctgcctcagcctcctgagtagctgggattacaggtgcatgtcaccacgcccagcccagctaatttttgtatttttagtagagacggggttttaccacattggtcaggctggtcttgaactcctgaccttgtgattgatccgcccaccttggcctcccaaagtgctggattacaggcgtgagccactgtgcccggcctccagagtgttttttactgaggatagtgaatttgatctggattatagaa

SEQ ID NO: 28461 - DNA, 1090 bp, Homo sapiens
gcgtcctggtccccatgggcagcgaggcccccattctgcttgtttggtcacagtggggttttcattgctctttcccttcctgtcttgccgtacttttaagtgtgtcttgtctcttttttttgtagattacgttttttggttaagaaatggcaagaagtagatcggaaaggagctctggcacaaggcaaagcccctcgcccaggtgggactccagctgctgttgaccgctggactcacaaacctttctttctactcttgtttttcattcactttgggtcatttttcagtgttgatggggacgtaataaagcacggtaagaaaatccgtgaattccgtcagagcagtcgtccagagggaaggcgcgcccggcgtagggaggtcagagctcatgttagctatgaacacaggtcacaggggcgtacggcgatgggaaacactgagatgctcaatatattgattatttaatagtgtttagcaaaatggtctttttttattccttaaatcaactgaaactcacttcacgtctctttccttgtagagcatcatgcttatttctggctcactcacatctttgtctcgggagttctctgccgagccattgccccctacagcagagagcacagctggctgcactagtgctgaaggagccagccccagagcagggcatttccaggggctcttgtcccagagcggcaggcgttgtgtgcagagaacgcccctcccacgcagcacagagaacgcggggtgggtgtgtggctccgggcctgtggggcttaggctgcctgaaccaccgccgactggcaccatgactcggcattcctggaagtgccttaccaagttgttgttgttgttttgttgttttttaagagacgggcttgctctatcatccaggctcgagtgcaatggcacagtcacagctcactgcagccttgaactcgtgggctcaagccatcctcctgtgtcagcctccccagtacctgggactgtgggcatgagcactgcgcctggcagctgtatcagtgttgactccacattttaatagttgcttcttgaaattaaaatgctttgattcagccttcaagccatcagg

SEQ ID NO: 28462 - DNA, 1065 bp, Homo sapiens
tgaaaccccatctctactaaaaatacaaaaaaattagccgagtgtggtggcgggcgtctatagtcccagctactcgggagactgaggcaggagaatcgcttgaacccgagaggcggaggttgcagtgagccaagattgtgtcacttcactccagcctgggcgatagagtgagactcctttctcaaaagttttaagacatttgtacagctgtggaaagcatcactacaatcaagatagtgaccatatccagcacgcccaaaagtgtccttgtgttccttggtcctcctctcttcggatccttctggctttccccatacacttcaggcagccaccgatttactttctgtcactatagattagattgcattttctagaattttatataaaaggaatcatacagcgtttacgtttatggtctgccttctaccactctccataattattttgagattcattcatgttctgtatcaatagtttactccttctcattgagtaatatttcattaaatggatgcaccacaatttggctgttcacctgttgatgtgtatttaggttgtttctagtttgggccggttacaagtaaagctgctatgaataatcaatcttgtatacgtttttgcatagatgggtactttcatttcttttgggtcaatacctagaagtagaatggctgaattatattgtaggtgtatttcacctttttttttggagactgagtctcactctgttgcccaggctagagtgcagtggcatgatcttggctcactgaaacctcgccatcctgggttcaagcgattctcctgcctcaccctcccaagtagctgggattacaggcatgtgccaccacgcccagttaatttttgcattttcagtagagatgggatttcaccatgttgtccaggctggtctcaaactcctggcctcaagtgatccacctgccttggccacctaaagtactgggattataggtgtgagccaccatacccagcctattttaactttttaagaaactgccacgctgttttccaaagtgattgtaccattttacattctcattattagta

SEQ ID NO: 28463 - DNA, 1042 bp, Homo sapiens
tagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccaggttagttgaacctaacaacaggatgctctctagtctaacagtggtaacagcggtgcttgtggttagggtgcggccctgctagacctccagtgccaactgcccacgtctttggggctggggtcaagagccagagcgagtgtgcaccccagaatggtgccacctcccgccttcctggaaccagccacgcatgggggaacttaaccacatcacctgcatggtggtttccacctgcctgttaggaaccaattttaatgataaactcaaggatggcatcttagctttgcatggctaggagatggctccctagggctagaaatgctgcccaggatcatcctggagctggacgagctggacacatcacatcacccagtgtctgtgtggcctcggaaatctctcagcaaacggccaacttgccttccctcattttatacatttaaaagctaattttagagactggtttaactttaatgcaatttttcatttctttggtcctgttgatttttagtacatgccaaagtttttttttattaattattgaacacatatcactaaatacatttcatcaggaagatttaatttcctgatttatacataaagtacagtaaaacaaaatatgttaagaattttgctgtgactgaggccaaatcgtatcctctgagatgcgtcgtgtagtaaacttctcaataaggcgtagtttatgttcaagagagaaattctctttgtcacttagcataaaccttgtagctagctttctgaatatttgtatctcagtagaagagttaaatgcctcattcaagtatgttttcaaaataaaaattgtaaataaaatcacgtgatgtttatatatg

SEQ ID NO: 28464 - DNA, 1658 bp, Homo sapiens
ataggcacagaacagcatcctctgaaccaggaagggttcaaaggaaggaggaaaagccacacagcccaggaaggcagcatgaagagtaagccaggcttgatatgagtcggggaccctggtgccttcacaaccgcagaggcaagggaaggagcttggccaccctgactccgttcactgccatggccacagccacctgtggggagtcagagaggggtccagagagggacccagccaagccatgtgatgtccaggatacagactcctgcagggcagcaggggtgagactgcggacagaaggcacagctgctgtgagggtctcgaggtgggagctacagggaggccagtgggactgggctgagtgtggggagcagaaggagtgcgtgagtgagtgaactcacatgcaggtgcaggggcttgaaaagctcccttcccgtgtcccctgttacagtcacttcaggcggtagaccagccgagagtggagtcgggtgagcttagtggacagcacatctgtgggagccgtgggctgctgcacgtcctcccttctctgagcacagggacatgtgagccgccatcgcacacagctctgcatcatccttggtgtaaactcagcgggtttccctgggtcatggggcctccacgtcgctcttttccctgccctgccatgtacagccgcactgtaattgtttagctcacccccttttattggacgttctttcctattttgctgttacaatcacttgggcctgataggtttgtgtcctggaaagagctctggttttggggctcagctgggacatgcagggagaagatggaggctccaacagcatctggggaaacagaacagtcccactccgccggggagggtctggcggtaaccgtagctcacacctccctgtggcccgtcgtcccctcctcttgcctgccctgagcctgcagtgtcattgcccccatttcatacgtgaggaaactgaggacacagaacaagcatccaggccttgtgcagtcaggtggtctgacctgagcccagtgagggaacactgggaccgggcctgggaggccaggtaagagatggtggcctcttgccgtcctgaattggcacagagccagtgctcagtggttggactgactcggagtcacgggcaggaagaacttcctcatggtcaggttcctggccaagaactaggacagacatgtgcctcctgcagggctgggcacagcagggtcactgcacccctggatggatgcccatcaggtgcgctggcatcacctggctgattgtctttgtaggcttagtgaccctctgcccctcctgacacccagagacgggatcccttctcaggaactggagtcattttgcttatttctattaacatctcttatttctttcaaaattcaaagtcaaatttggagcggcctctaaacttcctgacctgacatgagcacatcagtcctgcaggccagcttctgagggacgttattttaatgtcactgaatcaagagagtctcgtgtcatgttttctttaacaagggacatagctctcctccttccagatcctccccggcgtgaaggtcatcatcgcacacaccgagaccaaaggacccttgggagactcacacctgggagaggtgagcaggggcccatgggaggggcttgagct

SEQ ID NO: 28465 - DNA, 1485 bp, Homo sapiens
tatgaaaggcttagaaatctaacaaaatgtgatctggatgctgaaaatgatgagatgataatgaaagaaaccccagaaaacctaaataaatggagagataagaaggctcaacctagtaaagacgtatgttctttttaaattgatctgtagacttaataaaattccaattagaatccaagcaggatttgttcttatagataagctcattatgaaatgtatatggaatgtaaaggaactagtgctatggtttgtccccaccaaatctcatgttgaaatttgatcctcagtgtggtggtgttgggaggtggggcctagtgggaggtgtttgggtcatgggtgtggatccctcatgaatagatgaatgcccttcctcgtgggtagataagtgagttctagctctttcaggtcccaacaagagctggttgtgaaaaagagcctggcacgcccacttgcctctgctcccaccctgtggtctctgcacgtgccagctcccctttgctttccaccgtgaggggaaatagcctgaagccctcactggatgcccaatcctgaactttcccaaccagcagaaccatgagccaaataaacctcatttctttataaattacccagcctcagatattcctttttggcaacacaaaaatggactaagagaactagagtagctgatagaattttttaaaagaagggtaaagttggaggaactatactacttgattttgaagctacagtaatcaggacaatgtggtgaagggacagacacgtaagtcaatggaatggagacgagagatttctacaaatatggtcaatgggttttttttaacaaaggtacaaaaatcaatttaatggagaaaagacagtcttttcagcaaatgttactggaatagttgtcatccatatctaaaaaacaacacctcaacctcacatctcatacacagctgaacttaaaattgatcatagatctaagtgtgtgaaatgtaaaactataaacctccttgaaaaaatcatagaaaatcttcatcacctggacttgggcaaagactttttactctaaaagcgtgatccatagcagaaaatgttgataaattgaatttcatcaaaactaaaaatgactgctctgcaaaaggatgatgctaagagaataaaaaagacaagctaagattaggagaaaatattgcaaagaacatatccagtgtgtgttctgaatatacagagaaatctcaaaactcaacaggaagaaaacaagccaattgaaaatgggcaaaatacttgaacagacactttaccaaagtggatatacagatatcaaatacacacatgaaaagatgttcagcatagccatcagggaaatgcacattaaagccacagtgagatatcacttacacccattgaaaaatgactacaataaaaaaaaaatctgatagtaataccaactgtcatcgaggatgaggaacagctgaaagtcatgcattgctggagggaaca

SEQ ID NO: 28466 - DNA, 1046 bp, Homo sapiens
tatccaatcatccgttccgatcatggactgcattgtatttcaggttgattttggtgtgtccttggttgagaggaggagttcattcagttggttagggagcttagagtttcatttttggtttacacacctatgtccaggtaagagggccccacacaggagggcttgctcagaacctggcttgcagggctgcttacagaccttctatgtctcctgttgtcatgcacaaggaaggacacagccaatgacaaccctcagccatccagggagaagctgtgtctgcagaggacggtcatgagctgtgagtctagagacctgtgattgtcttcaggggcctgtggtcctcggctttcataggagttgtgggggcactggctcaaatagcatccaccaggattctaatcagaatatctcattcacagaaggcagtgggtgatatgacagtacagagggactctgtggggccagctgcatggagcactctgggagagtcactggcacccgtgctagacagatcttcattcaacttctggagcacacggatttagatctctctacatcattttgaaagaccatttatcattctgaaggaaaccactgtaattaactaaggtaacatctttaataggtagaaagaaaaaactgattattttattgccaagatgattacaagaaaagaaacaaacaaaaatagcatgaaggaaagagcaacactagactgagggctttgggtaagaggttgagacttagtagtgaatgccctgggccatcttctgtcaaaagggagggacaatcagcaaagggaaatatgcagtagaggcaaaatcttggttagtaaaagaatcctaagagaaaacaagaagtctccttcctgagcatcatgttggtgtcgggaagatgcacataatcccctcattgcatgtcttacacttttcagcaattagggctcagcatgaatttagaagacaccattcacttcacagcacatggggacacagtcaaggcagcggtgagaggcaaggctgggctttcagtctcagcgcacagag

SEQ ID NO: 28467 - DNA, 1047 bp, Homo sapiens
tcaaaaagtagtttggcagttcctcaattagacagttatatgcatctgagcaattctgctcctagataaacaccgaagacaaatatctacacaaaaacttatacaccaatgtttatagcagcattattcataatagccaaaaggggtaaacaatgtcctaaatatccatcaactgacaagtgcataaacaaaatccagtgtatccatgtaacagagtatcatgtggccataaaaagtaagtactgatacatgtcacagcatagacaaaccttgcaagcattatgccaagtgaaagaatccagtaacaaaagcccatatgatagataatcccatttatatgaaacacacgcaatagggaatccagaggcagaaagattggtgattgccagtgctacaactgcgggggtgcagatgatgtatgtggagagacagaattgaaagctaaacggcacaggaggcagggtgttgtggtccatgcctgtactcctagctactagggaggctgagatgggaggattgcttgagcccaggagttcaaggctgcactaagctatgattacaccactgtactccagcctgggctggtcgactgagcaagaccccatctcttaaaataaataaataaatagaaagaaaataagctaaagggcataggatttttttttgaggtggaaaaacaattctaaaattgattggagtgttggttcccaacatctgtgaatatactgaaaaccactgaactatatacttcgagtgggtgaattacatggcatgtaaactgccaataaagctgttttagaaatcctaatatttgctgtgctataacttcagcaaagtactgcagggcaataattgcagagccaaccctatcattacagtatgacacaggaaaacttaaaactgcacttacgatcaagctatatgcagagcatattagcacaccaaaaataaatgactacactaaagacccatccttcaaggattacagaatttaagtgctgaaaaggagagtaaaactactctgtttttttaaaaaaggtaagaact

SEQ ID NO: 28468 - DNA, 1420 bp, Homo sapiens
attaaaataaggcagaggaagaaacacattgtctacagagaaacagacataagaattacattggacttctgtttagaatccatgcaagtaagaagtgttgaaaaaattagaatacagtgggtattttttatccaagtattcattatttaaaactgcaaggtgaaaataattgtaacaagaacatattcactagcaatctgagcactcatgttattagtgtctgttctggagagaattatgtccccccagaattcctaacctgaagccctatctcccagtgtgactgtatttggaaaaggagcttttaagaagttaaaggttaaataggggcaaaagggtaaggccctaatctgttaggactggggtcatcatccaaaaagaaagagacaccagagatacatatctctctcttctctctctctctgcctccctccttctctctctctccctctctccctctccccacatacatttgttaaattgaggttttttgttagaacatatatagtggcattttaatatagtattactctacttaaaacatacacacacacacacacacacacacatatacaattttgataaattcttttttgaggataaggccgggcatggtggctcacacctgtaatcccagcacttggcgggattatcatctgaggtgggtggatcatctgaggtcagaggttcaagaccagcctggccaacatggtgaaacccgtctctattaaaaatacaaaaaattagctgggcgtggtggcgggcacctgtaattccatttactcagaatgctgaagcaggagagtcccttgaacccaggaggcggaggttgtggtaagccgagattgcaccattgtactccagcctgggcagcaagagcaaaactccgtctcaagaaaaatacaataaaatacaaataaaaaaacacaaaactgggatgtgtccctgtcttttaggcagatatactttaccattactaaaattgagcttcagaaacattaagcatgctacacaaacttagctggaaatgaatactgaaatggaagtttgaatccaagatgatttcttttgaatcccatgctaatgctgttaactcctatagacccttctcaggtgcagccagagagacactagcccactgatggacggacagacgtgggcagggtccgtgtcactaaaccacccaccactgccacagctgcctacaacagacacatcagatgacactccgggcatataaatgattttcactgaggacttactggttttaataataggtcctggtgtagagaagtccctcaacctattgtgcaatgagttttgagaagcgggtaagctgtatgttttgtggttttgtttcataaatgcatctacaggaagaccaatattgactgaatgaagctttcatttaaagagctaa

SEQ ID NO: 28469 - DNA, 1050 bp, Homo sapiens
tcacgagaattcactcatgattgtgaggacagtaccaaggggatggtgctgaaccactcatgagaaatttgccttcatgattcagtcatcttataccaggatccacctccaacattaggaagcataactcaacatgagatttggtggggacacatattcgaattgcctcatcagtctttgagtataaagacatccatagcaggctttatccagccagcttctttgggattctttatagggtttcaggtctatagcatatccactaaaatattcctacttcaaaaggcaataaagtaagtagtattatcattcttcaaaaagttataatggtagtgtaggcattcatagtatgatttagttcatttgctactgtttctattctatcaccatattaacactttcctacacaagtctatattcagctgggtttcagttgagcacaaagtcatccttgtactaccaccgatagctggcactagctctttgatactgttatcattctgctgtagaaagtacccgtgaactggaaaaagtccacaatagaatagctagtcattcaacactatcaaattttaggtgactttttgaaaaaatagtatctcttgttgcaagaaatggtccatctgtgatttcaagtctctcgcttgagtgaattggatggaagtggtgaatttcagccaaagtggccaaagaaatcctgttcctgtgataatgacaccatcagcctctgctcctctgtcttcacttctgccacatgttgcctgttctccgtgactttggtaagagcttccttgtgtatgaggatgatgtccaggatgttggtctggtgtccctgagacagcactaacaggtccatggctgggtccaaggtccttcctggactcattggcaaagagcttactgatgttcttgaaggcatctctggtgaagtggatggcctagtcaagttccaaggcctggctgaggctgaagaaaaactggccaccttctgatgctctttctaaaagcctgtcactgtcatctgcttgcttgtcaactcattggctgtga

SEQ ID NO: 28470 - DNA, 1026 bp, Homo sapiens
gaccacagcaggagagttctggaatcctatgtgagggacaaactttcagaccaaagcaggagtgttcttaaatcctatatgaagaacaaacattcagaccccaggagcactgttctgaaatcctatgataagggcaaacattcagaccccaacatgaatgttctggaatcctatgtgagggacaagcattaagaccatagcaggaatattctggaatcctatgtgagggacaaacattcagacccttgtagaagtgttctggaatcctatgtgattaaaaaacattgagaccacagcaggagtgctctggaatcctatgtgagggacaaacattcagaccccagaaggagtgttctggaatcctatgtaaaggacaaacattcagaccctcgtagcagtgttctggaatcctatgtgagggacaaacattcagaaccttgtagcagtgttctggaatcctatgtgagggacaaacattcagaccctcccagcagtcttctgggattctatgtgagggacagacattcaaaccccagcagcagtgttctggaatccgatgtgagggacagacattcagaccccagcagcagtcttctggaatcctatgtgagggacaaactttcagacactcatagcagtgttctggaatcctatgtgaggtacaaacattcagaccctcatagcagtgttctggaatactatgtgagggacaaccattcagaccatggcagttctgaaatgttatgtgaaggacaaacattcagaccctcgtagcagtgttctggaatcctatgtgaaggacagacatttagaccctcgaagcagtgttctgcagtcttaagtgaggaacaaaaattcagacccttgtaacagtgttctggaatccttttttgagggacagacattgagaccccagcagcagtggtctggaatcccatgtgagggacaaacattcacaccccagcaacagtgttctgtaatcgtatgtgagggacaagcattcagaccccagcagcagtgttctgg

SEQ ID NO: 28471 - DNA, 1044 bp, Homo sapiens
ttgaatgctgtctacttcattcattaggcccttagcatattctccagaggtttaaaaaaaattccaaaatcatatctttgtctgcttctgaagcttgctctgttgacacaaattgtatttttttctttttttggattttagtatgccttgcaattttttccctttattctcatgcatgaagcacccactaaaggtgactgctgttagtatagctttagtaatgcggtgatgaggtgacagggcaggtgatgctctcttagtctctttaggctactataacaaaatactttagactgagtaattcataaacaacagagattattgctcacagatctggaggctggaaagtccaagactaaaggggcaggatatttagtgtttggtgaaggtcaagcattcagacactcgcaacgactatagtgacagcagcagtcttcaggaatcctatgtgaggaaaaaacattcagaccacagaaggagtgctcgagaatcctatgtgagggacaaacattcagatcacagcaggagtgttgtggaatcctatgtgaggggaaaactttcaaacccttgtagcagtgttctgcaatcctatgtgaggggcaaaaattcagaacctcgtagcagtgttctggaatcctatttgaggaacaatcagaccacagcaggaatgttctggaatcctatgtgaggggcaaacattcagaccacagcaggagtgttctggaatcctatgtgagggacaaacattcagaccacagcaggagtgctctgtaatcctatgtgagggacaaacatttcaaaaccttgtagcagtgtgctggaatgttatgtcagggacagacatttagaccctcacagcagtgttctagaatcccatctgcgggacaaacattcagacactcgcagcagtgttctggaattctatgtgagggacagacattcaaaccccaacagcagtgttctagaatcctatctgagggacagacgttcagaccccagcagcagtgttctggaatcctatgtgaggtacaaacattcagacac

SEQ ID NO: 28472 - DNA, 1035 bp, Homo sapiens
aaaagttagctgggcatggtggcgcgcacctgtgatcccaggtacttgagaggctgaggttggagaatcgcttgaataaggaaggtgcaggttgcagtgacctgagatagtgccactgcactccagcctgggagacagagcaagactccatctcaaaaaaaaaaaattatatttacaacagcattataaaaattagaaataagcttaaccaagagggcaaaagatttgaacacagaaaactacaaaacactgttaaaagaaattaaacacaaataaatgaaaagaaaagctgggtttgcaaattagatgatttcatcttggaatgatgtcaacactactcgaagtgacctagattcaatacaatccttataaagattccaatgacatttttgataaacagaaaaacctatcctaaaactcatatggaatctccagggcccatgaataggcaaatcaatcttgaaacagaacaaaattaaacgtctcaaagcaattacaaaactgcaataagccaaaaagaaaaaatgtggtcatggcataaagacactcttgacacacttatggaccaacacaacagagacctcagaaaccaaccctggcatatatggtccgatgatcttccagaaggatgccaagaccactcaatggaaaagcacagtttcttcaacaagtgatgatgggaaaattgtataactacatgcaaaacaatgaagttggactcttaccttacaccacgttaaaatcaattcaaagtgaattataaacctaaatgtaaaactagaactatcaaactcctagggaaaacaaatttggaaaatgctttatgacgatgaatttgtcaataatttttaggatatgacattaaaagctcaggcagtaaaagcaaaaatatatcaaacctaaaaacttctgtacctcaaaggtcacaaccaacagggtaaaaggcaaactgtaaaattaaaaaaaataccagttgagtgtcccttatttgaaatgcttgggatgtgtttcagattttgtaatatttgcactatt

SEQ ID NO: 28473 - DNA, 2001 bp, Homo sapiens
gaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatcacatgtaactaataatttgaactatacttgaaggaccgtgttgatgtcaggtatttacagtggttggaagatagcagtattattagcataagctgcatacgtaatattcagtaactgccatattatataacaaatttacattcacaaattcagtatcctgttaagtgtcatattcttgtaatctgcattctccaggagttttatgtgtttaatagatgaatttattttatttctaaaggtattcaaatgtttcagcaccatataatagaaatacccaattatattctagttcctttatgtcctgtacatcattctctgcttggatttccattattctgtttggttagagaataaaattggtaattgcatttgaagaatgtgttaatgtcataataaagccatgattgctatcttatttttgttatccgagacctttgcaaacattggcaaatagcatcaattacctactgtatttgtttctttgtttatattttcagtaagccctggggaatatagcatggaattgagctactaaatggttttggttccgttttacggagatttttcctcatatttagttttgaatgaggaaaatgtgctcaattataaaagctgtgttattgttttctattattatttttaaataatcacacttggactcttttcaaacattaggttagtttgtaatgaaagcaaaaaatttgtgaatactggaagtaacgtggaaatctaatgtggaagccattgtggcaaggtttctacaaatcggcatttggagcagagttgtttgtttttgttgtttgtttcctttaagaaaaaccacagggaccaagaaagaaaatataacagtttgatttctgtcatacccattgtatttgaagatatatggatacagattatatatatatatacatattttccttaatagaggaatgcttcatattattcaaaaattatatcctgatcacctttttttgttttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaattgctgttaaaacacaaatttcaatcaaatacttttgtgtatagaaaatatgtatagtaggtagatagaaaagtataaaatgtt

SEQ ID NO: 28474 - DNA, 1050 bp, Homo sapiens
agctggcagattcaaatcctcaaaacacaatatatgatgccaaaagattcataggcaagatttttaccgcagaagagttggaggctgaaattggcagatacccatttaaggtaagtgattaatctaaaatctatattaattttagtgtactcttttagttaatgctttggcttcatgtcacaaaacattctatctcgtctagttttatctattaatacatgaaagttctgttatctcacataaccagaaattccacagcagctataggatcagttaatcactgactccataatgctaacaggtacttaaggccttgccattttcttgctgtcccatcctcagcatgtcttgcttagctctttcaaggtagcaggaaggttgatgaagccctgtgtaccatagatagatattctgtgtgtgtatgtgtacatatttatatacatataaagagaacataccaggtgtgctattttttgctatttaatatgtcatggataattaataggatcatgtcattatctttaatgattttgtggaatgactattccattattaattagactagtctctatcagtgtacttttttgtggtttttcactaatgttggagattccggtaatatccttacttatctttgtacacttctctgaaagtttcctaacttgaatgctagaagtctaattgataggtcaaatgtgtacgtttttaaggcttttgatttatttttctggtttgctcaccagaaaggttatatgctcttaaccataattttttagagtggctgtatcttcgctagttattttttttaatctttaacagtcagataagtgaaaaatagtatcctgtattaatttttatttattttgattttttttagtgagatcagaatttttagaattttattgatattttaattttcttttatggtccatttttctttgtccttttttgttttggtgtgtttttcttttccttagtgagctataaaagaccttcattatatgtttttgttatcttttccttaccttttttttttcactgatgtttttg

SEQ ID NO: 28475 - DNA, 1030 bp, Homo sapiens
agaatcttttcatgtgctttttagccatttatctatctttgtggagaagtgtttttcaaatccattgttcgtttttaattgggttatttatcttcttattgttgagttttaaatgttttttatatattctggatgcaagttttttatcagatatatgacatgcaatataatatattttctccaattctgtggattgtatttttattttcttgatggtgttgtttgtagcacaaatgttcctaattttattgtagtccaattatctttttttggtcacttgtgcttttggtaacatatttaacaaaccattgtctaatctaatgtaatgaagatttattcccatgttttcttctaagaggccaatagtctcttaaattttggtgtatcatttatttcaagataattttactgtacagtatataggaagagtccaccttcattcttttgcatgtagatatatagttgtccttacactatttgttgaaaagactattcttttcctatttgattgtctcggtactcttgttaaaaatcaattgaccataaatatattgtcataaatatatggatcataaataagtgagtttacttatggactcccaattctactttattgatttttatgtcttatgtccattctctttttcaatccacttcaacagggctctgtctccagtactccattaaaatagctgtcgccgtcagtagtgacctctgtgttgccaggtccaatggtcacttttctttctccttactacttttcaactgtatttgacccaagtgctgatttccttacatataaaacatccacttttcttgtttttttttgactaggcatgcttctggcatttcttcttcctcatagcttcctttcttggctctgctttctttctcatcccttgaaacatcttcctgaggcttgttcctggatgctccattgaatctacattctccccttaagtcagctcatctactctcatgattttgtttttcacaactatatctctagctatgacctcttcacttatct

SEQ ID NO: 28476 - DNA, 1074 bp, Homo sapiens
ataggagtggtgagagagaacgtccttgtcttgttccggatttcaatgcttaaagcttttgcccattcagcatgatattggctgtgggcttgtcataaatagcccttattattttgagacatgttgcatcaatacctagtttattgaatgtttttagcatgaaggggtgttgaattttatcaaaggccttttctacatctattgagataatcaggaggtttttgtcattggttctgtttacatgatggattacacttattgatttgtgtatgttgaaccagccttgcatcccagtgatgaagccaacttgattgtggctgataagctttttaatgtgctgctggattcgacttgccagtattttattgaggattttcacatcaatgtcaatcagggatattggcctgaaattttcttcttgttgttgtgtctctgccaggttttggtatccagatgattctggactcataaaatgggttagaataaaacacctatgaatacaacttacaagggatgtgaagaatattttcaaggagaactacaaaccactgctcaaggaaatgagagaggacacaaacaaatgggaaaacattccatgctcatggataggaagaattaatatcgtgaaaatggccacactacccaaagtaatttatagattcaatgctatttccatcaagctaacattgactttcttcacagaattagaaaaactactttaaatttcatatggaaccatatgaaatttactctttttttagagcttatatagccaagacaatcctaagcaaaaagaacaaagctggaggcatcacgcaacctgacttcaaactatactacaaggctacagtaaccaaaacagcatggtactggtaccaaaacagatatatagaccaacagaactgaacagaggcctcaaaaataaaaccacgcatctacagccatctgatctttgacaaacctgacaaaaacaagcaatggggaaaggattccctatttaataaatggtgttgggaaaactggctagccatatgcagaaaactgaaactgtaccccttccttacaccttatatg

SEQ ID NO: 28477 - DNA, 1040 bp, Homo sapiens
tgtatacagcaaaaaggatgagcaaactagaactacagtctcaatatggttgtactgtataaaaatggaatcaaatgaaagaagccagacacaaagaagcacgtactatacaattacattatgtaatatctagaaacagacaaaagttaccaattgcattagaagtctgggtagtggttatcctttgagggaaaaaatgactgaaagagaggataacagtgtaggtcctggaatgctgataatgttccatttcttaatctgagtgttggttacatgagtgtgtcacacttaattgagcttacatttgttttgtattattttgtgtacataagtgattgtttagtaagatcattatattctaaactataatcaaattttatttaaagataaaataaacacaagtacattttagacagaatgtataatcaattttacctgtttatgaagtctctgtttccaaggtgacagcaaaagaagggacaataatcaagagataggaattggtggcagatgctccttggtctctaaaccactactgtagaatgaagtgatcaatagcttaggaattatatttcatgcttcttctttaccttgaatggcttcaaataaaatctgctttgtctgatattagtatagccactccagctttcttctagttactgtttacatggtatgcccttttattttcaacctatttgtgtctttgaatctaaagagtgtctttgtagacagcagataggtggatctctttttttggtccatctcccaatctctaactttttattgcactatttattccatttacctttaatgtaattactaatatggtaggatttatgtctgatgttttggtagtggttttctatgtcttcttgctcctttatgcctatattactgcattcttttgtgttaagtagatattttctagtgtaccattttaattctcctgtcatttatttcattatttttttgattcactttcttagtgatttcctgaagattacaaagaacacttaatttacaataatctagttaagaat

SEQ ID NO: 28478 - DNA, 1046 bp, Homo sapiens
ttgttccactttaatttttatttgctacaggagcatcatggttcaggttaagagatcaaactagttgctttatcagatacacccttacattctctttctcatgcaatacagatctgtcagccacaaatgttaaacctaaaatatctaccatatgttttctctggaaaaaggagttctatgaggttgagaactgctgtgtaaaacactgtatattactaaactgtcagaatgtctatgagttttctatctcaagaatactggtattagagaataccagtcttccctccatgaaagttattgtacgtaggttttacctaggatataccagggactcaagatttgcactaaacacaacagatgatcctgccttcatggagataacattccagtaagaagatatacattataattgtatggacatggatcatattcttcttagtcctctccctgtttccatctgcttttttgataataagacattttatttccacaaataaaatttccctgaagactccaggaatattatcaggttatctgtaagattcatttggaatttacacatttgtcatcttgtgttgtcgtctaccttttaaaaaatgtgcaagtgtccacgtatgtttattgcagcactattcacaatagcaaagacttggaatcaacccaaatgcccatccatgatagactggataaagaaaatgtggcacatatacacaatagaatactatgcagccataaaaaaggatgagttcatgtcctttgcatggacatggatgaaactggaaaccatcattctcagcaaactaacacaagaacagaaaaccaaacactgcatgtcctcacgcataagtaggagtggaaaaataagaacacatggacacagggaggggaacatcacacactggggcctgttggggggtgggggctagggaagggacagcattaggagaaatacctaatgtagatgaagggttgatgggtgcaacaaaccaccatggcacatatatacctatgtaacaaacctgcacgttatgcacacgtgctccaga

SEQ ID NO: 28479 - DNA, 1062 bp, Homo sapiens
actttttattttgagcagctgccttaacagccttcgtcttgttacatcacatgagatatatctctggaataggaagagaaaaaagacatgactgagcaataatttttgactaaaacttaaaattacaaaaccaaaaccagagatagatgtccctgaagttgtatttttatagtatgtgagaacacaattttcttatcctagttttaaggcattcctctggacccaggatttttgtttagtttcattcacataatcaaactcttttttttttttttgccatagactaatgcattttggtgtaatgatctgagcccttatccagaaggcatctaagactcatgtacaaaaatagatttcagggctaaacattctaaaagacaattgagtgcttcttttttctccggcccctagatgtaaatgaataacctctgttcactaactcttaatgtaatataagggataaattatgcttgtttatttaattgtgcttaaccagagtactaggttggagtcaaaccacagatatatttgtgagatgtgacaaaatgtagcttttagcccgtaatacccaagtcatctgggaacataactgatgacagtgtcaacacctttcaggaattctggaggtgcctttgagtttagaaattcgtaggttctctagaagcaacagtagcatactaaattaacacataacatttcaagctacatttacataattgcagtggttatgattaatacaaattatattaactgcctgttttactccttatagctgattggctgaatttaccagtgggtttggtatgttcaacaaatgatccaaattaccttttcatttcagttaagaaactaatcaaagcaaatacactttgatttgttgagaggcagagattctccctaagtggcaatgtccttggccttctaagctaaaacctaaatggaactataatatatattttgatgctttatctcacttgagttttttattctttaactgaagggcagccatggaccataaatacatagaagataaaaatatattgagcttaggagtttggtctg

SEQ ID NO: 28480 - DNA, 1027 bp, Homo sapiens
gtcatctcaaaagtcttgcatgctagaatccagagaaatatagagataagcatcaccaacatttattgatgaaacaactacttaataacctccagaggtgctcacgcatacacagcacatgaaaatagtccagatagaaagtttaaagggatttcacagtagaaaccatggagatagtgtgtgcagtaacccgtagtcattgctgccctcatagtatctgatctgaacctggcatagcttcagaaaaagccaggtgttcaggctaaaatgagaatgagaaaaaaggagaaagttgctttcttcttatgtgaaaaatagggaatgaacattttatagtttggtagtagaaccagttgtacgagttctgcactcgcccatagggcttagcctgaagggagaaaaatatttgtattcaaaaatcactttaagacttatgggaagatatctaaagttggtgtatagaataaagaactgagattacagttgtatatctgatttgttgggaccacgtttgaaacttgaactactatattttaaaagttttttttttgagtgacaatttccagttctgtttttggcatgaggaagtgatacaagaaagcttcctactcttgcacttctttgtgtgttcccttattattaagttttgctattaagtattcatttacagtgttctgccagataatttattttagatgtcgagacaagatcatttgtttattggatccaggtattctgctattcttggtttgaagaggaagtagctttaagtaagaaattcccacacattattaatatgtatgcccctctaggtgagtatgtatgtgtaggagagagacagacccacagctagaggcagagaatgggacacagaaaaaggagacaaagaaaccatggtgtctcaggtaataaaattacttgcaaagttattgaataatgatattgcatttgcacattgtacattcccttttctttcaagtttcagtatctctcaacagtctaggtgctgtatggctgctattgcaga

SEQ ID NO: 28481 - DNA, 1015 bp, Homo sapiens
gcaactatatgccaataaattggaaagtctagaagaaatggataaattcctagacacataaagcctaccaagattgaatcatgaggaaatccaaaatctgaacagatcagcaacaagtaataagatcaaagctgtaataaaaagtctcccagcaaagaaatgcccaagacccaatggcttcactgctgaattttagcaatcatttaaaggaaaactaataccaatctgattcaagctatttcaaaaagtagaggaggagggaatacttccaaactaaatctacaaggacagtgttatgctaaaatcaatacaagacaaagatacatcaacaacaaaaaaaatgtataggccaatatccctgatgaacattgacgcaaaaatcctcaacaaaatactagcaaattgaattcaacaacatattaataaaaatcatttatcatgaccaggtgggatttatcccagggatacaaggatgttgatacacaaatcaacctatgtgatacatcatatcagcagaataaagaacaaaaaccatctgatcattttaattgttactgaaaagtcatctgatcaaattcaatatctcttcatgatataaattctcaaaaagctggatataggaggaacatacctcaacacaataaaagccatatacaactgacccaagctagtcttctcccgaatgaggaacaaccaaaaggctttcctctaagatctggaacaaaacaaggatgcccactttcaccactgttattcagcattgtattggaagcactagctagagaaatttgacaaatgaaataaagggcatctggattgaaaaggaagaagtaaagttatccttatttgcagataacatgatcttattttgggaaaaacctaaagactccataaaaactattagaattgataagcaaatttagtaaagttgcaggatacaaaaccgacataaaaaatcagtagtatttctatttgacagcagtgaataatctgaaaaagaaatcaagaaagtaat

SEQ ID NO: 28482 - DNA, 1003 bp, Homo sapiens
aatgaaactcaggaaatgcagtgatgtaatagaatgatctagattccagtcctgtcttggccattaaagctaccacgtgaccttagaggaatcagttaacatctttgggactcagttttctcatgattaaaatgaaaacattggattagatcaatggtcttcaactgtgcccctaaaagctgtaaagtgttttaggacatattaggtgaaatatgatttgtcttctctgtatcttttctgcagcttagcttccttaagggctggtataaaactttgccataatttttctttactatgtaactgatggacttacattttatcaccatttatggtggaattgaggttctgcctttcacctaccccaataccactcccactgtcaaccttatgtctttcttatttggcttctcctatccaaggaaaaactcaagaaccacttctttataccttttttttttaaacctacccagctcatttaaattatttattttccctgtgcttcaatgaaatgagcactgcataaccacgtttatcctgttctacctctctctgtattatttctggctcaaagagtagattgcaagtttcatgagagcatgactatagcagcctcttaattttgcctcttcactatcttttccccttaggtacaacttaatggagcccctggccattatcaccaagttattaataaactcaagttaataatttcagtttcaaaatatctgccaaggatggccaccctgcaggctgcaaccctttataggaaataaagctctcctttccaaactaaaaaataaaatgaaatagaaaattaaaaatttgctggccgggcatggtggctcacacctgtaatcccagcactttgggaggccgaggcgggtggatcacgaggtcaggagatcgagaccacggtgaaaccccgtctctactaaaaatacaaaaaaaaattagctgggcgcagtggcgggcgcctgtagtcccagctactcgggaggctgag

SEQ ID NO: 28483 - DNA, 1033 bp, Homo sapiens
ctcctcaggctcggtgtagtggctcatgcctgtaatccctgcactttgggaggccgatgtgggaggatcacttgagctcaggagttgaaaaaaaaaaaaaaacccgcaacaactcctcattcatttatgttttattatgaggttacagaaatttacccacatctttaggctcacttctagttcttttgctttttctaccacatctgcagttgcttcttccactgaagtcttgaattcctcaaagtcatccatgaagttgcaaatgttgatatttgacctcccctcatgaatcatgaatgttcttaatgacatctagaatggtgaatccttttcagaagcttttcagttgactctgcccagatccaatcagaggaatcacttttgatgacagctaaagccttagaaaatgtgtttttccaataagatatgaagtcaaaattactctttgatccatgagctgcagaatggatgttgtgttagcaggcataaaaacaacattaatctccttgtacaactgcagcagagctcttagtgtacaggtacatggcctgtaatattttgaaaggaatttttgtttttgtccagtaggtcccaacagcgggcttaaaatattcagcaaatcatggtgtaaacagatgtgctttcctccaggctttgttgttccatttatgtagcaaaggcagagtagatttatcgtcatttttaagggtttaggatttttggaatggtatatgagcattggcttcaacctcaagttccagcttcatcagcctttaccaagagagtcagtctttcctttgaagctttgaagccagatattgacctctctctagctatgaaatttctagatggaatcttcttccaatttaaggctgttttgtctctattgaaaatctgttgtttagtgtaaccaccttcatcatttatctcactcagctggatcttctggcttttcttgctgagcttttctgtcagcatttgctgcttccctttgcagttttattgttttctcccttaaatcgtatgagccacc

SEQ ID NO: 28484 - DNA, 1083 bp, Homo sapiens
gttaactgggttttcatctttatctaggggaggtaatttgaaaaggaaaaatgatgaaaagcttgatggaactggtattttgaagcatatactcattcttgatataacctaaatccataccagatcttactaaccttgacatgggaaacagcaactaaaagaaaccaaattagtatgatcagttcttcataaacaagtggtaaaataaagatcatcttacaaaaactttaaaatactctaaaaatatgtatatttttaaaatactttgccaggcatggtggctcacactggtaattccagcactttggggggccgaggcgggtggatcacttgaggtcaggagtttaaaaccagatgatagatgatagatagctggcttaaatcttgtgggttttctaccataatattagtcacgcatgttttctaaacccacagaactctctgtaggataaaatacttttttattctttaattttgtgcctttttattaatttatattccagggaaaaagatatattggatctgaaaccatcattttaaataacattgtcatatcattttaattctcctatttccatagaattatgacagcccactccttattttgcagaccaaggctccaaaaggtttacttgctgtttacagcatgttctactaggaatgctgcctctgctaggtgctaagatgtaaagatgaaaaagacataattcttgcccataaggagtttatactctcatggggaaccaggccttaacgaaccaaaacacaagcatacctcagagatattgcaggttcaattccagacactgcagtgaaatgaatacctcagtaaagcaagcacattttttggtttttcagtccatataaaagttacgtttacactatactgtagtctgttaagtgtgccatagcattatgtctaaaaataatgtgcataccttaacttaaaaataccttatagctaaaaaaatactaatgatcctctgaaccttcagagaactataatctttcttctggtagaggccttgcctccatgttgatggctgccgaagaatcagggggaggttgctgaaggttggggtc

SEQ ID NO: 28485 - DNA, 1065 bp, Homo sapiens
taaaaatggactttaagaaagttgtttctgaacatgcatgacattttaaggcacaatgaaaccatgtccatgaacactcggtagccatattggatctgctccccttggtggggcttgtttccccatgttcctccttcactgcctgcgaatgttaactaccaaataaattagttggacaaagtccaagtgcattggctttctgtgcttgagacttaatgtatatcacctctgcaggattggagcagaacaatctaagagagtaattttgtggttgatattttctttatgtgtattatgtatagaagcacacatggcagttatttttttatccacaaaatgacattgtgtagagaaagttaccttcaacattatgatattagcaaagcagttttctcagaatttatacccagttgctttttgactgaagtagaatcaggacaagtacaatattttaagtgtgatgatttaaactgatattttggattttgtgggcgacacttaagaaatttgtttgaggggataacatgttggactgtgtgaaaacaagttagaatgaactagacttattattctgaaggatttttctcctattgagaaacaattttgggggtccatgaaatgaaaaggtgtgtatattaagatacatatttttaggtatgggtattttaaagatctcaggtttgcaaaaagaaaatattggaggggaaatctatatgtgaggaaatggttagtgtgattcattgcatcctgcccttgcctggagtctggtgtgccctaaatgtcatgtatgacccaagctcacctgctagtaatttctaatttactgtcctaattcatcgatttgttatcactaattgttcttcatttacttctgtgtagtttccagtacctaaagggttgaaaggttgctgtaattggcacccgcagctgctctttcttttgacaggggataattttgcagcctatgctttgtgtgacagctgcctaattgggcattctccccttgtagcaagcctgcctcctccagcctccctgctgacaaatggtggtggattatagatgagg

SEQ ID NO: 28486 - DNA, 1026 bp, Homo sapiens
tcttctacggtgattcgcccaactctagaggtttggtcgtttaaaaaagtttcacaaaatgaagttgatgtgttattttgcaggattgagtaggcttcccctcaagtctttccttctctcctttgtgtgaccttcccctccacttgcctcaacctgatccctgatgctggcggtccttttctgagagtacagtctgctctctggcagatatttacttggccctggtgactcctgttctgttttactccctactctcttaccttggctgatactctgttaaattctttctgaggtctcagcgggacagtcagtctctagagtatctgacgacgctcttcaaattacattggtgctgggtcttccctgagggttctgggaatgcgttgtgtacctttcagctggatcggaataccaagatggctgctagttccgacacttgatttactgacagcttcatactgtttttactcgtagtgtttttattgtgtgatgatgtcatgcaagctggaatttgaggacttgatatcattatgagtgatcatctaaaaacatgaagctgatagaatgttgggtagtttttattttttaattctgtgtcctaaacgtagtcgggactcaagaaatgtttgctgagttaattttttttctcattagcgttggatagaactcttagctccaagaaccacattataatttaagtcggacatctctgtcttatagccaagggaaatacgctctcacactgttctgaaaaggtacatgtcactgtcttagcaaaacccttacctaatacttaatgaaggttgatagttcaaagtacaaaattcagacttcaaacaggatctgattctgcctctttaaagcacccctgtaagaattactacttttttgaaactttgtagaaatcatttttttagcacagtgtttatcaaacctaggcttgagatatagtaattatttttatcgtttttatctttgattcaataaagttgctatgaaataacaccctatcttatagcactgttt

SEQ ID NO: 28487 - DNA, 1030 bp, Homo sapiens
tgtgctggcaggcctgtttactgacatccttgttcgagtcttttacaaccaccagatcttcctaaaactccagcttgcttgtgttacttgtctgatcaaaaataatgtagcaattgcaatagcataatgaacatagaaaagtaatagaccttccttaatcctaacttactgttactatgggaaacattaatacaattaacatttttttaatttggtatctttaaataattgacttttccttaagtcttttacttagtatcttaattgatataacttacgttgtttggggaggaagatccctactagactaagcctccatatcaactcagattttataaagtcgctatatgcgaagcctccatatcaactcaggtttttttttttttccttttccatgaaaggtttcaaatgaaggaatcaaaataattttaaaagtgttgatcaaactgtcaatacactttctcttcttacacagaccctggtcttttttcactgaaattaactgttgtgaacctgatagtctccttgattctctgctacatttgcccttcaaccatgtggcctgtggtttgcatatctgaaaattttctgattctaacgtcagagcttatgcattttatttagataactagaatttcttcattctggattagaggtatatgagtaattttcaaacctcgcttgcttcctttttgcatttatttatttaaaaaaatgttcatagtacagtctatgtaagcttctagcttgaagctttgtctcctgctgttgccgcccctctctgcacctcctccccacctgccatcttctagcctgtcctccaagctagtgcttctcaaaatatctgcagtaaaggccaataatttgtttgtctgtttctattttattttttttagtaactcacttttattgtctttttaaaaagctatatgacagaagtttttagcaagactacaaaatctaagtccacatctttcatcattaaatttaattataacttttatagaacatgccatcaaattattttgtc

SEQ ID NO: 28488 - DNA, 1011 bp, Homo sapiens
ctaataattatttggttgcaagtcacttttcgtatattcatttatattttacttataattggaatttaaaatcaatgacgcaattatttgtaaatactaaaatttttttattcagatataattaggtgttaatcactggttggcagtctgaaatctgcttttatatttgatgaaacagttgatattgaaccccatttctgaacttctaattctattaaaattaacattataatcatgcatattcctgtgaccgccccgccacaagatataattggtttgttgttgttcttaattttcaacacctttgttttaccacatagccagaatgataagcaatgctcactggatccaactaggagttggataagtaaattataggtagccatctggtaaatatacacagccaatgagttgttcttagaaaattgtcaaatttagatttttcttccagattaaaaaaaaagacagccaggcatggtgtctcacacctgtaatcccagcactttgggaggccaaggtgggcagatcatgaggtcaggagttcaagaccagcctgaccagtatggtgaaaccctgtctctactaaaaatacaaatattagccaggtgtggtagcgcgtgcctgtagtcccagttatttgggaggctgaggcaggagaatcacttaagtcggcagtcggggttgcagtgagccaagattgtgccactgcactccagcctgggtgacagagaaagactccgtctcaaaaaaaaaaaaaaaaaaaaaaaaagacattataatgtatagtgaacaactttgaaaactaaaaatttataaaaacaaattactgatagtgattttctatattcctttcacatatttttaaacgtttttagattttaaagatgattatgtcaaatgtgttttttctaaaacgtgttgtgttaaatatgttttccttttaaatgaacagtccatggtcaaataagcttgggagatgttgggtcaaagtatagaatgtcttttcaatat

SEQ ID NO: 28489 - DNA, 1047 bp, Homo sapiens
ttctaataggagtactcatgtaattacacatatggttattgttaagttgatgtgtgaatcacatccttctaggtatatataatcagggcaagtgattgtttcctactcttcttagaattcctatctgaatttatagtcaagatttaattgagtccaagatctataatttggggcatatgacttaaccagccctgctcagtatctgttgctcctctatgaaatggaatctctgctcatttcaccgagttgtgaaaatcaaatacagtcatgtccatgatagcattttgtaactggtaaagcattactcacttaatgatgctcccatttatgtgtcagacctgtctctttcccacagctatttagtagggtgctgctggtggccgtgtgatagctcagaactacatctgtattgtgcactgcctcttaggagttttatacttgtattagggagtggaaaattttagattttttcctatttgcatcattttatttgtggtgtttgttagaaaaataatatgtatgtatttactgtagagaaattagaaaatgcaaatcagcaaaaagaaaaaataacaattacctctaaatgcagaaataattactgcatttacttttgtttaaaacaaaaattcaattatgctgaaataatgttgtttcctgtttttatcacttatatagtatataatttcatataatttaattttcttgtataatattttaatgactacataatattccatgatgtaatatactgtagtttatttaactatttctaattttttcattttgacgttttatggctgtatacaatgtactgcacaaatataataatatgtattttgaacatccttatggctaaatatttacacctatcctccatgatttttttaattaggataaatcttagacatggaattgctgcatcaacggacatataacatgttaaggcatttaatttttgttacagttttatcgaggtataattgatgaataaactgcacatatttaaggaacaatctgacaagttttgacatgtgtgtacacctg

SEQ ID NO: 28490 - DNA, 1089 bp, Homo sapiens
agtcctggcacatagtatgcagtatttttttttttttttttttgagacagagtctcgctctgtcgcccaagctggggtgcagtggagcaatctgggctcactgcaagctctgcctcccaggttcacgccattctcctgcctcagcctccagagtagctgggactacaggtgcccaccaccatgcccagctaattttttgtatttttagtagaaacagggtttcaccatgttagccaggatggtctcgatctcctgacctcgtgatccacccacctcggcctcccgaagtgctgagattacaggcgtgagccaccgcgcccggtgatcattttaatttttcagctttctcagtggcccattatttaaaagaaccatatttgaaatcaaacagactactttatatttttgtaaaatcatttttacatcacacacatcttttggtccttctgtggcttcagacttttaattccagtcttaactcacccttctgctgcatctcctgcttcatttcctgaatgtagtgtgaccaggggagagcagaaggaagcagggattggatctgaaatcagtagacctctgtagtcaaccttacaatgagcaagacatcctctctggactaaagtccttagttaaattgattcagttgctgctttttgaagttttaccaacagaataactttaagcctttgtttactattagagaatatggtgagaaggttttgaaggaaatacctactttttttcagtgacttcgaacggtttttttttttagagccatcatttatccaaatattttttcaaaaatgacagctactaaaactactgataactaaacaattactgtatattacagatactgtgttaaggatagagttaggtttatcctataggaaagttttaaaaaatatcttctattttgtctacagtaagttacttgatagtacaaggagtttattagaattttcaaagtttttaagacttttataatgaggcagtgtgtggtttgttaggtggttgtagtgagaatttgaagagttcttgttttggatagtcatagttctggctttgttattaatggcttggctttga

SEQ ID NO: 28491 - DNA, 1140 bp, Homo sapiens
tcaatttatgaattttggggagacacaacattcaggccatagcatacctcatagatcacatatggatatgccagccaatttgactaatgtcagtggtgaacatagtcttcttgatctatatccaaggcatccttcttaatattcgaccttatacctcctctgtatcttgtgttttccttctcaaaaacttttgccagctgtcttgcttgggatagaaacagatgaaggaaggatgcataaatacatgcaataaaataatgtatttgttaagattatagtgaattggccaccttcttttactataatacagatgtaactttattagctgaatattcatgatttttattcatatgaaataatacaaaaattggtttttaccgattttcttaatcactgtcaagcagtgtgaatttctagggttggttgaatacagtcttttaataagtctccccagcatgctgcattgaacttttaaaatggaaactctgtgtttaagattattatttattggcaaaccagcatattcttcctctttttgtcggttacgggggaaaggcaaaagcaaataagaaatgtaaataagcaaattaggtctgtgaaagaacttgtaaatgaacccaaaaaattaaatttaaaatatactttatcagtaaaataaattatatgatcagaaactggattttatggaattcagagttatcttttcaaattaaagatgagaatgaactattataaatatttcgtataaacattcacacttagctataaagatggaagttataattttaatgctaatatgaattatcaattcatgaaaggttatcatatctcaaaattaaaggtatgtttcaatagagttgatagttattcttattaaaaagaaactgcaaagaaattgaaagtttagctgaaggattaaatcgacaaattcccatgtatattcaagataggaattagttttaagtaattattttgaaaagaaatcataatgcataaggtccttttaagaagaagtttcttatttttatacaaaacctcctgaagtgtaacttcatgtaatcaaatagacacccttatttgctagcttgattgttgtttatgtaagtatagtctgagtaactagcaccctactccagaagg

SEQ ID NO: 28492 - DNA, 1049 bp, Homo sapiens
tgctcttcactgaaggtgaatttcctgactcttttctaagagtcatattcaactacattaataactgctggtaagagacagaaaataaaattattttgaaatggagctcagagatttctagacgagaaatttattttaaaatgctaatagaaaataaattatatggatatatatttataacactgatttttaacagatgctcttaaaataactttaacctagtttcttgctttgtgaagacaaagttgtttgttgtttcttttttgtttaacaaaggtaacttcatgagtatttgacagtatatttcttttggctcatatttctgtgtattcacctgcttgtaaatcatagcaaaaaggaacaagctaatggactaatatatgaagtaaaagggcagaaaaatgagcacatttactatttatgcactgtgttctactgtgtgctttcctccagtgcttacttatcctgaattcctgaacaattttttccctcattgttcattagtgtcagtcggtatgttatagaaatgtgtgaatttctataaattagttgtgagtgtgaatttcccactgttggattcctcagcagacacccaaacttaatttttatttcatgaactaaaagttgtagctaaggcatgacatctgatcaaaattaacactattatcctttgcaatgaaaagggtgaataaaactaaagttcctggtagttgcccctgatacaagtgtttgcttagctttgaccatacatctatctatttattttacattttacacatccatgggtattcctcccgataatgccaaggaatgctttcctttgcaggcatcattctaacaacacaaacacattcactgtgaattttaaactctcgttctcttttttcctcctttaataaattatctcattgagattattcattgttttggcagtactctaaacgatcttgcttttgcaaaatcattgtatattctgtttaatggcatgttactttaaaactgtaaagtttagggttgctaaaggcaaaagctgacaatatttgttaata

SEQ ID NO: 28493 - DNA, 1078 bp, Homo sapiens
tgttgaagagacagtgaaataatagactttttaaacaaatggtgtttcatctgcctggcccctaagtgtcggttgccgcctggagtatgttgaagtgtttttcaccttccaagtaagtgagttgctctggttttgcccggcagttcggtaacgtcgatagggtttatttggttcagggagcactggcttcatcacctacagtaactttttttctgcctgggcatagttcctagagacaaagaaggagaatcaattagtggagcggctactgccctgcaggttgtaggattggttgttctagtctgtttcatactctggtggagaaagacctctttccaaacttacctttaaaagtgccctaggagtgtgagtaaaatatacatcagaacataacagaaaaaaaaaaggactgttcgttgttgattttattcaaatgagttagttgaaaaaccaggtttaatgcctgtgggaagttagttgaaaaccaggtttaatgcctcttttacatgcatttctaaactctgcagaacttggattttgctaattttaacaccctaaaatattgttaactttgcactaaagaagtgtgtgaagagactaaaggcttttctgactcttgcagttataagtgcaaaacatcatgataaaaaataacctataccaccacctagagtctgtttgttagtttattgctcatgaagtttgcttaaattgacatgtctgttacagttctgatatagtcgaaaatgattaagaagtactagctttcaaaagcccgtccaagagaacaattatttaagtaataaatagcaagtgccactttaaattatccgtgccacctttagaattgaaaattatgacatatcaagttgagtgggctattctccaaaagatgttaattcagaagattttaaaacggagttttcagtttgtgcgccaaggcagttctgattgcttaaagacttctgcgttgttatcagagattcaagaaatcttcccaatcagatgccattagaactttttgaagtccagatgaaacaaaagcaaaaatacaggagagcattacaactacagaaat

SEQ ID NO: 28494 - DNA, 1050 bp, Homo sapiens
tctcttccctacagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatgacaacgcgtgtttctgttgtgtgcataaaaggggaaaagaacgggtatttcccttcaatgtatttaactaaatagcaaaaacattaaacagaacgtaagaattttaaaatttcctttgaaaaatcaactattaaccatacttttcctaaaagaccacatatcagaatatgcatatgaaaagttaaaaatttgttagtggtagttattgaaaatataataaaacatcttttaactatcagtgtcactatacatagggttttttaacaaagaatttggctcgtactaattttgacatgacatctgacttacatgtctaatgccattgcataaagtagatgtgttcttacagctgctcta

SEQ ID NO: 28495 - DNA, 1024 bp, Homo sapiens
gttacataattatataaacattttggacctatgtatttaaaatgcttaaaataagtctcagtacctgaacataaaaactttagttatacggacattctacttcagtagacatttcattacttgatgatgcctggtaggaaaaaactgctactttgctttcatcttattaatcttagaaaaccttttcattcagtaggcttctaatttatatgtaaatttgccaaaaattggctctgatgtgatttttttcacagctaatagaaatcacctgcgagtgtcaggtgttcattcaataacagaaccccaaaaagaaagacgtattaatcgtttagtagaggtggttgatataagttaacagaagaaaaagacattgagaaatattttttcaccaaaactggaaacatagatattttgaaaattaaagctgatctagcaagtatacaattgatcaaatatctgagaatctttaaaaataataactcattggtatactagagactaagattgtaaaaaaaaattgagatgcactgagaacattcttcatagtcttcacttactctgatagaataaaatgctgcaagagtacaaagagtgccatatagttagaaaggttatcacttcgtgatacagaatagaaaataaatcttgcctatgatgagaagttctgagaacagatgccagcttatctactcaacatattttacaactttttttttttttggtgatttctgccatcctttttttcccccaatagagtgttaaatactattgattgtttctaaataactaaattagccttgatgttttatcagtgatcattgaaaaatggaaagtttaaaagttgtccaggtgtctactaattctcctaagatatcgactgcacattgtaatgttatagtagtatagtcagcagcttctcttaccatgaagagagagccttcataccaaaatagtacaaagggaaaaatgcagaaccaaactaggtgtcaaagaaatctgagttaataatgctgatccttcaatc

SEQ ID NO: 28496 - DNA, 1022 bp, Homo sapiens
tattttcaaagctttagtgaggtataattgccaaataaagctgtatatgtttaaggtatataatgtgatgatttgatgtatgtatacattgtgaaattattaccgcaatctaggtaggtaacacattcatcacttcacatggatgactttctatcgtgtgtgtgtgtgtgtttgtgtgtgtgtgtgtgtgcatggtgagaacacttaagatctactctcttaccaaatttccagtatacatataatgcaggaatttttcagttcttctccagccggagacctctgcggctggaaatgcccctgcccaaggcctctgttggctccgggattgcctctggagatatcctgcccactcagcccagtccgctgagcatggcttgcgccccggcctggatctcacacccaccaaaggcgagccaggtgcggagtggcgagggatgtgtcagcactggctgctgctgcagggcggggagctccaggtggccacacaggtgccggcgctgcgtgaggctgcggctggaccaggcatactacaagttgcttctgccttgggtgttcgtgtctagatgagaggaacatggtggcgccccccaaatttggagatgccagtggccctggagccccaaggggtgtgttacagagtgttacagctctcgctcagggatccccgaggtctaggaccccagaagggtcataactcttctctccttcccaccacccccctctagcccatggcttttgggctggcccagccctgccattgcctgtcttctggggcagctgcctggtgcttccagagggtggaggactacagtgtttcagcattttttgtactcgtgttccgcaggtcctgggttcttgtcctgcgtctaagaagaatgaggttacactgacagctgaagggtgagcaaggcgaagagttttattgagtgacagttctcagcagagaggggacttaaagagggcagccccctatgggaagtcaggtaatctcccagtgtgtctgatttggggtttatggg

SEQ ID NO: 28497 - DNA, 1048 bp, Homo sapiens
ttcctctgaaagtttaagttgaatatttctctttcatgagtgcattacaataagaaaacactagaaaagaaaaatgttaacaaaacgtatcttattcaagaagactttttgaattagtatcaaaggaaataattgtacctaaacttttgtattctaacttttgtactctaacttttgtactctaagtctaaataattgtacctaactctaactctaaataattctacctaaactcttatactctaacgtttgtcaattttggaaaacataatgaaaaatatcaaagattttggataagttattttaaaactggatattacttgattgaaagtctactcaaagaaaaaatccactttaaacttcagttctgtcaggaggcaggtggtcttaacttgtgtcacctttttacaccctcttcctggctatagataatttcttttatttaatgcctaaaaaaacaagcagcttaaatgaaatttaaatcagacagtatcaacaagaacctctctgacctctctggagagaattctgttatgaccaaaatcaatattctttgtcaacctggagaaggaaatgaaaaacatttgggtgcaattgaggggaaactgtacgaatttcaaaaagaaacaaattgaaaactctacttaagcatatgtattttcaggcaaagactcctgaaccatatggggttcagctttggtgtaaagatttgaacttttcagatttaatctaaatagctttgcaggataaacctccagtggtttcaacagtgttaagaggctccttgtgatcatctcaagtttgatttatttgcacttttcaaacgaaaattcatttatttactgagatgcaaagcaaatttggcttccatttttgataatgacacagtgaccacgataacagtttgattttaatattcttgcttaactctgtgagatagaggctatcattatctccattttcagaagagaaagtgaagaatcatgggagattaagtgatacacccaagctgtgtaactaagaagggccagagatgggacttaactta

SEQ ID NO: 28498 - DNA, 1025 bp, Homo sapiens
aggatactcgagatgtcctgagaggtcctcagccgtctgtgatggccccacagctgtggcttccacttgttcatttgcttcctgtgtaatgtaataaagtgcaatttctttgggcctctttaagtataaatatccagttttaccttaataaatcctctgcatatggacaaactttaaaagattctcccacacattagaacaaaggtcaactaaatgtgggtagagatgatcaaggacatttttagggttgttaattccagtccaggtagaagctcttggtaagccaattatgtcattagacaaaacccagaccacacaatgatctaatcagatcttataataagtcaataaaattaggaatcatcatgattattgaaatatggatttacattcattgccattagcagtgaatgaaccatcccctaagtgcatatttgcatattttacatattatagctttgtgaagtatcctcaattttgacagacattaaaatcaatgtaaaaataaactgaacttagaactgcatctatgaataactggatctcaaagtattagagcaaccaaaaccaatcacatagttctcactaaggtagtattgaatcaatatgaattattttctcatatgataaaattattaagtattttcaataatttttagttgaagacagaagatttctatgccgttaataattaaaattaatttaaaatatagttttttcgttatcaaaaattccaaggtttgtttcaccatgtatatattaattcaacaataaaagcatgtaaatacgaattatatatgtatttctatatactccccatacacaaatacaaacatatatgctaagaaactttgcagatagaggtggaatatatacatatatatgtatatatatacacatacgtatatatatacacacacacatatatatacacgtatatatgtatatatacacacgtatatatatatacacacgtatatatatatatacacacacgtatatatatatacacacacacacacaca

SEQ ID NO: 28499 - DNA, 1048 bp, Homo sapiens
aaatctgtaattttataaaatttgttgcaattatgagtagagagccattttgagtaattattttagtgttgtagaaatattcccattaggaacttatatagacaaaatgttaatattctttcagaccataatgtatttgcaaagcgtggaagcactttccgttatccttatacacaggagacctaggtaatagcattatgtagataattttacctcaacagaaataatataaccatagacattgatgataagaaaagctcaagaggtactttaggccattagcctgaaaaatttctgcatatcttaaacttttgtgtctgatctaatttgtctgactttaatggttccacttttaacaatttccaaagaaaagtttttgaatttttaattgagatatttcttattttacctaaggtaataatcagaaactatatgatagaaattagaagcaacagaatctgttaggtggctggcttcaagctatttgctttctcttctaaacattaggtttagtctcatattatcaaggatgtaacaccaaccagctgaccaggtggtcctttatgcgtgcagcatacttccctcgtcaatgttaaagagatggagacacctgtttatgtgcccaacactctaagagccacgtctgatttcaattaaaagtagatctggtttctataccaatgtttaaccgatgtttccatggaaagtccctaatgcttgtttcctttttaaaaaatatcttttaattttgaaataattatagattcacagggagttgagatagtatggacgggtctcacgcccccttcctgcagtttcctcaatgactacaccttatgtaacaatagcacatgtcaaaaccgggaatttgacactggtacaatgttgccattttatcacctatgagtgagatgtccttttatcagcattgtggatttgtgtaaaaaccatcataagcaagatagaggactatcccatcatcacaacctcctttatgctacctctttatagtgttcatcctcctactccccacaatctctaacccctg

SEQ ID NO: 28500 - DNA, 1016 bp, Homo sapiens
gacattgagatttatacagttcatttactcaaagaagacttcaaattttgcattccactcctttggggactagttgagacattaaaatccaaatattacaaaataaaatgaactgaagcatgaaattaatatttagcatacagatttacataattttactatttaataatagtatttgatttttaaagcctactgctgaccaaaaacaatgcaaattatttattgtgggccacctacttacttctcaaaaaatcctgagaggtacttaaatgtttacccatatttttacagtaggacctgcagcttaacaaaattaagtaaatgttcaagtttatacaaacagtacgtagctaagtcaggaatttcaactgaatacattgagctcccatattataacactccagtttacaaaacatagtctgtgcaactatcaatttcaaaatgcatgtattaattcatcgaatgtttactcagccccttcgtctaaaggcaccatcctaggcagcatgtccatttgatagtgtttccttctaaaactgagagttttgaaagttaattgctttagaactaaaatgcaatttgaattatcactgaatcctcagatgacttttagttgctgttattttaattcaaagtgaattaatccaaatgaaaaatgtcccagacattctacataatttttgctcttaatattctatttttttggatcagaaaggataatttaaccttagtaggttgtatgtgtaacaaaatttattcatttcttctatgttttcagttttgtttacatatagccactcatgataccttcttatgatcgtttgtatttctttagtgttggtcaaaatgtcttctttttcacctctgattttatttatttgagtcttttcaattttatcttagttattctatataaatgttagtcaattttgttcatcttttcaaaaaataactattttgttgatcttataaattatttaaaaatctttatttcatttatttctgttctgagcttt

SEQ ID NO: 28501 - DNA, 1048 bp, Homo sapiens
atgaataagggaggagggaggaggagatgtagtcagagaagtaatggggccagctcatgtaggtcctggtataccatggtaaggactcttagtttttattctgagtgagatggaaagccattgaaaggttgtgaatagaggagtgagattatgttttcatggaatctctatgtctgttctttggagaatatgctgaagctggacaaacttattataaaacagtaggtcaggtaggaggtagttgcaataatacaggcaaaaattattgtgttgtgtaccaagttgatgttttgtgataaacagccaaattctggatctattttgaagatagagaaagtagggcgcattgacaaattttgtgtagataaggaaagacatacagaatggtgcccaaatttacatgtcctagttagatatgagctgtatgaggacaggagtcataaatgattgtttagtattttatccttttctagtatctagttcacagacagcaataagaagtactgaatgaatgaataaaacattcatgtaggacactgtatcagaatttgtatataaagcagagatccctcttttctaggctaccaaattcttgatctttctgaaagtcgcttttttcaggcacagggatggaagatgtatggattcttccttttcggattcaggtgcttcttccaaatatcctcctgtcagtctcactctggtggctgtcaccctgcagggctgtggttggttattctttacctttctagataatgcagagaaaggtgttgtgtagaccagcttcttctgtttcctccaagattcagactactcaaactgcatgttcattctcagagagaaagaagggccatattccattttctcaagatccaatgcactcactcatctgttttttgaaagagtctttgtattttgaaagagtgacttctgacctctcaaggaaactttcacaacatgagtcttcagagccctcgatttggcactacctgtagcacagagcaccccaatcaaaggcctaatgagtcattttaatcctgttactctg

SEQ ID NO: 28502 - DNA, 1026 bp, Homo sapiens
gccacagaggcccagatatgttatgaaacattatttctaggtagcttgtgatgatgttcctgggtaaaattcacattggaattggttgattgagtaaagtaatttggccttctccatgtaggtgggcatcatgcagtcttttcaaagcctagatagaacaaaaagtggaggaaggaagaatttgttctctgactgatggtttgagcggggacatacatctactgtccctagattgagacttacaccattaactctcttggttctctgtaatctgaatctgacaggcttaaatcctgaaggccattgttctttcttcttgtatctctaaccattaaatgaaccactcttactaaatgtacatgccactttaccatcatacttgaaaactgaatccacaaattattctaattgagaaatgacatgaaagaattcaagacattctatccccattgggtcaatttgtggaaaatagaagattcaacctcatatggagaaaagatacatatgagttagtctgtaagcaacttcggccttctatgaagaataaaatgtgtgcaaatacaaacataatcttgcagggagttaaatatcctgagaccatgtaagtgcccaaggatgagcaagcaaatccaggataggctgcatattattaaagaatctgttatacagcatgcaaacatggttctagaagcagctacctgtgtaactaattttggggtataggaagcccaggtaccacaagggtagtaagataattttttgtttcatcccaatgaaagcagctggatgtaacccatttttgctgcagccgattgcaaaatcagccttattgctcctgtctctctgggttctgtgaatatgggttctggatgtagtgtgtgtgtgtgtgtgtgtgtgtgtgtgtgtgtgtgtgtgtgtgttttctttttttctgttgttgctgttgttctctttgccattacagcattactatcttttgtaacaaaacttttaatttaatttttcagagcattaagcaccttctta

SEQ ID NO: 28503 - DNA, 1034 bp, Homo sapiens
ttttctttttaccaagctttatttttaaattattcagctatcccaatggccttttaaatccttttttgcatctccaggtctgttttaagaacagcattctaatgttaattctgttgaatataattttaaacttatcccggtgctaggtttagggtgtgggacaaagtgaatccaagggagtagcatgaataggggcagtaaactgtggaaatgagctaaccttgagcttcaagattatcattcgtgtaaacaaatgcattacgaaactaatacaaacatacccaagaggtcacttgacattattctattttacagaaaacgtatgcatctatataagttccaggctcagttatctctgaaataacaaaatgctttcaggtagataaacacaaaaggaatatctcagtttcccacgttttcttcaagcctcaaaggaatgtgtagttaaaattctttttttttttttgtagaagtgaccaatatctttgatatcatcagagaacaaaactttagtcatgctgatttctatcctgtattttgaacacagctctttgttggagttctatatatttattcttctaaaaaaatcttccctgacttatccagctttcatagtctaaactttttgtccaaactcttatggcactgatggtcagatttctttattattattttagagacagggtctctctctgtcacccaggatgagtgcagtggcacaatcatagctcgctgaaacatcacattcctagccttaagtgatcctcccatctcagcctcacatgtagctaggactacaagcatgtgccaccatgcccaaccaatttttttttaaatttttattctttgtagagacagggttttattatgctgcccaggctggtcttgaactcgtggcctcaagtgagcctcctacctcagccacctaaagtgctggaattacaggcataaatcactgcatctggcccagatttctctattattaactgttgcatttcatactatatcatttgattttcttattgagctgcatt

SEQ ID NO: 28504 - DNA, 1043 bp, Homo sapiens
ctgtcgttttcagcttgcctgggttccattccagaccccaccagtgttactagctgtgtggtatttggcaagttaataaacctctttagggcttagttgcttctctgaaaatggagataaagaataacctattcaaaaagtctttgtgaagatgaagtgacaatgcaaaacatttagttgggtgccagcctcataatcagggctcagtgaatgttagccatgatactaatgacatcagtcatcaatgcttggtgagtactttgtaagtaccctacatctatcacatgttacacttgctattttaaaagaacaagcccagatacatttaccactgtataattgaaccattatataaattagaggttatctacaagcaggtaaaagccaagttaaaataattattttgttcatcctaatctttaagtcataaagtaactgctaaaaggtacaccaaaatgttttcttggaaataattttcagaagtattttagtagtttttcttttggttaaggagaaggatatgcattctgaaacaaaaattctaaaaaccaaacaactttttaccatgtcagtgtggtctctgaaaattcatgacacagtaaaatgtctttaaaacgtctttactttctcagactgcatttgtatctcaccttccaaattgatttcttataatacacaagatcatctagtgaaacaaaataatagcaaacacttacacaggctccctctgtgccaagcacctaagtgtttgacgtatactaactcagttattcctcctcacaaccttaggaatgagtattcacaccctccccattgaaacacaggggccttgaggcacaggcaggtgaaataacttgcgcaaggttaatcagtggctaaggagcatgctgctgggatgcctacctgggcaatctggcacctgtttcccatgcttggaaccattatttgtgtgagcatataaaggaccatagcattttgttaagacagccaggaacttataatttgtgtagaacactcttgtttatggagaactggcataaatg

SEQ ID NO: 28505 - DNA, 1347 bp, Homo sapiens
gacctgcctttataaaaactgcatctgtcagcgtgtttcccttcccttttacttaagatagaattccttaccattagagccatctccattgggtgggagagccaaggtgacaggtaaggtctctggtaggttgttcttgaaatgcagacaagttatctggggaaaaagggttggggttgaagttgacacatcaccttagatgtgtttattaggttagttagtcatctttgaaagcagaggtgaagggctgaggagagaggacccgggataggtggattttaatgggaataaagagtaatttagaggaaagataaggatgtaccccaaatagtttgatagctcaatagttttttatttataatttaagctcacacttttcatgtccagcataaagcagcaacaaattaagtatttagactatcatctgagttttagttctctgagtttcaacctctctacatgctgtaaaatgtcatataaagtgtttaatttctcagaaattcttcaggaagacttgcaatgttctctgacaaaaagaaaatccaaatgactgcctttctaaagtgtattcatttgtgtaaagtttatcacatattttctgtagaatatgattctgtgttacatctcaataactgacattaaagatgagtcaacttctctgctaccagggaatgaggtaaagagtattatgtttcctcttgacttcacatgagttccatcattaacaagggattgatggtgtgacttactactgattgagatggtggccaactggcgtcacatcttctgaagtacacaaactcatctttaaaggtaaaaatggattgttctgtaggaataacttatatcctgaaatcttggtgaatgataagattaccacttttcagatcattaactttacatataagaaaaattccctgagtaagccattgctgggggaaaaattataaacttttcatgtcatgatactttatttatttccataaaaacttaacatcacttcttgatattttctaattgagagctctttattgaaaaatagcaactttctaaattaagagctccttattgaaaatagcagtttgtgcacacaatagcataacattcttttctgtattttgagaattaagaaaataaatgtttttaaagatatatgccaatagtgatatttaacacataaaggtgtgatgtatttttgaagtgtcttagaagaaagccaatgtggatattgcagggtcactgtggaaatgtgtatcagtgaccgtttagttgtaaatgcacaaaagagaaagaatgtcagccttagaggattatcctgcttttcccaattttagaaccaggaagttt

SEQ ID NO: 28506 - DNA, 1070 bp, Homo sapiens
ttctaatattctatgttctgtatatattcttcagtcctctgacttgactttttccctcatattcctctattttttttctccttaattttttagctactgggtccatctaactgatgacagtgaatacgaaaggcttggtcttgaattccgtaaatttctggggaagtgggtcagatcctagataaatctcttaacattttgcaattttttaaaaccatccttagtttgtaacttaaacacaaacgcgcgcgcacacacacacacacacacacacacacacacacacacatatacatatatataccttgttacttaccccttcctccaatccaaacacagactcagtcttgctcatgctccaagaatttttgtaatgactggtcaggaggaatccctctaagatgaggagataggcagtcagaagcctaggtgggctgggcgtgagagaaaacccaggaaccctggttctttgggtcgtcaccacgggattgattatagttagtttggagctagagtgtctttggggagatctgctatggtagatcatttgatttaaatgactgaaatgtaaaagtttgaaagtttgtgtttaacacttaatgcataatagacattgtgcttttcacatgcatgatttcatttaagcctacatcttatgaaatatgaaatatattcatcattttattgatgaagaaattgaggcttagaggaagattaagtaactttccaaagcttcatgtgagtgtacccaaatgctcttcaaataaggcatttcccagcacagcttttctttaagtgcctttgtaatgtttatagctttttattgtaacagcaggaaggttatactacaatagtttattccagtcctaatgttctatgactttgtgtctttaggcagcaagcaggattttgaagaactgggactcaaagcaaggagtcctcttgtagatatacagtggcagataaaatgaattgaacagacacttttttttttttttgagatggagtctcactctgtcacccaggctggagggcagtggcacgatcttcgttcactgtgaactccacct

SEQ ID NO: 28507 - DNA, 1111 bp, Homo sapiens
agcttgtccaactcacagcccatgggctgcatgcagtccaggacggctttgaatgagacacaaatttgtaaactttcttaaaacattatgaggttttcttgcgatttttttttttttttagctcattagctgtcattagcgttagtatattttatgtgtggtccaggacaattcttcttccagtgtggcccagggaagccaaaagattggatacccctggtttccttagttgtttaaggtaatccttgattctcttttcccctcatagccatgccccagcccatccatccgcaagtcctttcaacttttaactctgaaacatattctgaatctatgcaccttataacatctcatctactactacttcccttatccaagttcctctttgttttcactcaccttccttgctttcactcttgccatctacagtgcattttccacttagtagccaaagtgatctttttaatacacaatctgttatgtacttcctctgccccaaactttccaatggcttcccttgaacaaatcccaactctttaccctgtctcacaaagccctgcattatctggtccctgcctgcttctctgactttatctaacaccactcctttcctcactcactatattccagccacagcttaaggtctctgcaccagcagttcattccgcctgagtcaggcatggttttccctttaaacataccagtcagctctttccctggaagggtttgtatgttgatatttattaattttaccttttattatagattttatgagctcattcagtgtggagtagtcactggcctgcccatatgtcttgttaccactttcagttgacctaataaaattgatgtggtcatgatacactttgcacagttttctttaatgcattctgataatcctctgctacaggaggttgttatggactaaggaaattgagtttaaattttactattgtcttgggaggctgaggcaggagaattgcttgaacctgggaggcggaggttgcagtgagctgagatcgcaccactgcactccagcctgggcgacagagtgaaactccatttcaaaaaaaaaaaaaatttactattgtctttgttaggttttacttat

SEQ ID NO: 28508 - DNA, 1017 bp, Homo sapiens
acttctcagtaaatgataactccattcctccattcctgcacatacaggtgcacactgcacatggagaggaactgaggcccccagccaaactcccaagctgacagccaacaccaactcaccagccacatgagggcgccatcttggaaacatacccccatccttcggctcagctgcctctgttgagtgctgtgtggagacaggagcattcctcactgagccctacccaaattgcagatttgtggcaaaatacaatttttacttataaaccactgttaaaggtggtaatgcttatccagagacttaacatacaaggtgttgaaattaggaccatcttttttttttttttttttttttttttttgagaaggagtctcgctctgtcgcccaggctggagtgcagtggcgcgatctcggctcactgcaagctccgcctcccgggttcacgccattttcctgcctcagcctcccgagtagctgggactacaggcacctgccaccaccacgcctctgtggatgccgtgtggagcagacaggagcattcaccactgagccctacccaaaaatcgcaacgcactggttatctgttcaccttattcccttgtcttcttaggtctttgatcaaatgtcaccattttgatgatgcttttcctgaccatggttgccaaaacttaactctctcccctgccctaacagcatacgaagaagcatttcatatatccttctcttcatcacttttctcctgggcaccatctgactcatatgttttactcttttatttgcttattgccttcctctcacaagaacgtaaacttcgcaaagacaagatttttttttgtctgtcttcttcacggatgaatccttagtgtttagtctagtgccttgtgcatgatgatgctcaaggagtagttgttgaataaatgagtgaattgaaattggcacactttggcaagtagcacagagaaaggatcaaaaaggtaggaaaatgggaggaaggagaaggacttactaaaatattaga

SEQ ID NO: 28509 - DNA, 1958 bp, Homo sapiens
gcagacagtaaatgccacacacagctctaacagtgacagggggagaaaaacgtcttcagttactggcctgaccttagaggtaaagcaacatattaacagagagggtctgattttaaactttgagctgaacatacttctatagtatcttaattctcagtttttaaaaaattacatcatctagaatggcgtcgtccttgctcttccttttttcttgtgccaaataatagccccctttggtatatgttattgttttaattgattctcaaacctctccttaacattttaacaaacataaaatttgatagaaatgggctagactaaattcagcagtccaggaaatcgagtatttttctacacagatttgagtgtcacccaagatacagtatactttgctgaatctccctccatgatactcttgtggttttatctattttaccaaaacacttccacgtaaaacaggcttccgttgactctgtttgtcctttatggacccaacaggggaggaaaaaataccattgcactgggtttatccacttactgtggagttggggaaccagaaacaaccactggacacgttgcaagcgcgtcaaggtttccaccgccacctggtggctagatggagcacagcatctgtgtaactggtgggcaaaggcgttctgctccaagatgtcaaagtgggggagaaaattatgggtgttctgcaatcttggcaaaagaagagtactgtactccttatctttttactgcttctccatgttcacccttaaaagattgatttttattttttactcagctctcctcttgtttttcaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaa

SEQ ID NO: 28510 - DNA, 1088 bp, Homo sapiens
agtcacacatcagggctcagagtgctatgactaggaaaatgctgacctcctttcattagtatgatcgtgcctttccagcttttgatagatccaagcgctatcttcccaccactcaccaaatgttccacctgtcaaagggtttcaggtccctgcagacttcggttttgacctgtggggaaagtagacttcctcgaactggggaagccacatgttgtacatccttctataaactatgattatcattcttagtaggaaaatatgtgatttctttttttttttttttttttaaagtaagcatcaaatatttgaccaaccagttgggcagagaatatactgaaactttttatataacctcatccaaatgtcccctgcatttaagaaatgaaattcttctaattgcgtttataaattgtaaattatattgcatttagaaattaaaattctttttcttaatttgttttcaaggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggtaggtaaacttgactgcatgtttccaagtgggaattaagactatgagagaattaggcttagctttttgctaagaactagctaagtatctcttttaaaaaacgaatcagtgtgcttccatgatgcttgggttacagttgttctttcttgttttggttttcattcattgcaacttaccgtgaatattctgctcaaggtattgagagtgtgtgttgttatctcaacttacaatttgtgttgaagttatcaaaataatacaaatgataatgcatgactttaaaaaagcatgattactcttagacttttttttttcaaacacaagcaacaaaaaccagtacaagaagttaaaaataaaaatagaagtaggaagttgctttttccaaaaaaactaaacatgtttattcttggatttcttttgtcttaaatagtctggcctctcaatacaaccaggtaatagtaaataatgtgacttttcag

SEQ ID NO: 28511 - DNA, 1504 bp, Homo sapiens
agagaagatagcttcacaatctgtaagccaggtatagagtgacattgattgtgggtctcttttcaaataggttatcaagtggaagctttttgaacaattggatgaggaaatggtgctaggtcacaaccagcgtggatttcctaggttttgtcagattatccttaccttctccttgtataggctgtgctcttagactggcacatcatatgctgtggacattgtgcttttcagtgtcagcaagatgtgtcacaagtttcccagaatctcgtagacaagattgaaagagtgattaggccaagagcaggaagtgaattcccctgggagccaaaggaattgggaatgtgtagcccaagtaagacaagaaccagcaggaacatgcctctccttagggtcgtgatacctgttcaaggttttaatgtggaagggaggattaggcttgctctgtgttgaatcaggctcaaaggatggaagttacagggaagctgattctggcttcatgtaaaaaaaggacagtttgggcaggcaaatctatcaaaaaatggagggaaattgatacattcctctatgttcaaacaggaactgacaatctgcccctgggtgggaacacggtagagaagatgacttcaaaagcccttttcatcctaaaattctgatgtttgataattaaatgttatagcatggacactgacatttacattttttacttatgtttttggtttttaaatgactctgcattttgttttaagcttcaaattattatttgaataatgaaattcatcagaacaattagtgttaagaatcatatagcaatttatagaaaaggaagagttcgtaggttataaattctgttagttgctaagaagcatttttaaaattatgtactatagctctttattcagcagacgaaccaattacaatctgtgtaactagaacacttgactaaaattatataatttttacaacgcttcactgcatagatacatgaacataatttatttgtaattggaacaaagccccaaagtagcagttttgttctaccaggtaattaatgctcatttttaaagccttttattattatttctgaagtaatgagtgcacatggaaaaagacacataataggctaaacaataagcccgtaagccaagccaacatattccaggaacaaatccttgccaacctctcaaccaggatttaacttctgcttttcccccattttcaaaaattatagcatgtatttaaaggcagcagaagccttactttcaggtttcccttaccctttcatttctttttgttcaaaataggtagtaattgaagttttaaatatagggtatcatttttctttaagagtcatttatcaattttcttctaacttcaggcctagaaagaagttttgggtaggctttgtcttacagtgttattatttatgagtaaaactaattggttgtcctgcatactttaattatgatgtaatacaggttctgggttgacaaatatcaagacggag

SEQ ID NO: 28512 - DNA, 1025 bp, Homo sapiens
gtgcgatcattgtatactagggacgtctaactgtgtcaggaggaaatggcagctgagcccctgtggcctttcacctctagcagtgccacgctgcagcacattggccggctgccatgctcctgcctgcagtcctgccagcagctcttgtgagctgcgactttgcataagtagcttgaatgccatgtgcctcagttttcacatctgtaaaagggagatgataatggtacctatgtcatggctctaaacgcgatcatgcacgtgaaagcagttgaagtcttgcctggcagaagtaaatggtggctgctgctgctgctgctgttgtgattgttgttactcaccaaagagatggttttgtttggtttagatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggtaagagtcccctgagccagcaagggcgttctgggaggtatatatacacatacataacgtgtgtgcaagagagagagttatcttttgtatgttcttgagtggtgaattttttttgatgtagtcataaatattttcattataattttactttaaaaagtaaatactaggagttactatgtcattaaaataatatatctgtgtaaattattctttatattttttatgctgcaaagcatgtaaactgccaattgttggaaaagacaacaactccattgtataggtggcaaaacaaaatggtaatgatttacataacatttgcaggtaaagggcctcttgtttcgcacatgtccaggtttgcattctagggaatattatccttcgagtgaacactcccggacgaaggggagccacagtgtattattgaagaggcagttcttca

SEQ ID NO: 28513 - DNA, 1044 bp, Homo sapiens
tgtaatacagcatccgttttcctgaatgatttttatagttttaccattggcaaacagatactttcttttatgtatttctactccataattttaggaaaaagtaaatccttttagctacattaaaaagaatacactttctaggaataatgaatgtaaaaaaagtttccttttttaaaaaaatattgcgctctctaccattctggcagacaaattgttgaccttaatatgtataattcagtgcagtatattgatcttgtttattgtgctccaaatggacgctggcagaaatttgaggaattaaatatcaaccacagtgttttcttcatgcgattgcaatggtttgttatggattattttgttcagttcaaataaatgatgtacgttcagattctttgcccaattttttaattgggttgtttaccttactttcttaattttatttttatttttatttttatttttatttttggagacagagtcccgctctgtcacccgggctgaagtgaagcggcatgatctcagttcactgcaacctccgccttacggattcaagcgattctcgtgcctcagcctccccagtagttgggattacaggcacatgccaccacatccagctaatttttgtatttttagtagagacagggttttaccatgtttcccaggctggtctcaaactcctgagctcaggcaacctgcccacctcggccttccaaagtgctaggattacaggcgtgagccactgcactcggcctgctgttattattgagttgtaagaatttttatatattctggatactattaaattcttatcaaatacattatttggaaatattttacccattctgtaggttgtattttcacttccttaataggatccttttgacacacaaaaattttcaatttagaagtctattttatcagttttttcttttgtggcagttactatggtatggtatctaggaaaccattgtccgaaacaaggttacaacgatttatacctgttaccttctaagagttttgtagttttagctcttacagttaaat

SEQ ID NO: 28514 - DNA, 1032 bp, Homo sapiens
acaaaaattaggtcggtgtgagggtgcacgcctgtaatcccagctgaactcaagaggctggggcaagagaattgcttgaacccaggaggtggaggttgcagtgagttgaggtggaggtgcaccactgcactccagcctgggcgacagagtgagactccatctccaaaaccgtgttagcttttatcaggaaaggccattaaattttcttcaatattacctacatcaatttgacatcaaactataagaacacaatatgtgagatgttttgaaattaatgaaatgaatcttctctttgagacgagtttgtgcacgctatgaagtccattaaatattttctgggaagagttcccagttaaaactactttctaaagtacccaagcacactatatagatacatcaagtaggtttattaatgtcagtatttcggtgaaaattgggaaggccactattctgagtagagaggtgtttgttttctacttgaagactatgaaggatattctgcactactgggcctatttctgaaattgtatctagctgcaagttactcattaatttaattaacaaatatttattagcaaccaaattgtggcaggaactgtgcctagaggtagaaatacattacgctcttgtttccagagaggaaaatgagtaatgttctaaaatgtaaatcttatgtttctctttcctcttgctgtaaatgatgtctaagccatttcggtggtgcctgttcttaatcctttaataaattattttgaatgattttttaaaaggcagtgtgattgtgaggtgagtttagtacaaattaaaaaatgtcacatcagttgcaaacagacagcacataattatgagctaaacactgtttcagaaacagtagtgacaataaataggattcggtataattagtcctcctgggacagatctcttcctctgttctttgccatatattttaataatgagattagccatctaatgccaatataaccagactgtagtattaatacacagaaaaattattgctagtaacagaagatt

SEQ ID NO: 28515 - DNA, 1047 bp, Homo sapiens
gggtacaaaaacatgatctttagagccacagagatcttggtttatattcttccctctcccttttttacctgcatagcctcgagctggtaccttaacctggttcgtaaaatgggatggccctggctaatctcacaagctgttgtgaggaatcaattaaattagatagattttgtaaagctcttaatacagggtcagcagtaatgctacttgttatcagtcccacagtgaaattcactgttcacagggagatggtcagcctacatatagtgtgtattcatttgcagtagagtcttagtgggatggtgcaggtgatttgtttatttgtgggggtataggatattgttaaattgttctgaaaatcaaaatgtgagttaatttctatagtaatgcttatttgcaactcattagctaaataaatctctttaattatttcatggattcccccagcttaaagcttaaagtccagtttcttaaagtgtatgaggtaaaatggaaaaaatgtaaatgtaatatgggaaatcagttctcacattgcagtagaacattgaacttctatctcaaactaattttgagattccttgcttgaagaattgttggtagagtaccaccactgtgaacattcccaaagcaggaaattgaaatatttatattgcaaggcttatctcatctataaagcaaagatggtcttccatttcccccttgcccacaggttccctttattaacgtggtagaagcaccaaagcagatgggacaatatgtttcttttcttccatgttctattcttgttcattgcagcagggcatttgtcccaattttgctgtgaaccttgagattatttttgatatgcttttcaagtgtaatgaaatatttattccatcttgtttcctccatggttttacaaaaacaacaagaagaagctaattgcctatcatatacaaagaatgaatgccaatggacaataaaatctgtaattaggaacccacatggtgatttgatatagtattgtctcatagaagtcttctatctatagttatttattccaagcct

SEQ ID NO: 28516 - DNA, 1071 bp, Homo sapiens
aatctgagtactggctatcaatacctgataattttattaatgagttgagacccagatatgccgtagaggtaaataaccatataaaggaaatatagaagtgtaggagaagattgctctggaaggctggggtaaaatgaaatcagctttatccttaagacctccatagaggttaactgtaccatctccttttactgctacagtttatatgaaactggacaatattgaagattttgacttttcgaactcatctattgagtgttgagcagctatgacaggttatttctttatgtgcctccattaacgaagtcaagaatagcttctgacaaattgacaaaaaacaataacctaaggttaacccattctggacgccagttattgctattgcttcacatatattttttagattcaaacttgaggttgcttttaagttttagtgtgatgtgctgaatagagaatagatgttaataaaaaaataatgccagcattcgttccttcacattcagttcatatatttgaaaaaattcccatgtcagtatgtgtccatggacataaaaaagaaatgtagcttgactagagtaaacacatcatagattatatttttattaccttatgtccatgtgatgcattgatagtgttctccaccaactatgattgcactgactataaaattgtaatacaagggcatattagggggagaatgcctttgttttttcttttgttgttattttgtttttaagagagtctggtattacactggaggatcacaaactgtattttcttgttataaatggctcctctatcttggacttaatggttaggataaatatttgaatgtagaatgcgttaggagttttaactatttttgaaattaggaaaatggagagacactttttttttttttagagacactttttttttaagttataataagcatggcactcggaaagctctgccatgtttcaagattaaagtttcacatgaacgctaacaagtttatatttcactcatatataaatgatcctccttgtctcctttcctaaattatagccatctcaaatgacaacattgctg

SEQ ID NO: 28517 - DNA, 1034 bp, Homo sapiens
tgtccacaaagaatttcactccaatttgaaatatctattcagaactaattttttgtggttgagcattattttttgaacaatgaattgcataatcattttgtataatccagggagctctggcttagattctgtattattttgtgttatactgatttttagaaaatggaatgtagcgttgacacgagcacaaatctcagcaagggcctaccttacaaagataaaatgcgtggagttttattagaagcacatgattttgctttgtgtttcgtatacaccagcatttcagtgtagtaaatggcattttgtcttgaagagtgagcagagttgttacaaaagaaggcataatgcttccttgccagcagaattcagataagtgaatatcagaaaagctatttgtgatcttgaaagtgtaagaaattcaacatcaataaaggattgtggttccttagatagccatgtaagtctttgcctatgtttctaacatttctctttaggaaatattcttgcttttatttttctgaacaaattttctccattattatctctgatatttactttgaacagaaaggtggattggaaatcaaaaaataagtttgatttcaaaaatgatttcaaaatgttagttttctcagtattttacattttgagaagagaacaaagaaggcagatgaagagttttttgttttttcttaaatttgttttcttttcaactttatttttaattgacataataattacatatagtatacattttgaagatacggttttaattttcacaggaatcttatttgggtttagttatataaggtctaattttgcatcctctacatttagtggctgatttataaatttccactgagtgataatagtaattaatgtgaaacaggttttttgctgatgtttttagaagtttcagtagattaggaaggaagaaattatgctattgagaaaaatagaaaatgtaaacataagcatttgaactctctcttgagatatttttatcttccatgaaactagatgcggcttattgaaga

SEQ ID NO: 28518 - DNA, 1051 bp, Homo sapiens
acacagagatgttgtattgttttatttcctgtagaaagacgaaggcagttaaaagaatttcataaacaaaacactccaggctaaaggcaaaaaagaaatgaaccttaaaaaataacaagttaataattttgttggcaagaagagcaacaaaagcaaccttctgaaagcaagatacctggtcattgagagatagcaactgttaatgccccagaaatagaggaatctttaatgcaggtccattcattccacctcaaactcctgaacaaaagctctaattgaggcaagtcttcctgggaaagggggcctaacagaaacatgttatggtcagttgtgcccatgcgagataatttttttgtgcttgtagctaattccagtaaagaagtagatgttttagagggtaacgttaaaggggtcagctgcaaagagtccttttcctcctcctcactgttacaaaaggtgacttgtggttcttccctaattgagagcaatggcaacgccataggtgattactcattttgtaaaactctaattacaagtaggttgcttctgtgttcaacataaaaattagaagtgacttgcaaagatgagatactgcagggaggcttacaatcttgttttcagtgttagtgtttcagtacctggaacaaaatgtgatttacagccatcctttctaagaaaattgtcatcattaccaacatattgctactgataccagtccttaatgtgcttcataaaaaactcaataatttcataacccgttaaaaccggaaagaaatggagggaagaaaaataagacacttttagcgtagtcataatcttctctgccatattgtgttagaatcgatgatacccaaatgagaagatgtctgttctctgtcactgattccagtagaataaaattattgtttaaaagtaagcacattcgctgcactccagcctgggcaacagagtgggaccctgtctcaaaaaaataaaaataaaagtgagcacacgattgcaagatctatctggttttgggggcttattgtcatctttggttgttaaaaaaata

SEQ ID NO: 28519 - DNA, 1075 bp, Homo sapiens
agttttgatatccaccaccccactttttataatggactacatttttcagagcagttttaggtttacaaagaattcaagcagaaactacaaaaagttccctctacctctcacttccccactccccaacagtttcccctggattaacattttgccttagtatggtacgtttgaaccaatatcgatacactattattaaccagtattcctgttttaacatgagaggcgactttttgtgtagtatagtctcttggttttgacaaatgcttaatgctgtgtatctattattacttatgacagtatcgtgcagagtagtttctaaaaatcctctctactccacctattcatcccttccccactccccctgaaccactggcaaccgctgatctttttattgtctccgtaattttcccttttccagaatgtcctgtggttagactcatggcatccccttttagcaactgcagaaactaagaactgtccccaaggataaaaatttttgcagacccactgagctgggatttatacttagacctgctgaattgaagttttgggtgtgtttcttctcaaattgccaaaattccatatggacgacttttcttttccttccctgaaatgtgtttaattgactttttctgttatttgtgtttgccttcacagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgaggtaatccaccatttgcttggattccccccacccccaaggaaaagaaagcgtaataccagagttggaaatatccaccctagcaccactgccttccccaatcaaaaacatgtttttttttccaaaaggcttcttatgcttgtgaaatttttttggtttaacaagcaaacaatttcaaataatgtgaaatctttattatacagtttgttttgtacctt

SEQ ID NO: 28520 - DNA, 1047 bp, Homo sapiens
gaatgtaatctctctgagtacagggagcttatctttttcccttttggagcctcggatccagcagaatgccagacacttagcagccactagcatttgatgagtgaatggcttttcatacacaattttagacattgttcctgattggtctctctagtcaataatagatttatcaaatctaatcgataatagatttctttttcttttctttttttctttttctttttctttttttttttgagaagtcttgctctgtcgcccaggctggagtgcagtggcatgatcttggctcactgcaggctctgcctcccaggttcacgccattctcctgcctcagcctcccaagtaactgggactataggcgcccgccaccatgcccagctattttttgtgttttagtagagatggggtttcactgtgttagccaggatggtctcgatctcctgtcctcaagatccgcccgcctcagcctcccagagtgctgggattacaggcctgagccaccgtgcctggccgatagtagatttcttttattgattagagagactaatcagcaacaatgttttaaaattctcacatagatctctgaatgggaaagcagtcttgaattatgcttgcagggagagagaggggaaggaaggaggaggaatggtataattagacttcataaggctagattttgtttctacttaaataatggtatcacagtgggacatattatccatgcagaaagtgagtgggcatctggtctattatctgtggtctttcaggaatggcagctctttagtttaaaaaacaacaaagtgcagcactgtttatttaatggaaatagaaaagcagtgcctgtgtattagtggctcagatttttttgttctttgttttcagctgtctgctgtatgcctctccagcggggtcttacagaatctcaagtctaccatgatcaaagctgaacccattagctccatttcttaattcctcctgtatcctctgttaccattagtaactattctccaactcaaagcatcagattcctcctcttactcactccct

SEQ ID NO: 28521 - DNA, 1041 bp, Homo sapiens
taatcaataataatacgtaatggctccttaagcacttctatcctagataaggttgagaacattattaaaattagttttggtagtaatcaagtaatgataattcttatttatgaatttaaatatgtaggagtttttttattttagggaagcaaaaaggactagaaagtatgatgtctcatgattagaaaactgctataaaaatgaaggtagaattgatttgggctgttttggacattttaaatagaaatttaaataggtattcaaatagcaaagtcattctactttaaaacttctatacttttttaggatcttcaattttatatttaaattatatttttgaaatggttttagaagaaatattgtatcttaaactctaactactaataagtaagagaagatatatcaaaggtttgatcttttatctcctagaatatactattcattcgtttcccattgtacgtcatttgaatgttaatggttagcctcaaatggttttcaacataattgtatagctactattattggaaaattggagccaaggactcatacacatatcagaagtggtaatgaagcactttggttttatgaaaatatgtttacaaggtagtcacaggatagcaatattgcatttactgtaatacaatgatggtggaactaagtgcagtggaacaggatgctgagaccacagttaccgcatctctaagtgcctcgtctagttatggtccaacctcagatataactcattggtgttgaaacacacctagcaacattttaagcatagaccgttcattaaaaggtacctttttaaaaatttttatttttaaaaattgacatgtaataattgtacacatttacagggtacacagtgatcagatcagactgatcagcatattcatctcaggcatgtatcatttctttgtgttgggaaaattcaatatcctgcttctagctgtttgagattatgtcatatattactgttaactgtagtcatcctacagtgctgtagagcactagaacttattcctcttatctagctgtaat

SEQ ID NO: 28522 - DNA, 1040 bp, Homo sapiens
tgcagacactggtgagcgtgtgctgagaggtaacttgatgtatctttctggataattagatgattttttttttctatttctttgaacattttttttttaaagagctgcttaagatctggaggagtgattccttttgaccgtgtcttattttcattaagactgtataacttggaagagtttttttttttctttttctttttcttttttttttaagatgaagtttttgctcttgttgcccaggctggagtacagtggtgtgatcttggctcactgcaacctctgcctcctgggttcaaacgattctcctgactcagcttcccgagtaattgggattacaggtgttcaccaccacacccagctaatttttgtatttttagtagagacagggtttcaccatgttggccaggttagttaatgttactctctggtttggggggcagtgatatgttttggcttttttcccacccagatctcttcttgaattcccatgtgttgtggaagggactcggtgggaggcaattgaatcatgggggcaagtctttcccatgctgttcctgtgaagtgaataagtctcacgagatctgatggttttaaaaagaggggttcccctgcacaagttctctctctttgcctgctgccatacatgtaagacatgacttgctcctccttgccttccaccgtgattgtgaggcttccccagccatgtggaactgtaagtccagttaaacctctttcttctgtaaattacccagtctcaggtatgcctttatcggcaacatgcaaatgaactaatacagctcggggtggcttgtgtgggtgcgtatggccatgtatgcaggtgtgcgtgcattggaatatacaattccgtattgaacccagtttaaacttcatcagttctggtgattgctggagtgtcacatatggcaagacgtcaccttgccctctaactacaccagaaaaccaggccagcaccattgactatctagatacagtgggccgtttatattattattgtttcatatttttagattatttggtaa

SEQ ID NO: 28523 - DNA, 1045 bp, Homo sapiens
tgttccctagagctacagatttccaaacagcacattcaataggagttgtaagtttataatcggcaaactacaggatgcttgtttttttttcttttaatttctggtgtaatctgctactagggcccccatagagtttattgtctatatcagctagaacactgggaccacagtcataaactgaaggatccaggcaaactgggtcatatggttacccccaccaattacagtcttcagtgatgatgtcactatccaggttgatattcagttgaaatgctagccagctccttcctagttaccttcatttacatcccatttcagtacctgaacacagtcatgctttagactctgaaattccttagaaatagtaccataaggtttatagctttgatattcctctctgatcatgatcttccctcataatcacctccccagttcaggcttttagtccattatcctctttttccctgcctgcctttctaatcaggatggaatcaatggataaccattcttacctattccattgaacatccttgacttggctgaaacccttcacattttctaaacatatttttgtcaattctccatagctaggaaaaattaatttctttctttagttgcttctgggatttctaaagtatcaagtcatgtaaccttaccacttaattccatttcttattcatgctgtaacatcagctgggatcttaatgttactagatgcacctaattatctctgtcttgatgacctatcatcttccccatagcagttgatccagcccaacttcattctccttggttcccagcgtaactctctctcatgctctacagatgacccctccaccgtcatccattgtgaatttctgcaacatggtacctgacatttggtaggtgcccagtacgtgtttgttgaataaaccattgaattttctcctgtacttcagcaactcttgtaccttcttctatccctttgtttcctgtcttcccttttatgattatgttctgctggactctcaatcatctcctctccctttcttgcattttcagtctc

SEQ ID NO: 28524 - DNA, 1080 bp, Homo sapiens
gagtgagctggggatctacctggaatgcgcacaatttctggatacacgaattaagccagaaggcattaattctctggtatctgttcaccagtggagactgctacatcttatttcccaattagtttccattccagttgttcgtataaacctctattatataacatcgtggtcttattaaataaataataaacaagaataaaaagagtaccaaagtgtaacccatgctaaaaaaaatcctgttgtaaattcactcaaaaagcaaataatcttttcctttgtgaaattggttcctaatatattgggtctgcatgttgattattttatgtggagttttcttacaatgaaacacatctactctaccactcactgttttctccttacactttgtagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggaggtaaggtggcctttgtgttcagcctcagagatgctgaaacatcttgtatggagtatttgtatcctgtaaattaatctttctgtttatcactgaaaaggtctctgcccactcccatcagagtctgctgttatgcaaaaatctgaactatgaatttttatggcatcctgttgaattaataatatcagtcacccatcacagagttaattttaactatttaatattaaacttgggatcaaaatcccactgataactatcataggttactggtagttctaacagggagttgaaataataatggcgttctgttttggtcattaatttaaaaatatttttaaatgctctctgggattgtcagtcattagtttaaggtgaattttcgttaaaggtttggtttgagattttgggcgttctctgtgtggatgtgtaagggtttttttttggccttttatcatttcttttccttcatagtggaagtcaaaggcattaataaatgctt

SEQ ID NO: 28525 - DNA, 1105 bp, Homo sapiens
aaaaagaggcaacaaaaaagcacctataacttatcttgggttggttaatgaggaagctgtcattcaaaattagtaagactactgtaacatttcttggggtcctgaacattggaatgagagtcggttttcagagttgagcccacctctgtcattagctttgtgcaaacctcatcaggctcaagattcctcatttgtaaaggggaatgaattctctgaccagttagtttacattcctaagacaaggttaaatttggaaagcaaagaattttcggtatatatgtgataattttgaaattcttgaatttttaaaaaatttaaatgccacattacttatatttttttctaaaaaaaagtcaaaccaagcgctgtctagttattaatagataccacagatgagatgcctgagttggtaagctctttttaattctagttcttttcaactacaataattttatagacttttttttgaaggctagaatgttgatgtggaatcaaataggtatgcctctatgtatggtagatgcacctgacagggatcacttgacttgaacatgccctgacaatgatcctgtgtggcaggtgcacctgattctgagttctgagttaagaaatccgggagtgggccgggcggggtggccggtgcctgtaatcccagcactttgggaggccgaggcaggtggatcatttgaggtcggaagtccaagaccagcctggccaatgtggcaaaaccccgtctctactaaaaatacaaaaaccagctgggcgtggtggcgcaggcctgtagtcccagctactttggaggctgaggcaggagaattgcttgaacccgggaggtggaggttgcagtgagccaagatcacgccagtgcactccagcctgggcgacagaatgagactctgtttcaaacaacagcaacaacaaaacccaaaacaaaaaaacaacaacaaagaaatccaggagtggctaacccagagagccattccttatctgtaaggaacatctgagccctcatctccttctgtggaacatgggcctcgccggggattgagaccctttgttatgagttaagtggaagttgccaggtggagattgttagggggagggt

SEQ ID NO: 28526 - DNA, 1023 bp, Homo sapiens
ttaaaggcgtcctaactttgaattagataaagctaaactgtggtttaattgagctgagtttgttgtatgctatatctcaacttcacaagatgtttgctttttcttggctataacctaagattatacaaatataaaattacctttatgcccatttgatagactttagggctgaatttccctgtgtaagatgttgtagaggtttgtacttgtgattgtttttactctagaagcatgtttatcttcactcctttagtgacacgtgtttgttcaggaacttcaaactcaatgtgatcaaaactagactcatgttccctgaatagtctctcctgactacaaatctgttggaaacttccaatcctaattaataattgtaaactttttaatgtaagtcatatgaggggttgttgtgagcataggaggtagggagatggtagtgtgagctggagcatatggtaaaagttgtttgaaagaaagtagacccatgatgtggatcctgagggatacgtaaagaaaatgaagaggtgtagatttaaaaatgtttatggggcctgggcgtggtagctcacacctgtaatcccagcactttgggaggccgaggtgggcagatcacctgaggttaggagttggagaccagcctggccaacatagtgaaaccccgtctctactaaaagtacaaaaattagccaggcatggtgatgggcgcctgtaatcccagctactcaggaggctgaggcaggagaatcacttgaaaccgggaagcggagattgcagtgagccgagatcgcgccactgcacgccagcctggatgacaagagcgaaactccgtctcaaaaaaaattaaacaataaataaataaatatattcatggggatgttccagggaaagtagtttgtgttggtagccttgagaaataataatagaaaattagaatagaactaagttggttcattaaagttggaacacttgtagagatttttgatttggacagacattaattcatttgattatttctcttattcgatg

SEQ ID NO: 28527 - DNA, 1054 bp, Homo sapiens
gatcgcaaggtcaggagattgagactgtcttggctaacaacggtgaaaccccgtctctactaaaaatacaaaaaaattagccaggcgtggtgcgggcgcctgtaatcccagctactcgggaggctgaggcaggagaatggcgtgaacccgggaggcggagcttgccgtgagccgagatcgcgccactgcgctccagcctgggggacagagcgagactcagtctcaaaaaaaaaaaaaaaaaaaaaaaaaaaaatggagcccttctaggtaggtcatcctccatggctcactgcagcacttccttggccctgtcccaagttccataattgcctcaattgcattggctcctgcttgatttgctttctaaaactcaggacagaggatgagttgaggagactgacttttttaacaatcgcattttgaaaagaaggaagcgtagtggtgtttcttggctccgtttccagttttgtttcttttcattttaattattgtacctggtattgtgtcctctttctgggacttttaacaactaatgttttgattgataagagctctaatagcatgggtgatttatacttcattacatcttcagttttgtcttctttactggagttgtattcaggtgtcattaagtaacgaggcattaaaaagaaacgataacttttgaaaaactgctgttatggcttatgagtgggctttgctgatattttcttgaagcacagaatttatctatctctgtaggtcctagatgataggtgagaaaaagaaacccagcttatttggcatgatattgtcccaaggcttgttagtaattgctttgaaaaatgaatagcaaggctaatggacatctgatttgtagtacatgctaagaattgcaaatgtgtgctcaaaagaaatttctctgattacaaaagtaacatatattcaacgtacaaagttgagaaaatacaaccactagctaaaaataatcaaaaccatttggcttccttgcagtctacatttttttcatgtatgttttgcttttgtttttagtgttatttaatcgtttcctgtt

SEQ ID NO: 28528 - DNA, 1073 bp, Homo sapiens
acatttgtatggtggccataccaaaaattactcttcttgaccccaggaacacccctcttttcccgtttcacttagagatcctactaatgcctgggtagctttactttctgtcttagcctgttgtttgtcccagggtgtattagtctgttctcacattgctgtaataaactacctgagactgggtaatttataaagaaaagaggtttaagtggttcacggttccaaaggctgtatgggaagcatggctggggaggcctcaggaaacttagaatcatggcaggaggtgaaggggaagaagacacatgttcacatggccagagcaagaaagagaaagagtgtgaagggagaggtgctacacactttcaaacacccggatctcatgagaacactgtcacgggacagcactcgagggatggtgcttaaacattgaaaccacccccatgatccaatcccttcccaccagaccccacttccaacactgggaattacaattcgacatgagatttgggtagggacacagagccaaactgtatcaaagggttgagcacagagtggttcttcccagttctggactttaccagattgttggtggccaccatgagtggggagaattagccctttgctgtcaccttcctcttgcaattctggtattatctgtcctctgcctaccacccacccacggaagtcttgttggatgatacacaccagccagattcttcaacattaggcgccataagtaagaaagggccaaaacatcataccttgtgagccattttaatggatttgggctttattttgtagcaacaggaagtcactagactttattttttatctatttatttttttctttttttttcttttgtttttgagacagagtcttgctcttgtggcccaggctgcagtgcagtggcacaatctcagctcactgcaacctctgcctcctgggttcaaatgattctcctgcctcagcctcccgagtagctgggattataggcgcctgccaccacgccgggattttttttatttttagtagagacagggtttcaccatgttggccaggctggtctcgaact

SEQ ID NO: 28529 - DNA, 1073 bp, Homo sapiens
actcttaacagacttgttaagagttgagactgataaccagagaatattctgggggaaaccaggagggatcgccaacatactcagttatatttgtggatggtgaattctacagtgaatttttctgttcaaaatcataatacagtcacttgctaactaccaacgccatacttgctctcagtgctgagaggtggcacaaatattattttcagtcttggtcatcaggcagggcctggcaggcatcatgctctgtgtgagtcagtggagtttattataagaatgcggtagcctccacagtgattatatttattataggaaaacgtgtaattttgttgtcagaacctttcagcaggtaccacaaaatctcatatgggaaaacgtgtaaatttttcatgaataaattcctttcggtattggtaatttccttctctgttttagtataaaagaaagcattgccttataggtggctaagaacatctgtagcatacataacacttaatctaaaggagtgttgaagaccgggctgattcctaattgagaatgagcaagaatagaactctttttgatagttatccctgttcttcctccaagcctctgccttggagctatggatactataactaactgaagcttcttctttcaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtaagtcctgtccggtggctagcaattcacgttggatcacatgcatttgttttcaaaaaatttaacttcttgtattttgcatcagtattttaaccctacagtaaaaatcttggttcctaatgattcaccataccattaatatatttatttgcattaccctatgatatacatataaatgtttttaaaattatgatgtcgtattatgaccatcactaaacagtagtttaagatgtcacagcacttttttttttcctcactctgtcac

SEQ ID NO: 28530 - DNA, 1028 bp, Homo sapiens
atagcttttaatgtttttttaagagagaaagaggcccacgaaagttgtcctggggcccccgcatcctcctcatacactggtgggatgctgctcttgcttgctttggaatgtggcagcagctcccagtgacttcacacgtttattacaaattcaaggtcatttggacgctagccttgtgctacctttcatgcttcctgtccgacccatactcagcctgggcatgttttctgctctgatctttggtctgccttccttctccttctccaagtcaaaccagtcactctttcctgagagctcttcggtgtacccttgccagacctctgcattaacactccagcacctttggttagccaatttggccttatttgtgtctccaccattggattatctgtccatcaaggtcaggaatgttttcgggttaccccactgtccccaactttgaatatgttcactgcctggaaaatgtttatctgaatataaggcatcaagccagaacttgcccaaaacttaacctaggactcaaacagctttgaaatcttatctgtgtagagtgggaacggcatgtgtttgataaccatcagcatttgctgttttgcttagccatcaacaatccgtttctatctcttcctcatagtattttcagctgtatttttgtacagcagtcattcacgttaggtgttaggttacactgaaatctctgacaaccagttctgtgctactgaaggcttttagcagcaggattaaaaaaatagttgattgcacattcgaagtctcactgctcacactgtttatgtaattcttggagtccagttagatcatctgatttttaaaatgttgcctgaattacaaaggagttcaggaatgtgttatcaaagaattaggaaattaacattgaaatttattgagcaacatagctaataggttgtcttgctttttaagccttcttgttttctaggaggagcctgaagtccgtggacaagttgaactgtagctggtatttaggaattggtaaagacagaggtgtggat

SEQ ID NO: 28531 - DNA, 1030 bp, Homo sapiens
tgtttgttttgagacggagtctcgctctgttgccaggctggagtgcagtggcccgatattggctcactgcatccttcaagcaattctcctccctcagcctcctgagtagctgggactacaggtgtgtgccaccacgtccagctaatttctgtatttttaatagagacgaggtttcatcatgttggccaggatggtcttgatctcttgacctcgtgatctgcctgcctcggcctcctaaagtgctgggatacaggcgtgagccactgagccctgttgaaaattcttattaataagatgtttctcatagaatgtttcaaaaaattgtgactggtttcaaaatcagatgatttgcaagaattagccatagtataaacacatagttctcaaaccgttttctgggagtgggcccagagatctatttaacaaaaccttgagtagagtctggtgcaagttaaaattggagaaccactaatgtaaccttaccttatctgtggaccacattttgagctttggaagaaataaccctttctatccttcacaaggtaacagatgatttttttgcacaattatttgataatgagcttatatttgagattaaggtatgcacacgataatgtacattctcactctaggtctggggaccttgattctttgactcttctgtccttttctctccagttacttggttttgtgcattaacaaacttttcaatttacttatttttttttacttatttacttatttctcatcccttacgtaatgttgcatcattgttttttgtagcctctgcagttcaagatactaatcacccctttctaccacattaaaatacagactctacctaaaatcatgtatgggagtaacttgatatatacgaaagtgtaaccgtgtcacaattccccgccccaccccgccagtctacataaaactgcaaacactttattgcttaccaagaaagtagacaataatatcgaagaaagccctccttttcctcttctttgaccaacaagggagcagttcctgacaaatg

SEQ ID NO: 28532 - DNA, 1033 bp, Homo sapiens
tgcctcagcctcccgagtacctgggattacaggtgtgagccaccacgcctggctcattttttgtatttttagtagaagcagggtttcaccatgttggccaggctggtctcgaattcctgacctcaagtgatctgcccactgcaggcatgagccgctgcatgcagctggtacagaaattttttagatcagtcatttagaattttatgtacatatcccttgatctaggaattctagaaactaattagttcatagtatattgtataaatgcgcacagatgaggatattatgagagcattatttgtatcaactaagcaagcctttaaaaaactcttatacagtagaatattatgctgatacattaaaagtgggcataaccatactgatgtatagaaatatctaaaatcataccgatataagtgaaaacattcagaatgcaggcataatcacagattaaacagtaatttatataaaaaacagaaaatttatatgtgtattatgtcagtagcagattcaagtgaatctgacaaaatctgactctgggcaatgagaacattggaatggaggagaaggtagtacatatttactttgtatattatcaccttttgtactatttgagtctttttaactgtacgcagatactttagagcaggggtccccaacacccagccatggacaggtactggtccatggcctgctaggaaccgggccacacagcaggaggtgagtggcaggcaggtgagccagtgagcattactgcctgagtgctgcttcctggcagtagattctcacaggagcacaaaacctattgtgaactaaacatgggagggatccaggttgcctggtccagtccttgtgagaatctaactaatgtctgatgatctgaggtggaagagtttcatcccaaaaccatcccatcccatccagtctcatgccatcccacccccaacaccccatggataaatggtcttccacaaaaccagtccctggtgccaaaaaggttagagatcactgccttagaggctgctccctcttg

SEQ ID NO: 28533 - DNA, 1061 bp, Homo sapiens
agcttttggggtacaagtggtttcttgttacttagttgaattacgtagtggtgaattctgagattttagtgcacttaagtagggtaccttgtacctaatgtctagtttttcttttaatccctagtcccctattaccctcctcctcgtgagtctctaaagtccaatatgtccctctgtgtgcctttgcttattcctaacttagttcccacttataagagagaacatacggtttttggttttccaattcctgaattactttacttagaataatggcctccagctctatccaagttgttgcaaaagacattattttgttccttgtaatggctgagtagtagtccctgatatatatatgccacatcttctttatcctctcattagtcagtggccacttaggttggttctgcatctttgcatttgtgaattgtggtcctgtaaacatatgtgtacaagtgtctttttcatacaatgacttcttttcctccgggtagatacccagtattaagattgctggatcaaatggtagatctacttttaactctttaggaaatctccataatgttttccatagaggtggtactagtttacattctgagagaataatttttgtaaaattatgtttaagctagatttggaattgggaaagaattacattctttataggaagcttttgaaaaatatatttaaaaatatataaaaatatgcataatcctaccacccacaaatgtctgtattattatgtcatttctaaaccatttttgagattatgctatagattacgttttagatcctacattttatttcttaacattaaatctcatactattttaagttctttgtacatgtaatgtttactgaatgggtaaatctgtttagggaaactggagctatgtagttgtggacttgtgcttttgttttgttttgttttgtttgtttgtacatttgctttttagaaatgtctattcagatccttggcccatttttttttttttttttttttttgagatggagtcttgctctgtcgcccagactggagtgcagtggcgcgatctcggctcact

SEQ ID NO: 28534 - DNA, 1049 bp, Homo sapiens
aatctaattgaggtcattatgattagccttgtatcttgctagtattttctcaatcttattttgaatgttttgtgtcaagtgttaaatcctcttataccacagaatccagaaaatttaaatgcaacagaagtaaaacgaatataaaaattctatggttgttgtggaggggcgttcttggctaacccatagggtgtttgaatgtaaaggcagcttacagaactgctgctagttgaattgtggagggtttcacttttaagagtacatttgagacaaaattgcaattttggaatcacttattcctgcttgttcagtgaaataggagaggggggaattcctgagggaagctgggagatttccaggtgatgatagagtagccatgtgagtatttggctgaaacagagtagaagccacctctgtctgttggacagaggtggccttaacactgagtatcaatcagcatggccattagagctgtccaggacaaacataatgaatgttgtggtggcagagagggtatacttaaatgaacaaaattggaggctgactttccttgtttcttggtagttcctttcttcgtatttgctatttggatatttcacttcacttttgtgagctagactcaaaggttaaatttatatcattgtgaattttctgggtcatattgtagggacacagatgggaagcatcccttcagtttattgagagtatttcttatgcgcatgtgtttttaattgtatttattgatttaataaatagccgatgagatgagaaaaaaatattagtgtcttgttgttgcagagaaaaagacattggatgcattcttagaatttattatcacatgcgaagttatttagatttacaaagcaatctgacatgttgacttcattgctcgtttgctcatttctatcagaggttgaacacaaagccaagcctaagcccgtgattcttctgtgtgcagatgagggggaaggtttaatgcagaatgtttagctgaatatttggattgtgcattccccttttatgtctctactgcaagttttctcagggca

SEQ ID NO: 28535 - DNA, 1083 bp, Homo sapiens
gtttagtttttccttgtctgtgtgctcgttatttcacagtaaaattagtgaggcaacataaattttatttttaagagaaagtaaagaaaatggctttatccattaaaggtttattcatcttaaaaaaggacttgttatatctactcctactattggatgaattttcaaaagcatattgatactgtgtttggttttgtttgttttcgggacaagtcctcactctgtcacccaggctgaagtgcagtggtgtgatctgtagccgtggcctcctgggctgaagccatcttcctgccccagcctccagagtagctgggactacaggcatgtgccaccacatctgactaatttcttaaatgttttgtagagatggggtccccactatgttgcccaggctgatcttgaactcctgggctcaagcgatcctcctgcctcgaccttccaaagtgctagattacaggtgtgagctattgtgcctggccaatgttgtttttataaatatcattactcagttattttgtttataattgaattgataggctcatagaataaagatggataagcactgtttcttaactgtatttattgatttttttatctttcaaaaaaaaaatcctcatctacttcaaagattaagcctttaaaaccgatgcaaagtttttgaagtcttagcttaagtcttcagagactaacattaaaacccatcatatgaaaagtgatatgtagtagcaaatattctccatcctgatgctctcaattgcttattatggtttaacacaaatataattttgtcattacagtaaattagtttgaggatataactgaagagtacctaagaaactcccatagaaatgtgaaaatatgcagactaattattctaagaataattaatcatagatacttacatattaaattgattagcaatttaaaattaaagccaaatttctgtggaaattagcttattttcatacacaaagaaacctagattcttaggggtacaaccaagaaagggccactccttcatttcacaaatattttcgaggtccttgcccccaagagggtagacagaataaaaaggaggaagga

SEQ ID NO: 28536 - DNA, 1062 bp, Homo sapiens
ctaaactatcagtgagaagtgcattaaattcagtagaaatgtacattgtttctgcaaattgtattaccttgagaatcttacaaagcatctttcattaatacatttcttttaaaatctctatcaattacaaatgtaaagataaacctgtacagatgcattttaaatttaaagcttccagaatgtaaggtttagttcgactgcatacctcattacctccccttccctcctccctccccttactcccaggaagtttgcagggtaaataaaacatgcacatgataataaaacaaagtggaatgtactaaaataccaaaaggaaaatacagattaggtatactgagtaaatatgttacagagaaaacttcctgtatttaaaaagtaaggaacaatgggatgagatcatagataatcctggagcatttcctggtagtaaatttccagccaggtttatatcccaggtctggggattggaggttaagtttctgcatatacaatatttgtttacattcctctctgcctctaccagacagacagacagacacacacacacacacacacacacaccctctgtctctttctctctctttctctctctctctctctctctctctctctctctcacttgagtgacagatgctggtgcagggtattctcaacaggagtagggaatttgaaataaggagttgagaggtcaaaggtaaggggctgaatgcaggaccagagagcttcagtagcatcttgatgggcagagtatgagatgaacagtggcaacgaggaggatagggaaaaatcacattttctgtttgtgttttgtttttgtctggtggttttcaacctctctctgtttcacttgactatgcttgattatgaaatcttttttttttctttttttaatttaaagatctcaactggctttgttgtgattctacattcaggcaacactattctgtaaaatagtataaatgttccgatgagttgaacagaggagattggctttgtagacagaaaagggctgaagaaaacagaaataaaaaaatcttttccttttcatagtgagagctc

SEQ ID NO: 28537 - DNA, 1051 bp, Homo sapiens
attgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaat

SEQ ID NO: 28538 - DNA, 1101 bp, Homo sapiens
aaatctaacacttcacatgcttgcaattgctcgctattactcttttatatgcaaagaaaagctttttggacagtcaagcgctcctctgtgcgactaggcttcacatacagctcatagttagatacattttatattcacacagtaaccagtagttttggaaaatagtctatgcatggtccaaaatacttgttactgggtaactagcagtagcaggtgcaaacagaataatagaagtggtagtctgagtattgattatttttatgtttgaaaacacatattgaactaggaaaagcatcatttcttttgctgttttgctaagggaatacatctggatctgagacagaaaatggaatttaatgtgattgagatgatcgtgtgtcattagcaccataggctatgaaaatattcccaagttgcagattcaatattcagcaagtgatttctgaagcacttactcttgccagatactaattattctaggctctgaagatacagcagtaaacaaagtgacaaacagctctactttcattgaccttagctggaggagacataggtcaatagataaataatttttaaaaatatctaatttcttcagatgtctatacgtagtactgaaaaatatgccaaagtgaagggtaaatgcatgaaatgcataatgtgtagagggtactgtgtttaattagcatggtcaggaaagtagagagaaaatgtttacacttatcattgcagcatctccttcctttgcttgtatgtaacactagacatgtgtccttttttcaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaagtaagttttaaaacacctatttgcagaccttataatttaaatgggcctttcaacaggtctgggaaaaaaatatgtctcataaaagattaatgtgtttttaagctaaataatctaattagccaatgaatcagagatttatgcctgt

SEQ ID NO: 28539 - DNA, 1048 bp, Homo sapiens
gaagggaccctattatgaaattacttaaaaaggcaaaaatgtggacaaaagttgactcgtcatttcacccttggtgcttaattagcatttccatcctagcattcctcacaggtttatgggtattaaagatatttgtgtctttccccatttttttgtccagatgatggctctttgaagacttatatgtcactcaccataaagcctttctcaatctatcgtatcttatgggcactaagaattcagaaaaattctctaagtcatttaaaaaaattccccttttatgatggtattagtaatatcattacccaatttcagaattgcatgcttcatttatggcctgtcccaccaaatccagaattctagtagaaaggaatgcagagactctactcacctctagtccaaaaactaattaattctgtgttcccaagttagtctgcacattggaacaatgtgagaagtttcaaaagtgctcttgactgtgcccgaccctggaagatggggatttaattggtctgaggtgtgggtaggctctgaaagatttaaaagatccccacgtgattctaatgtggaagcaatctgagaaatattaaagaattatgtgagattaagtgaaggcatatttttgtcagtttgtgtttaaacagatcccattttgtgccagaaagaatggaaagtagatttgtaaagatgataggatctgataaggatgaaaatggttgtataaatcttgaaagttagtataaatgttttaaatgaaggcaggttgctagcatcatcctaattttgaacacctcaattaaagtgtatacaatactgtagtataattgcaattttctcataaaaaataatttttaaacccaattttaaactaatccattaaaactgtgtgttaagagaagactttttagagaacttctgtttgtgtatttatttgttaagtgtttactcatttttttctccctttttttaaccaccttcccccacttcctgtgaacattcctacttccagtaagggttacactgacgtggtgaggattcctgaaggggc

SEQ ID NO: 28540 - DNA, 1032 bp, Homo sapiens
gaaagcaaatttattaagaaagtaaaggaataaaagaagggctacttcacaggtggagcagtggcaggggctctttgactgaatatatttatagttatttcttgattatatgctaaacaagaggtggagtactcatgagtgttctgggaaaggggcagggatttcccagaactgagggttcctcccctttttgaccatataggataacttctgggcattgccaaggcatttgtaaactctcatggtgctggtgggagtgtcttttagcatgctaatgcagtataattagcatataatgagcagtgactacaaccatagatcacttttgttgccatcttggttttggtgggttttggctggcttctttactgcaacatgttttgtcagcagggtcttcgtgatctgcatcttgtgccaacctcctatctcatcctgtgaataagaatgcctaaccacctaggaatgcagcccagtaggtattagctttattttatccagcccctattcaggatggagtgactctggtttgaatgcctctgacaagagtaagttgacatactgagaacaattaaagtctacacagggaatggcaagaccacactagatctctttacacacagatctaccaattggcaactagaattataacttgtataaaggaaatgaaaaaatttctctttgaagaaaccaactagtttaacaggctccttggggttccctagcaggacagccaatccagatcaccttctaggaaaatccacccgtgaacagagtttgcaatcgttttgtggcacgtcactcccacttgtaaatataagttcaaaaaatgaaagaaacacaataatacataaagcctcaagaaaagaaagttgctgggagggtagatttatgggccttcctatggagaacatccctcagtcagatacagtatttattcctggaaaacatttaggtgatggagacgcaactactttatacaaagcatgtttcaatattttaattttcataatcctatcaacatttacattttat

SEQ ID NO: 28541 - DNA, 1032 bp, Homo sapiens
ctttattttaacaccagtttaagatattgtggtagcagcctgaaaagacagatatggattcctcttcaatctttttatggtggtataagactttttctttgaaaactgtgatagaaaattttagcctttttattcacaaacatatgcataatgtttagctccactaatttaagtttttttaagttaatttttaatgcataatcctggtttagaaattcaaacatcgcaaagatgcttattgcaaatgcaccatttctctatcccaccactttcttgctcccagatctttcccaggggcaacatttaaatctatctttctcctagcatttgtgtatcactagtgttataaataatatgtgcatcctgccatcttataattcatgaatcttagggaatatctacttactggatattattgtggtggaggattaaactatctgtgccttatgatttcttccttcctttcaatatggttatattataatttgttttattcaagatttattggacttctttatctgaggatttatgtctttcaataatctggtaaaatttttagccgttatcttttttaatgtttccccttccctattctccctataatttacttctagagctcagaatagacaaatattgggctttcttactctttcctccatgtctgttaacctttctctcatattgtccatacactctttttcagatatgtcatccaactcactaatttctaactttgtgtaatctgctgctttatatttccactgagtttgaaattttagttttataattttatttctagaaattctttattttaaaaagtctgccttgtcattttttgtagttttgttttgatctttctctgatttccttacacatgttaacataggtactctatgttctttatctgataattccaatacctggagcctttatgggtctggtttggtgtttcagctgattttcactgaaggtgatacatttattggattacttctgatatttatttatttatttatttatttatttatttat

SEQ ID NO: 28542 - DNA, 1049 bp, Homo sapiens
acaccaattattcttagttttggtcatttagcataatctgaaacttcttggaggctttgttctttaaaaaaattttttgtctttgtcagattgagttaattcaaaagccctgtctttgagctctgaaattctttcttctccttgttctattctattgctgagactttccagtgcattttacatttctctaagtgtgtccttgatttccagaaagtgtgattgttttttatttatgctatctgtttcactggagatttttccattcatatcctatatctttttttttttttttctttaagttggacttcacctttctctggtgcctccttgattggcttaatagtcaaccttctgttgttttttttttttttttcctggcaattcagaggtttcttcttggtttaaatccattgctggtgagctagtgtgatcttttggggatgttaaataaccttgttttgttgtgttaccagaaccgtttttctggttccttctcatttgggtagactatgtcagagtgaagatctgggactcaagggctgctgttcagtttctttttcccacagggtgctcccttgatgtggtgctctcctctttcccctaggggtgggcttcctgagaactgaactgcagtgattgttgtttcttttttggatctaaccacccagaagagctactgtgctccaagctggtactggggagtgttggcaaagagtcctgtgatgtgacccatcttcaggtctcctagtcatggatactagcttctgctcccatggaggtagcaggggagtgaagtggattctgtgagggttcttggttgtatttttgttacgtgtgctggttggcctccagccaggagatggtgctttcaagagtgcatcagctgtggtagtagaggaaggaacaggtggtgggtggggccatagagctcccaagagattatgtcctttgtctttgacgaccagagtgggtagggaggacgttcaggtgggagcaggtttaggcatttctgaggtcagactctccttgggcagggcttgctgtggctg

SEQ ID NO: 28543 - DNA, 1069 bp, Homo sapiens
atcaagcattcttattttgctgtttccaggaatagcttacaattttaatttatgacctttagaaatattattttgtccaggcactgaacacaaagtgccatatcatgagctgctaaggtaggaagaatcagcagattgtttggattgtgaagagacaacttttatatgcatctctccatgcggcaatggccaatgctttgtagagctgagagaactcatagtattgtgactagaggtggcagtctgagagcttacagcaatggttggctgattagcagtaagtacttatgaggtgtgaaagggaagcagtgagagatttgatactgacaccattaagggacttcagtatgaaatcagcacaaaataacataatcttagcatgtcatgcaaggtctttcattatttggtccttgtttgcatctccagtctcattttgcactgttctccctgcctccctctactccagccctgccagatgtgcttcagtttctcaatgctaaactgcttcccatcttagggccttggcattggctgtgcctctgtgtggaaggttcttctagatcttcatatacatgtaaccttcctcagcaaggctattccagaccacccaattcaaattagccaccaagtcgctctctgacctattgccttgttgtacttcactgtctggcttctatgtctaagtcttatttttcttgtttatttatttatttttttcccttaccaactaattgtctgtggccagctcactggagcctaagctctatcatagcaagactttatatactttgtatcactgtgcctcagtgccttaaaaagtgcttggtacctgatggtttcttatttaatattggtgaagtaactgagcaagaatgacaattatttgattgcctgccacgatggttagatccaatcctgagtgatgtgttgagttttttgagttggagagagagaaactggaatccatccacaaatgagaaactagaatagcaaagggtatacaaatggtacttgtagggtaggaactggcaatattcaatctggaaaatatttaaatgactaggaaata

SEQ ID NO: 28544 - DNA, 1026 bp, Homo sapiens
aaggaattctaggctgccaaacctctgtttttaggtatctacaataaccctattgcagaaaacaactaacttaatgtattaacctaatgtgcagaaccacttttctaaaattgggtgctttatgctaaaactatgaattccaagcagatttcattgacttgtttcagtaagtctgaacctgtagccaggtttttgtttggacagcactgaaaatgagacgttaagagaaatacattaaaatgtgtgttttatttttttcgagacagtagaaactctgtcctggcaagttccacgggagagaacatctgctcagaaacaattcttatgctttccttgacttagagtgctggtgaaaaaatagctttatggatctctaacttttgtgcctttctaccaccaaaaaaagatactacttgtcagaggttatccttcagtatccttcccttccaaagtgagtaactaagcagagaaagaaagaaaatgctggagataaccatgaaagctgttagtagacttcaacattttttagactctgtgcaggcagacagtatacttagttgcacaaaacactgtgctgtttttgaaattaacaaattaatggcctataaggatatggcccacgatccataacttactaaatgctctttcattgtacgaacctgttctgatcggccttcaagaagacagtgagaccagtgcaatgttctgtgactcaaatccacatgttttctcagagttttatcagatcttcctcttcatggttgctgtactttctgctcatttgacaattgtcacatcatttttgttagtgactttcaaataccattggtcaacaataattccagttggtaaacacagtttgcatataggttagcgtttgaagttgttttatttcattagtctttttgacttaaagctaatgacttcaagggataaaaagatagtttacagttttttcttttgctaatcatagagccagatacatttttcatgatcatttaggcttacataatttctcaataatat

SEQ ID NO: 28545 - DNA, 1013 bp, Homo sapiens
aggcttcatcttaacttgaagtgggttgtatttattcctctgctacctcatcaggagccccactgaatcagaattctgttctatgcattttcttagggccctcaagccaactttcccactctattggtttcgggcatttttaatatcctttgaagtagcctctaaccaaactgagctactggaactctagaggctccagttattcttttattagtatcctagttacaaaattgtttgggttttggatggtaggactttaatgttgtttctcttttaggtcctattattttggtgttagagccaaataccatacagagattagttgagatctgtccctacaacctatatttgacatgcacacttgagttttggagtcataaacataatttcaagcatcccacaacttctaggatttctgcacacataccaagaaatggcttgtcttaattcacagaactaccattcaagaagtccatgtccccatttattcaaaatttgaggtattttaagaattaattttattcctttgcattttttctttttgcctttttcctctcaatatccatgttatacagttaatagccctagggtaaagagctgtttcaatccaagtctatctaggaagcttggcccaagataccattatttatggttagaaaagatcattgttgtgctaagttatttttcctggttggcagccttaaaggtttgggttgctggctgctttttggggattatatcataagtatggatgagttgaagtacaaacatttaaaaaactccagtattctttgtccaaacaaaagaataaccttccaagttatgaggatatgaatctcaagtgttctgacttccagaggtttttttgttttgtcttttctctgcagttacaattttcatggtgttgttgtagtctgccaatgtcaaccaatttgtgttttctggtaggataattgagttgagatttttctcctttgacatgaagtcagaatattaaagttacaaactcatgg

SEQ ID NO: 28546 - DNA, 1065 bp, Homo sapiens
cttggctccatcttaaagaattttaaaagtcattttttccagaattatattgttgtaggactctctccttagttccactaaagatgtgggtccttgccacatggccataaaaaattaggctcacagacaatttgaagggtgagaataatggaatttattgggcaaaagggggaaaaaggggaaatagggaccctccacaaagccagggtccgctagtgtgcttcctgcctcacagattgaatcctgggtaccacccaggaagaggaggggccaggctcctcgctgctgcaaaggcgcgaacttctgtggctacaccccagtgcatgctcctcccagtgtgcaggccagttggagtttctctcgggaccccctcccacctggctgtctctgtattttcaggattttgatctttcaggatttcaagatgatgatatttgggattgtgtcttttgtgattatgatcagctcctgttgaagtcctaaccccctggtacctcagaaagtgactgtatttggaaatagggtctttgaaggggtaattaaattaaaatgaggtcctattgtgggccctaatccaagctgactggtgtcttcacaaaatgaggagattagaacgtagacacacacagagggactaccatgtgtagacacaggaatctaccagctaaagacagaggcctcaggagaaatcaaccttgttgacaccttgatatcaggatttcagcctccagaattgttaaacaataaatttctgtagttgaagccacccagtctgtggtagtttgttatggcagccctaaaaaccatacaccagggcagtttgcttcaaattctaccttgctagcttttgtactttatctgctgctgagctttggctctgactccgaaggcccagacagtggaattggggttaagcatgaaggattctgtgttggagtaaattccacggggcagggtaatgcccagctggacttgcaagagaaagtggcccaagagaagaaagaacttcataattccaaatgagaaacttcctgtagcagctccaggcccttctaagaagagcta

SEQ ID NO: 28547 - DNA, 1035 bp, Homo sapiens
gagtagctgagactataggcgcccgccaccacgcccggctaattttttgtatttttagtagagacggggtttcaccgtgttagctaggatggccttgatctccaatctcctgacctcgtgatcctcccgcctcagccttccaaagtgctaggattacaggcgtgagccactgcgtccggccctgaatcttgaaaaagtaattactccaagaaccaggaagagataaatgttccaggcagagagaagaaaatacaaaaaaaaatagaggagggaaattgaacatttgggaaatgcaagtataactacattgtagagtgtgtcaaggacagttgaagaaagaggatagtgtagtgaggcagggaccagattatggctggttttgagaaccacattaagggcttagaacttcaaccataaatgatggagggaggctttaaagaattttaagagcttgtaatgttgatgacctcttagtgctatactaagattttctgtaccttccttttgttgtttttctcatagtacttagagcattcaaagatgatgtgtatgttagttatatagatattgcacacagacttataagacattcctgcaaattaggtcaaagcaaattctacatgttgggtagtctactatttatggcaagtatgtaccgtaaccattaaaagaaacaagagaaaacggaaagtaagcctcagagtgtacttggtatgaatgcccagtgtgcttgaggaatggaattgtccaagaaactgtaggccaggccaataattacaaacaggtacccttcctttgacaatgtacttttgaaactgcctctgtaattacattgtaatggttaagcagatatatttggtaatcatttaatgctttgtttgtactatctactactcatacatttgtaaataaatttttaaatgggtacattttcctggaaatactttgaaaaaaaattctctcttgattgtgtgggtaaagaagtgaaaaatccatgttgaattttaattcagctaaacactgattaagaaagac

SEQ ID NO: 28548 - DNA, 1047 bp, Homo sapiens
aaattatagtagtaattgtattagaggtaaagcatatatacagttatgaacagtgccctgtgtccaaaaaaatgcattacataattttcaaaaatgtaatgtatttattaacatacttatccatagtcaggttccacaggagctaattctgaatatggttcactcaaggccactctgcccaggaagttgggcagaagggatcaattcccttaagaggcattgatctgttaggttctttcttgcctatctagacttgagcagactccagaagaataaagccaataatttctaggaattcaatcttgtaaacttctgggtcaggtaaagatagcaggttgcttttgatagtttttggcctcatttgaattctaagcttatgaaaacactgtagttgtgaaatactttagcatgaagccgaggctggtgaaggaagggtaccttttctctcccacaaaaatcctctccaactagatttgatatattttgcatggattaattcataaacaatcactattgcccatatggaagctatgatagccaacggactgtaaagtaggctgaaatctgcagttggccctcaggttttgacccactgtcatttgaattcctgctttatgtcagctctcatagggaataagacattccaaagggttacccacacaataaaggactttgtctatgttcatgtgttttggccagtttgaaaatcttattgcgtggtctgggctacacaaatagacaaaagtaaatagagaaacctgcttcatggaatagctttggaaactgtggttgctaagatatagataggctttaagtagagagaatttccattataaatatactaaaaggatcagaaaagtgaatttacatgaaaaacatacactgggtgtttggaaagtgctttttctatagacggtgtgtaaaacgcatatcaagggaactctttgggggaagacaagaatttacacaaggtgttgggatgaaaaatattgctaacttgttttaattattggctgaaacttgatggaaagaggaaaaaatcctcca

SEQ ID NO: 28549 - DNA, 1051 bp, Homo sapiens
atatttggaacgcctctcagaatttccgcttcctaaagagcctgctgctctagcattttgcccacatgctaaaaggcatcagaatagattttgataaaacagaatatttttaggcattgtaatcagcctcactctgccaaattcctggcctttggtatgtgctgctgagtaatgtcagaccctcacacgtacacacactgacatttacaaggcacgaggtaggctccgccaagttcagaacaaagcccccctgttgattggttcaccagaactttctcagatgcatttattgtttgctactggaggaactgacagtctgctggtaccgattgaatttccattcttttcttcacttccattcttctcttcactcggggaagtgaagttgtggactcatgaggttatatactcaactgtgcgagggggcccttgggcctctctggcattgacactgatggaagctacacataggagtggggctgcattagatctttctggtatgagatttgtagaaatgaaaatgaacagggcttcactccaaacacgtactgaatgatcttagaaagttccttcctgaaaaaatacttttacctaaaaagacaaaaacagatgaaaagagagcattattttattattgcacgccatgaaaaagccagagtatatttagtaacctttggaattccactgcctttttagatggaggagcatcccaaaaaaggagacaggagggcattgcgtgtgcacgtgtgtttgaaaggaccaaatctctatctagacaaaaatagtagataggtaggttatagaaaagaatttcataaaactaagcagaataaattctttttccgaaatagtgctgttttgtgaaaggtgtttcttttcacattactgtatatggctaactctcagatttgtaaatggctacccttagagatgaagttactgctgaggattcaaatcacctgccttaaaagctgaggtaggatttatgatgtactgggcattattttctctttaggggcatcctttcttcaatgatgattgagaatgtcaa

SEQ ID NO: 28550 - DNA, 1091 bp, Homo sapiens
gtacttgtgcttcatttcttcattccaaaacaattgtcagtatgaatttcctgaggaatatgctacagtcattttggaagaaattctgttagcagtacagtgttgataactgcaactgtaacaaggacagaaattatttgtgagtatgcataactcgttgcccttctcttgcccatgaaagacaattctggcattgctctaaagttctgcctcccctaacccaacccttataattcagacaattactctaattggggtacccaagaaatagaaatggatgattcacatttgaataagtgagaagagggaagagtagtagaggtagaaagaaatgaggtaaggaacagaaaatctatgtgggtgaaggtggggtgtaaacgggaggagagagttttgggaagcagctactattaatagctttatggaggagcctaatagaggtagtgatgagagagaatttaaaatgtgtttttctgggcattaagaatatatttccttctttggcattttcttaagaagctgaaaaagaaaaccttggaagtttctttcagtactttctggctgctaagctatgattctttgactgtagcagtagattgagattggaccacattgggctccagactttatttgggtttcacaatttaattgagtgcagtaaaataaaaacttattatttcaaaaaactgactatgtatacaaaggccatttcttaagattctattattttgcatgatcacaaatttgtgatcgaagatggttagtctccaaagcttgaggttttaggatgtgtatgttaatcccttgggatcagcacccgtatatattcaggttaattgcttaggaaccaacagaacatgaagtgtatgtgaaatcgagggaaatgattttttccaagacttctgctgcctgggtttttgagaagccagttgcttccctttgggaatgacattagtattctgaattttatattctgatgagtacagttgtgtgcaaccagggctaacttcacaggtgcctgacccattcttagaagggccccagtgattggtttaatgctgtgctgctgccatcttgaagttcttaaaaag

SEQ ID NO: 28551 - DNA, 1066 bp, Homo sapiens
ttcctccttccaaattcctcaaactagggaagagaaactagaatttactaagtatctattgaaagtcagtttctttcacataggtcaactcatttaaatatttccagcaaattacccagttttgctattatctccacttttacagataaaggaatagaggctcagagaggttaagaatcccgcagtggggcagcggagattcagattgaggttgccgattctggagcccacagcctctccctctgtggtgcagtgtaattagtgctagacaatggaataggttttggaaggtgtcagtgaaccaaatggagggggccggggtcgggtgatggtgggtggagtggaaggttggcaggaaaaatcttcaaaaaaaactgaacaacagagtaagtccaaagtcagacaaaaactgcatttcaggcatttattgtttatgctttactatctttattaagagtcacagaagtataaatataagaaatgaaaacatttggtttatggaaaagtaagaagaggaaaggaatacactgataggtaggggagaatgctcagacaactgggatacctttggaattcagcccttgatgtacgtgtcgagaaaccactttacttgtgtatttcacataggaggtaaaacaaaaacatatgattgcttcagattccctgcatttcagcttccccacatttttataagacaaagaaaaccccctatggaagacattcaaaaaataagagccagaaatatagtaacccaaaagttacacactttttgtatgggtgaagggaaagcttggaaggtttgctgaaaaatcaactcacaaaaatttagattaataaaagaaaaggcacacagatttattactattatgtgcatgtagggaatctcagagtgattgtccaatattccaatgggatacaggtgtttatatactctatttcttagggggaatggagatggggaagtgtggataattttagggggataataaatgatttttaggggaaatcagtgggcttgaagaacatacagtggtctcttgggcccacagagcagtcaaggttttgt

SEQ ID NO: 28552 - DNA, 1078 bp, Homo sapiens
aaaggaaataaaatgaagatattttcttagtacaagtgtatgcatgcaaaaacatgtttttaacaaaaggaggaaatactcatgacaattacagtccttctttctgcagttggtcacatggtcgtagctggtactgatgactactttctttttttttttttgagacggagtctcgctctgtcgcccaggccggactgcggactgcagtggcgcaatctcagctcactgcaagctccgcttcccgggttcacgccattctcctgcctcagcctcccgagtagctgggactacaggcgcccgccaccgcgccaggctaattttttgtatttttagtagagacggggtttcaccttgttagccaggatggtcttgatctcctgacctcatgatccacccgcctcggcctcccaaagtgctgggattacaggcatgacccaccgcgcccggcgactactttcttctactactcattctgtattccttttgccttcagcaagcatctcagcaggtcgtggtttttttcctagtggagtgacccaaacctttattcctgaagggtctgggtcatttgtagtcctgcctggattgggctcttgtagtttcctactgaccttaatcacagggcatggtaatactaagagacaccctaattaatctcctgtattctatgcaaactcttccttacctcctttgtgaagtagtagactgatttcatcttgaaagtccaggtcagtaaccccaaccaacactgtaactcccttcttagtgtgttgacttaaaggtaggaggagcccaaagtgtccaggtggcaatcttaacttccagtttaatggaattgttgtgtctcctggtggcagcattcctccctctgcaattaagacctctaggccagcacaacgtaatgtggcgggaacaggaagcaaaaaatttggtagctgattactaaaggtgatggtgagtggtgccacttccacttccaccccttgattcctggacctgtgaatcctggctgtgagagaaacagtaccgtatattggacactgattcacagcatacatggccttctggagaactttgc

SEQ ID NO: 28553 - DNA, 1030 bp, Homo sapiens
gaggtcttacatagggtggaatattttccactgagagacgcaatcatgatttaattgaactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctccagtgttcaaccttgattaattttacatcatagtatttaagttatgggatatcaaggagagagtaaacatcacatgaagactttaccacctcttctgggaaacgggttaaagtgtttctggtggaatgctggattgttaatcgtgttagatggaattatgaccttgttgttgtctttatgtggcagttaagtatggtttaaagagatgtttatgggtgccaagttgacaagggtaaacttgtgatggttaattttatatgtcaacttgaataggccacagggtgccaaatatctgtttaaacattattctgaagtgtcttgagtgtgtttacagacaagatttgcatttgaactgggggactcagtaaaggagatagccatccccaaggtgggtggacatcatccagtttgttgagggcgt

SEQ ID NO: 28554 - DNA, 1054 bp, Homo sapiens
tgggatttttttttcctttcttgccgttgagttgtttgagttccttatatattccttatgttagccccttgttggatgaatagtttgcaaatattttctcccattctacagattgtctcttcactttgttgattgtttcttttgctgtgcagaaagcttttagtttaacatagtcctatttgcctgtttttgttgccttcgcttttgaagtcttagccataaaaatatttgcctagaccaatgtcctatagcgttccttgatgctttctagttgttttatatagtttcagttcttaggtttaagtctctaatccattttgagttgatctttttagatggtgagagatagaggtctgttttcacttttctacatatgaatattcagttttcctagcacaatttcttgaagaggatgtcctttccccaatatatgttcttggcatttttgttgaagactttgtcaattgcctgcaaatatgtggatttatttctgggttctctagttctgttccattggtctgtgtgtgtctgtttttatacaaataccatgctgttttgattccaatggttttgaatacttttgtatttcatcgggctctaattttttttctggcaagtggacgttcaaatgttgaaccctaagaggacttagggcctcagcaaatttccctgtttcaacaaatggtttagaattataggtggtggagtgacttttacaagatggtattaaaggtagagaatttgcagaaaccctgtatcagtcttgtttgtaagccctcagctgtaacacagttactagaagggggaatatatgctctgtggaagaaagttgaaacacctcttttgggcagccaccttcacatttagttaagggaaaggaaacaagcctgtagtttaacattgctcacagggtgaatctgtgcaaatccaaaactagtaagtagagtaataattttttgtgttactaattacaaattggcaatattatttctttaattttatcgagctcattagtcagatattattgttgtttttgttaccatgacttgattag

SEQ ID NO: 28555 - DNA, 1023 bp, Homo sapiens
ggggagactccataaagtaggtgggatttgtactgattttcaaagaatggatgggattttaagttaaaaaaaaaaggggggggtgggggaatatttatggctgggaaggtaacagcaaagcgtggaagtgaacatcatacaggcttaatggggaacagggaggataccagtcttcctagaacttcaggaggaggaggaggggggatagaattggagccatgataacgaagggatagtaatatggtacaagtaatattttggacagagagagtatttgatcttgctgttaatctttgctttaattttatggttttaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatggtaggacaaatatggcttttgttttctaatggggaatagtccatttctcctttgtgggggattgcatggggctcagcttatgtgttattggttaaaaataacaggacttactcattcaaatttttttttttcttttcttttcttttttctttttttttttgagactgagtctccctctgtcgtctaggctggagtgcagtggtgtgatcttggcttacaacatctgagttcaagtgattcttgtgcctcagcttcccaagtagttgggactacaggtgcatgccaccatgcctggctaaattttatatttttagtagagacggggtttcgctgtgttggccaggctggtctcgaactcctcacctcaggtgatctgtctgcctcagcctcccaaagtgctgggattacaggcgtgagccgctgcgcccagctcatttacatatcgtaatattgtaagcaccctaattgtttattaatcttcataccatgacttagaagatatttaatatttttagtt

SEQ ID NO: 28556 - DNA, 1050 bp, Homo sapiens
ttgcagcatttcagtcacatcttgaggcttcatgtctcattctagttctttgcctctttcctccacatctgcagttgcttcctacactaaagtcttgaacctctcaaagtcatccatgagggttggaatcagcttctcaactcctattaatgttgctattttagccttttcccatggttcatgaatgtcttaatggcatctaaaatggtgagttttttccagaaggttttcagtggactttgcccagatccatcagaggaatcactgtctatggctgctatagcttaatgaaatgtatttcttaaatattaagatttgaaagttaaaattactctgattcatgggctgcagaatggatgttgtgttagcaggcatgaaaacaacattaatttccttgtacatctccatcagaggtcttgggttacccaggtgcattgtcaatgagtagtaatatttctacttattgtagaatttttttctttttttccttcgtttttccaacagtgggcttaagatattgaataaaccacgctataaacgtgctgtaatttagtccttgttattccacttatagagcacaggcaaagtagatttagcataaggttaagaaccctgggatttttaaaatgagaaatgagcattggcttcaacttaaagttaccagctatattagcccctaacgagagtcagccagtcctttgaaacttggaagccaggcattgacttcttgctagctatgagagtcttagatgacatcttcttctaatatgtgactgttttacctccactgaaaatctgtttagtgtagccaccttcattattgatcttagctagatcttctgtataacatgctgcagcttctacatcagcacttgctgcttcaccttgtacttttgtattgtggagatggtttcttcttttaaacctcatgaaccaccctttgctagcgtcagtcttttcttgtgcagcttcctcacctctcagccttcatagaattaaagagaattagggccttgctctggattcggttttggattaagggaatgttgt

SEQ ID NO: 28557 - DNA, 1048 bp, Homo sapiens
atctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtattcctgttgtatatcttttcaaactatttgaataatagatgagtagaatgagcctgcttattgttttctggttgtttcttcactgtgagtgtcaattttaggacaagcaatatattcttgatcatgatttgggaagtatctagggctgctgggtagatgttcagcagtaccagggtgacaaatacttgtaattaaaaggtgaattcttttaatctatacatttaaaaagttggataagaacattttagttttgtattggttacatgggtacttcatttactttttaaaagttttagctgggcatgttggcgcatgcatgtagtcccagctactcaggaggctgaggtgagacattggcttgagcccatgagttctagactagcctgggcaacatacaaaaccccatctcaaacaaaaagttgttctagcagattgtttctaactctttttcttttttcaggtggacttgaaatggaattctcttcttaagattattgaaaaggtatcttagggatttttttttctttttttttttgtatttatgggaatagaaatattataaccgtagtcctatttacacaataaatatggtcagatagtcaggttctgtgttagagaacttcctcattattgtaactttcttcctataatgtgggaagatatttgttcttttcctttcctgtagtagtatttttctggttagtaatattagggaaaaatgaacaggctctggaaaatccagtgtttctttcctagaaggt

SEQ ID NO: 28558 - DNA, 1102 bp, Homo sapiens
tatccacagagcttcctttttaggaggactgatatattgggctctcactcatccatattttttggtccattttaaaattgcagtttggttatttttgagttgcaagtgtgctgtatttatcctgagtagaagtatgtgtcagataaaagtatgatgaatgatttcttccagtatatggcttgccttttaatttcattagtgtttttgaagagtagatgttttaattttgatgaagcttaattgatcatttttcttttatggttgtgctttttgatgtcttattttttatttttattatttgaatggccagttaatagattgatgtcttatctaagaaatctttgcccaagtttgcaaagattttctatattttattttagaagttttataggttagctccatgtagtggatttagaggttttttttgcatataaactgaaggtgagagtcaaaattaattttttggttatggagtattcagttgctgaaagactatcccatccttattctgacatctttgtcagaattcacttgaccgtatatgtacaactttaattttagactctgttctgtccactgatctgtatgtctatccttacacccaataccatgcacttgattatgaatgttttatattgtgttgaaaacttccaactttgttcttttcaaaattcttttggttatcttaggtcttttgcattctagaataatgttttacaatctgctcagtccttatggtttttgtttctttcatgaatgaatgcttgatttctaagcaaagcaaaattttcttgatttttctgatgttttatgatcaaagtttcttggcatagctagaagtttgctgtctttataaatgtcatgtcttttaaaatactttgctaactttgatttggtaatattttatataaaatatacataaaatattttgtggggttagatatgtatgtatttttaaatctcacaaaatattatactctcaatctttgtttacatttgcctatatatttgttgctttgtgtcagaaggtgtttttattttgccctcattcttttttttttttttttttttttgggacggattcttgctttgtcacccaggc

SEQ ID NO: 28559 - DNA, 1057 bp, Homo sapiens
aagtagactacttctaggaaaaggcattgataaatctgttttataacttctgttttaaatgctctagaatatacattttgaaaatgtttactttggaaatttcttttcagactcagaaaattaaactggaagagaattttaattcgccatcgagaagacattccttttgatggtacaaatgatgaaacggaaagacaaaggaaattttccatttttgaagaaaaagtgttcagtgttaatggagccaggggaaaccacatggactttggtcagctctatcagttcttaaacaccaaaggatgtggggatgttttccagatgttctttggtgtagaaggacaatgacatcaagagtagttgaaagtatcttgccactgttggccttttgatttttttttcccactttttcttgaaagattaagtaattttattttagttccattctagaatgttggggagtggggcacaagaaaaaatagtatagctgaaatgcatctgttaaaaatgtcatgattgaaagcagaactgagtttcaaattacaaccttaaaattgttgttagatatttcttcacatatcagctgcccattttgaaaaagaaattatccataaaggtaatgttggtgctccaatttgccagccattcccaacccccttctcccttacctgccttcactaaagaacccagaaaagctaattgctcccctttcagcctctgttgcaactaacaactctcagtggcctcaggacacagctttggccttgggaattctgggaaaacttttacttcctgattaaagatacatatgcagctaggccacctcctcccccccttactgccataaacaccaaagtgatgactggagctggaggagttatttgaaccacgacgaagggccaagagaaccacgaagatgccagttgccacattgttgagctgctgacccaacaccagccattgcctgtctctaaacatcttatgaaataaaaccagttttgtttaatttctaggctttttttttaaatagacggagtcttgctctgtcgcccgggctaga

SEQ ID NO: 28560 - DNA, 1028 bp, Homo sapiens
agttggtgagaagcacattcaacctctcaagtgttcactttccccacgagagagtgcacgctgcttattctttcaggactctatatgccatagggctggcaacaggaacaggcattctctgggccaggagccacttttcagacaactatttatgttctcatgtaaaagtccgtaacaggcatcacggcccttcagtagtactgtctcctatactcagcttcccaatctgtgcctccatattcactgaagaacttagtacttctccgtccatctatgattctcacaggactttaaatgccattccattttagtcaaccacacccaggactagagtctgggcttgtcatcactcagaattgttcaacttcataaaattttttttgagacagggtctcactccgtcacccaggctggagtgcagtggcatgatctcagctcaatgcaacctctgcctcctgggctcaagtgatcctcccgcctcagcctctggaatagctgggactacaggtgcacaccaccatgacctgctaaattaattttttgtagagatggggtttcagcatgttgcctgggctggtctcaaactcctgagctgaagggacataaatcttatttttagtcttagtccacaagtcttctatttattcaactctcatctcacctattctgtactctttaacctaacaggatctccaatgctcatattctcctcacctatgaagacttttggcttcattcctgatatggtttggctgtgtccctacccaaatctcatcttgagttgtagctcccacaattcccacatgtcatgggagggtacccgttgggacgcaactgaatcatgggagcaggtctttcccatccttattcttgatagtgaataagcctcatgagagctgatggtttcttaagggggagtttccctccacaagctcttgctttgcccgctgccatccatgtaagatgtgacgtgctcctccttgccttccgccatgactgtgaggcctccccagccatgtggaactgta

SEQ ID NO: 28561 - DNA, 1045 bp, Homo sapiens
ggctggtatattggcaccaagtactaggtaactgaatggctaagaccagttctctgcctttggttcttcccagtacatggaaggacctcccctccctaaaagtagctcattccctcagtgatttctgcctcgagcagaagggtgtgctgtatgtccaccactccaccccttatcccaggagtcactgccttggtttatgactttattttagaaagggatatttttggtatatggagaatcaacagtttgaccgtaatgttattttcaggagattgctgatgagtttggtattcaattccttagggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaaggtatgtagacttcaaaccttaaaagtaataattggggttgcactttcagattgtttgagttagctcttaaaccagtaagtacttcttaaaaaactgaacattgcaggatcttacctatttttttatgccagatttatagtcttcaaatatctaattcaactactgaacattaaactggaaatataaagatggtggccgtattatttataatctgacacacagcccttctagtagagcttatacattcagcaagtgaaagaatatgagaatgtgagtattttgtgtgctcttcacgaaaataaagttgacattctgtagcatcctaaaacaagataagctaatgtaatttgaaaatggtaagtatgtttctaaaaatacatgttagaaagtttgaagtttgtgtttatagtcaatagtggctgacttcatctctagaattcttgaaatccaagttgttgatagttttaaaattttgtagcatgaggggggtctggtcatttggtccatattttattttattgtattttattctttttttttttttttttttttttttttagagtcttgctttgtcacccaggcttgagtccagtggtacaatctt

SEQ ID NO: 28562 - DNA, 1052 bp, Homo sapiens
aggctgagataatagcttccaatttgggtttttttcactaatacagttttggaaaactcgtgtatcacaaaacattatttgtcattccagtgctagtagttttttacagaacactgagctatttctttcaataaataggtactgaaggaactgcagtgaaagacaaaagtcccatttgtcgtagagtttatgtccttctaaggcagaaataatgattaaataaaaggagaattccaaataatgatgaaagaaactgcactatagtagaggatgacaggaggtaaaaatgtctgtaaaagaaggatcaggaatagacagaacacttagacgtttagggaagaactcttagctcagtgcttagtgagagaagcccctgagcctgggctgtttcccccgacctcttacttagggggaaatgccaggctcagggactaactagtacaaagaccctgaggaaggaatgattttgacctgttttttttttaaaacaacaacaacaacaacaggttgtagggctgaagcttaccaaagaaaggaagaatggtaagttcagaggaggagccatacaagggccgggatacgtagggccttgtttccttgaaaagggatttgcattttatcctaagctggttgggaaaccattgaagggtcttaagtatgggaatgaggggatctgatcaaatggtagtttctcacagaatggggagtgaggggaagaagcaagagtgtaagccaggagttcagacttaagtgttattgctggaataacagttcttattgctgaagatgcttttaaagcagtggctattggcaggggttggtggctcacacctgtaatcccaacactggggaggccgaggtcagtggatcacttgaggccaggagttcctggccaacatggtgaaactccgcctctcaaaaaaatacaaaaaaaaccaacctggtgtggcgcgcacctctaatcccagctactcaggaggctgagcctccagaattgcttgaacccgggaggcccaggttgcagtgagctgagatcgtgccacgatctcagc

SEQ ID NO: 28563 - DNA, 1079 bp, Homo sapiens
gaggtgttatatttgctacccttcagttgttattttcttttgctcatttttctgtaatagcccagaaaagttggtctgatttttatttattaagagctctcttatgaagacagcttgtccaggataattcttatgtttcagatctacagactccagcaatatcactaatcccgggagtgggatcccaggctgccactgccatgtggtggggcctcagaggggatccctctctgccatggagcttgtttttataagttaagaaatggtcatgctttctacaaggaaatgttcctattgtaccttggtagatactatgtttaagaaattttgacatggcaaaaataaaattgtcttggggaggcaagaggaaagctggcatctcaagctggaaaagtccaagtcattggttagattctgaaatgactctgaaatgttttattaattgtattagtccattctcacattgctataaagaactacgtgagattgggtaatttataaagaaaagaggcttaattggctcacagtttcacaggctgtacaggaagcatggacaatcatggtggaaggcaaaggggaagccagctggagcaggaggaagagagcaaaaggagaagtgatacacactgtttttttgttttgtttttttgagatgaagtctcaatacagaggggaagagtaagaaaggaaatgggtaacaagcagaggttggaacagtttggagggctcagaaaatagaaaaatgtgggaaagtttggaacttcctagggatttggagggctcagaagacagaaagatgtgggaaagtttggaacttcctagaaacttgttgaatggccttgaccaaaatgctgacagtgatatggaccataaagtctaggctgaggtggtttcagatggagatgtggaacttgttgagaactggagcaaaggtgactcttgttatactttagcaaagagactggcagcattttgctacagccctagagatctgtggaactttgaactagagagagatgatttaggatatctggcggaagaaattactaagtggcaaagcattcaagaggaagcagagc

SEQ ID NO: 28564 - DNA, 1029 bp, Homo sapiens
aggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctc

SEQ ID NO: 28565 - DNA, 1027 bp, Homo sapiens
agtagaatttttatatgggcaagctgcttttccttaagtgctctgagaagacggtggaacattctgagagtctccagaaagtggttatgtcgccatagttcagcatatggtggtttttgatggtaaaaggattaaggaaacattttcttggcaaacagttgcaccaacagaaagtttgattttaaagaatctctggaaatcagcttgctgttccttaacacttcactgtagctgccaagtaaacagctgctgatcaggtccccggatatgtaaataatgttcttgtgtttatgtttgctgccaaagagaactagcttgacttaatttaaaacctattataggaagtattagcacaatacagatctctgggtaacaaagagcctgccccagataaaaacagtcttaacggtagtggtggtctgtgcaacagagttctggtggaacctcaaatgaaaaggggacctgggattctccttgtcatgctgcctgacctttcccgtgtgctgtgttgggcatatggctctgtgtgtgcagtgtgtttcttttaaaacctttattgaatgctaattgttacgagattgttaaagtaacaattttagagtgctttgctccacagtgaaattatatacccatctctgcccttgagcaatttgtgttatttttaatcactcaattagattaaattctgcccccatggattttttcttaattcaataagaaaaatattatattatctttcaaaactatcccttaaaacagtgggaatgacccatatttttcttttcttttcttttttttttttttttttttttctgagatggagtctcactctgtcacccaggctggagcgcagtggtgtgatctcggctcactgcaacctctgcctcccaggttcaagtgattatcctgcctcagcctcctgaatagctgggattacaggtgcacgccaccatgcccagctaatttttgtatttttagtagagacgggggtctcaccatgttggccaggctggtcttgaactcctga

SEQ ID NO: 28566 - DNA, 1022 bp, Homo sapiens
tttgtaaatataaagatatcacttttttttttttctgtgatgaagttttgttctgttgcccagtctggagtgcagtggcgcgatcttggctcactgcaacctctgcctccttggttcaagcaattctcctgcctcagcctcccaagtagctgggaatagagttgcccaccaccacacccagctatcatctagcaaatatttatttagcatttgtatgcctggcactactctagctgttctaggcactggggatacaccaaaacaattctgcttctggtggaacctgtattcaagtttgcagaaacaagtaaaaatacatgtgaatgtgtaatatgtcagggaatgttcaaagcctggagagacaagaagttggggcaagtagagagagggagatggcacatctgcagtgggtcttgttgctattttattttatttattttttgtgtgtttttttttttttttaatgtgatgttcgaacagggtgagtgagtgaagagagggagtggaatcatagaggtattttgcagacaagtgttctaggctggccaggcatggtggctcacgcctgtaatcccagcactttgggaggctgagcaggtggatcccctgaggtcaggagttcgagaccagcttggccaacatgctgaaactccatctctactaaaaatacaaaaattaaccaggcatggtggcacacgcctatggttccagctattcaggaagctgaggcaggagaattgcttgaacccgggaggcggaggttacagggagccaatatcgtgccactgcactccagcctgggtggcaaagccagattctgtctcaaaaaaaaaaaaaaaatgttctaggctgagagaacaaagctggctaaggcctgggcagggggagggtggccatggtggaggtggcttacctggtgtttgaggaggattggcggagagggcacgaaagaggggatgcaggagatggtgggggggagggaaaaaggataggccatgtagagcctaagtgccataggaaac

SEQ ID NO: 28567 - DNA, 1060 bp, Homo sapiens
gtcatgactaagactgctagtttgacctattcaccgcatgcccttgtgaaaagtgagaggacgtcatcgactgacttgatagaatgatctctccttgtttgctcggacagttccagccattaatttacttaagaaatgaattttagaaaagagattagtcctgaaagctgatgccctgagtcccttagctgactgtgatactcattggttttttggttttgttttgttttgtttgtgatggagtctcgctctgtcacccaggatggagtgcagtggtgcaatctcggctaaccgcaccctctgcctcccagttcaagtgattctcctgcctcagcctcctgagtaactgggattacaggcactcaccaccacgtgcagctaatagcttattatttttatatttttagtagagatggggtttcaccatgttggccaggctggtctcgaactcctgacctcaagtgatctgcccacttcggcctcccaaagtgctgggattatagacgtgggccaccgtgcctggctgatactctctgttttaatgtggcatttccctatccttgatggaacctgcggagagcagatgagcaaatgctaagcgagtgtgagactgaagcagtttcgcagtttgtcttgtgatctttggggagagtagatcattgagcttgcttccatgggttttacttttatgtaaatctaaagaaaaaactgtggaggaaagtcaacatttcatcagaaaaataacaaaagagacttgatggttctcagttaaaacctgcaaaaaggaggacatgaaccatcagcatttctcttctttttttttttttttttttttcttttttgagacagagtctcactctgttgccccaggctggagtgcaatggcgcgatctcagctcattgcaatctccgcctcctgggttcaagtgattctcttgcctcaacctcctgagtagctgggattacaggcgcctgccaccacacccagctaacttttgtgttggtcaggatggtctcgaactcctgaccctgtgatctgcctgctttggcctcccaaagt

SEQ ID NO: 28568 - DNA, 1027 bp, Homo sapiens
gatgcgtcaacaaggaaagatccacaagctcgtggagctcgttggggtgaagtgggtgtgtgtgtggcagaaaacagttagcataataaggaagcgatgtgctgtggaagaaagacagggcatgttgaggaagatggggtgtgggggatgtggggggcaatttctgacagggtggtcagggtgagggcagacctggatagggacttggaaggagaggaggggaggagggagctggctcctgagttgcaatgtgggagggtgcccagcacattcgagcaaggaggaggagctcagggtggctggggtggggtggaggtgggagaggagatgctgtggagaggttggcatggtagttggaggaagcacagagaagccttctggttgtagtaaaaggggggacgtgagtattcttgggagtgagaaaggttgggagtatgccctggaatgagttcttcaatttcactagtgggtggggacatcgaagctcaagttttaacgcgggacaccgggggagggtcttgaacagcagtctgaggagtcctccacattgctcctggaacatttacctggcagtggtgtgccggatggattgatggaaggaagatgggttagaagagagagcttattgctcaaccagtgatgtggcactcggaggggaagagaaaaaactgagtctctgatatattatggatagtgaggagggaggggagggatgactgtaaggtataagcacatacatagaaaagcagatgaaaggagaggcaatgattcatttaacttagacataaagcttctccaatcaggagttacctgaaggaacatttcaagcttttgccaacttactttggaatccctttttagtaacagtaggaattttggttccaatgcttgtagctgaaattgtgagtcactcccattggaaatcgttagaagaaaaggaatgggttgttggaaacataaaaagaaaggcatagagattttgccctaagaaaggaaggggagggaaaatagagttgatttcctattc

SEQ ID NO: 28569 - DNA, 1086 bp, Homo sapiens
cgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggtaaagtgattgaaatttgtttcaatattttgggaatggtgcatgactctttaagtgcatgactttgctcttagaagatttccatcttttaatcgggttttaccctgtttgcctggtagttgctgcagctggtgctgttttgggaggatttctctctcttctgctttgcccctcttagagttctgtggttaaggggtggggattaagggaagt

SEQ ID NO: 28570 - DNA, 1027 bp, Homo sapiens
aatgagcttaggtcacttttctggggtccagctcagtggtacttttgccttaattgaatcacctatactgaaaaaagaatacccagtagagaaaaatctcatggtggttaccattgtgatgcccgtgggttttgacttgagaaagttaaagaaatatggacttctttccaggcgtagggagcacaaaaacttccagaccatccacctaactttaaaaagaatgggtgcttaggagagttgggccaagtcacttgtgtcccatagttaacccatgtctttcttgccatccctctgtgcccatcaccatgtgctccactctcatcctttgctggtctggtcactcacataaaccagggcattgcctgagatctgcatggtgttgcaaagctattgacttcttattttatacactcacagaaaagttaaatgattgttcttaaatgctacatgtgtttaagtggcacttgggcatgcttatttatgcattgcagatatattgcactgtgatttgtacagctttgatcattgcctgcattcagtgatcttatttaaataataagagtgagttcaagatgtgagtcaacagcatggtgggtttcctgcagcctgagaatattttggagactgaacccaaatctgatttactttttaactttatgatgccaaggctgaggcatcctatttttatttttgcattaaattattgaagctgttaaatccatttattattacaggtattgatttagtccatacaaagtgtggttgagataatgtttgaaacttctggcctctcatggataattagagggtttggttttgtttttgtgtgtgttttaagttccataaatctgcattggaattggccattatttgtgtctccattccaatatcctccctgatctaagttttttgggagttgctatgctctgaatgttggtataaattcatatgttggaacctaatacctgaatgtgatagtatcatgcggtggggcctttaggacgtgattaggtcatgagtgctctgc

SEQ ID NO: 28571 - DNA, 1044 bp, Homo sapiens
atttatttaacacggagtgatatatttgcttctttctctgactcatttgtagcaggcctgtgaaaagggatttgaggtggggaggatatataccattatacttctcatggcccagttctctctccatctgtttttctctctctctctctctctctctctcattgtttttttttctctctctctctgtttctcacacacacacacacacacacacacacacacaccctcaattggatctgatctgatccatgcttggtgagtaagaagtacaggagccaaggatgacgtctgtcacgttagtgattaccttcttcatggtctattatgtgtggtacttttatggttgatggaaagttttagatgagggaagacagacaattagagagggaagaataccagatgagagtagagctggccagccatgacactgatatttggaaatgccaattaagtaaacaccttgatcacttgattattacaagtagatggaatctgtaggagtagaactgagcacatttcattaagattatttcccgcggtagtcaccatgacacactaactctttcacaggttttcaatagacagtttacaaaatcagttttcatgattaagaaagtttagaaaacactaggttaaataaagtgaaatccatttcgttactgttggagttggagtgcccaactttggccatagaatgcatatttcttggagcacctggtaacattcctgtatttctacagaaatatgcatagttattggaaggcagggtggcggagtgaagtgggcactgcaggtttggaaggaagcccacctgggttctcatgacagtcaagccactccatccgctcagctgtggacaggccacttacacagaaatgggtgtaagagtaagtcatgtgccctcccccacccaggtggctgtgatgattagattatctaatgtacatagaaacgtttttcaaattatgaagcaccctgcaaatagcagttattattacaccctctaatgtttttattgccataatatatgtatcgtcatactcg

SEQ ID NO: 28572 - DNA, 1043 bp, Homo sapiens
tatttattacacgtatatatacacacacattttatatatattatatatattttatttatttatttatctatttatctatttattttgagatggagtttcactcttgttgcccagactggagtgcaatgacgcaatctcagctcactgcaacctctgcctcctgggttcaagcaattctcctgccttagcctcctgagtagctgggattacagttgtgtgccaccatgcccagctaatttttatatttttagtaaagagggggtttcgccatgttggccaggcttgtctcgaactcctgacctcaggtgatccactctcttctgcctcccaaagtgttgggattacaggcgtgagccactgtgcctggcttccattctatgttgaataatgttttcattctctaagccaaaatcccacctagatagcatggatggataactacctatttattctatgttttgattaatttacctagaatgtaattcctgtctggtcttttgtgctgtagaatcccaatggtgtcttgttttaataccctcatctgtgttccatagttacgggctgttattaagagaatctagagaagaatgagaaattgaacccagggtttttattgtagaattttaaattccactgtattaatctagttcttaggaattaggccttctagaaacaggccactggcttcctggccttgttgtggtctggatccttccaggagaactcgtgaggatagcacatctgcattcgagctgatacaacttccattctcgcccctgtcctaagcactgggaatattcataatagctgttgtgtatggttgttaacaaaaagtgatcacatcttataatctcactcggctccaaaattcacaatgcagtttcatccttactgttactttcatacataactgggggttgtctactataagccatgtttttggtgctgcctttcttgagtcaacttagcagcaaatacattttactactggcacctcctaccatgagatagctggaatttgattatgcctcaaaagtgtgact

SEQ ID NO: 28573 - DNA, 1050 bp, Homo sapiens
ccccacatagctgtgatgggcctggaaatgtacatttccttacttcccaggtgaaaaaggaattgatttagcatctctgccactgttgggtatttaaacttaatcttaaggtgaagtgtatctattaggaagacattagctgtgcaatttacttcacttggtagctgggtatttgatttgcatttctggacttatttttgcgttaggtggttatgagcttctcacagatgggaaagaaggggatttgggttttttactttttaaaatgctggagacttttcttctttgcctgatgatgtctttatatccagctcagagagccagaatgaatgtctggtcacgcatgatggattttagttgaaatcagatttgggtttttcatatagtttcttatagggatctatgctgacttcagagatgcccttaagtttgtcctgagtttctcactgatcctagctctccagggcttgtaggccacatcttcatttttttcatttgtgaagcattctcatgacttttcagaaggacgccagccagactctccggtctaggactctagaattctaggcacatgactcttcctgctgaaagatttttttcccaataagtttaaaagcttttcacctttcaaataattttgcaagagtttcgttttatttttttattcatttatttatttagttttgagacggagtctcactctgtcgcccaggatggaatgcagtggtgcaatcttggctccctgcaacctcagccttggaggttcaagtgattctcctgcctcagcctcctgagtggctgagattacaggtgcatgccaccgtgcccggctaatttttgtatttttagtagagacagggttttaccatgttggccacgctggtcttggactcttgaccacaggtgatttgtccacctcagcctcccaaagtgctgggattacaggttgtgccaccgcacccagcttaattttggaagacctttaaacctttcatctgttactagtcgtctttgacagaatatgttaaattactctaaattgatctttag

SEQ ID NO: 28574 - DNA, 1032 bp, Homo sapiens
accccacctttataaagctggtagaagccatggaactgctctttatacaaatgcaggtacgtccctgcacataatttttacactcaattccagaaggttcagatacctttgaaagtcctccagggatcgtgtgctaagcatccttgtcctgggtccattcccagggcctatgcagaagcgctgaaattagcaagtctgtgtgacccctaccctttacaagcatgcacgttttaaaaatacaaatagctccgtgtgcaaaattgtaatttccgtctgggtagcgcttttcaactgagggttgaaaccttttgggagtttataaaataattttagtggtttgcagccaatatttctaaaaaaatatattggaataggataaaaagtaaaccaagctattatgtgtgtgtactggggttgagaaataaaaatatgggtccctgtttaagaaaaactgatgtatgtgcagcttgttttactatatatttagggcagtgggagcaatttaaagaaatatttgctttcttttcattaaatgctttgactatgttggccctttttcttcttcataggtagggtcaaagagtttagtgggcttactaacattttatataatatatcctactgccaatcatcatttatccacagttattctcaggatacctctaatatcagtgagcttaaatctgctgaatgttctgattttctgtgatagtaaaacttaaaaaaaatatatccttgccaagggtcagtgtgattggccactagttaaccatttcatgtgggagacttctcctccttggcctcacttttctcatttgtaagtgagaaatggtcctgataataatgatatttttctctctggattgttgggaagactgaatgagcttttatatgtaaaattcatagcgtaattcttccataaacattgttcttcttagtagcagttgtactgtttgtctaccatgcaggaatcacatcttacactcccattaggatttctgagaatctgttaagttgtccattctgactgca

SEQ ID NO: 28575 - DNA, 1003 bp, Homo sapiens
taccgcacctccacctcctaggctcaagtggtcttcctacctctgcctcctgagtaggtgggactacggctgcacaccaccattcctggctaatttttgtattttttttttgtagagatggggtcttgccatgttgtccaggctggtctcgaactcctgggctcaagtgatctgcctgcctcggcctcccaaagtgctgggattacaggtgtgagccaccgtgcctggcctgtaaaaaaatacttctgttctttcctttggttattacagtgttggtgtactcattgtttacccttgtggtcctactgagggatgctggtatggagtaggtattcaccatttccctgtactttgggggcagtacagggaaacattaccaaaatatttcttaaacatttttgaaatacttaaagaaatgattttgttgtttggaaaccaaatcaagccaaaatctttgtctccagcctgaatgtcacatattctagttgggcagttaatctctttgcttttggcaatgttaggggccctgtggatggaatcctagaattcagaggtaggctagaggcagctgtctgaaaggttacaggcagaaaagatggctgagagcagcactgtgggaataaaaatcactagctccatcacttacaggctgtgtggccttggataagttgcctgagttctctgtgctttggattcttcatttataaatggggacaagtactttcctgatagaattgtcagaaaattaagaaacttcttcagcgtctgacttacagtaggtcctctacaagtgtcaattactattactgttgttatcaccatcatggacagcatccctctgcccataagcaggcaccaaataaaattttttttttgagacagagtttctctccgtcgcccaggctggagtgcagtggtgccatctaagctcactgcaacctccgcctcccaggttcaagtgattctcctttacagtatccacccacagtctgtccactgaatt

SEQ ID NO: 28576 - DNA, 1024 bp, Homo sapiens
tcatccaaagccatggaatctacagctccaagactgaaccctaatgtgaactatggactttgggtaataatgatgtgtcaatatatgtttattgattgcaacaaacagaccattctgttgaaagatcttggtagtcgggaggctgtgcgtgtggggcaggaggtatatgggaaatctctgtgctttctgcgtaattttgctgtgaaccttaaactgctctataaaatggtattatgaaacagcaacaacattcaaaccaaattgaggagacacagcactgcattctactcatgacatctagtaaagtgtcttttgacctatagtacttcttgaagttctttgcagcctgtcggcttgggcagcagtcactgggcagcaggggagaatccctcatcaagcaggaggctctgatactctaagaatgggattttccctggcggcttcatagctgtgaaagcactgacttcatgttcctgttttcttccttctggccatgtgctgcgctgtggacactaaggatgcattttctggtgagctgattcatatggtagatgccgtgttagccacactttcctgcatcaagggtggttacggacagcagggatttggtcgtatttgaatgtactgtgacctggggaccagaaatgctcaaatcctgcctcagtcttatcacccttcccacaaggagtcgtcaggactgtgtgcacaggcaccttagcacgaaagtgagcagttacgaggatttttctgggagccgacctcagcgtttcttcttgcgggttgtctttgacttttgaagtcagcatctgtgtgttcactgcgttcacgtgctcagttgcaggtagtaaggagacaatagggcagaaggctgggaagcatccttaccctcagggaactgacattctggatacagacaatatcaagagatgttgtccctgcgtatttgtggggggttcgttccaggacatcccctccctgccctgaggacaccaaaatccatagatgcttaatctcttttggaaaa

SEQ ID NO: 28577 - DNA, 1050 bp, Homo sapiens
gctcagtcatgtatgtttaaacaaaatgattatcattatttgctagttagtatttcattaatatgaaatatgagaaggtgagcactgggctagaaagaggtcaggagaccaaagttcttatcctgggctcttcctgactcttcaaccttagttgagcctgttgctcagggctgtgagttgcatccttaggttccttgagtgtatagaaatttctctctgtatagttggcaaagcctgtaatatggatattatgtaccaagactcaacttttagcttgatagtgctgcattatttatttacacattatttatttgtttctttcagtctcagatgccgtggctggattttatatttttggtgttgtattttaaaataccgtgttaacttgtggttgtttccttttctttctttcctttttactccaggagtagggggtttcatgtaggatgaaaatgaaaactaaagaaaaaataggatctggaagtaattttgagagcagaaaaattaaataaaatgggaaaatataccattttgttactagccaggtgaagagaacacaggagcatgtacgtgctttttctcagtaattggatatgttagacacggattatgttttcgctgggaccttgtagttaaaagaaagcaaaaagctgatctgaatgttcaatatttcccttttctcaagagcacatgaagttggtattgaaatgtgagttgcctgcctcttatttccatcgtttgaaatcagactgaaatcctgcatgtgggaccctcattctgtgacctctgtctgtgtatccaccaggcttccttgccagccctctttctgactcacaaatggcagtgggtgtgagtgcccaggaatacttagagtggtaaatacaggatttgggaaatttatctgcagaatgtcagccctcagtaggaaagtagtgctgtccaatggaaggcctggtcaaatgccttttggttggatgtttcaagctggtgtggcatagccggagattcccagtcctcaggagtgtggtagggtaggctctgtcctaccag

SEQ ID NO: 28578 - DNA, 1100 bp, Homo sapiens
aaatttatttctcatggttcttgggtattggaagtccaaaaccaaggcagattcagtgcctggtgagggcctgcttcctggttcatagactactgtcttttcactgtgtcctcatgtggtggaagggaaaggggtctctcttaggccccctttataaggacaccaattatttcccaaaagtcctaccccaggctggagtgcagtggcgcgatcttggctcattgcaacctctgcctcccgggttcaagcgagtctcctgcctcagcctcctgagtagatgggattacaggcacgtgccaccacgcccagctaatttttgtattagtagagacggggtttcaccatgttgatcaggctggtctcgaactcctgaccttgtgatccacccgcctcagcctcctaacccttcttcttcttttaaatgtatttttccttttatttttagttgacatgtaataattgtacatatttatgggacacagagtgatattttgatacaagtatacaatgtgtgatgatcaaatcaaagtaattaccatatccatcatttcaaacatttattatttttttacgttgggaacattcagaatcctttcttctagctttttgaaaatgtacaataaattattgttaactgtagtcaccctatagtggtatagatctctagaacttattcctgccatttagctgtaatttggtatctgttaagcaacctttccttatcctcccttccctcctacccttcccaccatctaatatttcaccttctaataccattgccttggaggttgggatttcagcatatgaatctgaagggcacacagacattgagaccaaagcaccttgcaactgatgcatgtgtaccttcagtctcatgtagcttcctcattatcatccctttctttctttctttctttttttttgagatggattctcgctctgtcacccaggctggagtgcagtggcacaatctcggctcactgcaagctccgcctcccgggttcacgctgttctcctgcctcagcctcccaagaagctgagactacaggctcccgccaccacggccggctaattttctgtgtttttagtagagatggggt

SEQ ID NO: 28579 - DNA, 1034 bp, Homo sapiens
gctgccctcgggcctatgagtgcacacgtagcatcgtcctctaccttgccaggtcagaactaagaaagagcccctagaaggcctggacgtgggcattgggtccagggtgccctggtatcatctagaaaggtatctgcctgtctgcctttaagaagaggcgtggctggtagaaggccagagaagtccctttgatgtgcgtgcccaggtcctactacgaatctttgaatactggtctggttttgatcctggaaaagctagtcgtcactttctgcatgaagaaaggagaatgaggagcctccatttggaatgtattagaattcagcagcatgcaattaaaaagttgtttttaatgggtgaacatcagtgtttcctggcataggttcatttaaaaagctctgggctcgatcaaacagcaaaatatacatttatacaaggtggtttgttgttgtttttagactttacttttcaagaaccataatgaagttttgcttaaaaatttcagtctttggttgcacggatcatggttctcttctgagctgatacaatgtttcacctcctggaatcttgtctgatgaccttcttcctgctcataacatctgtgattgtataggtgctcctgcattcttaattcttactttcggggggatgctgatgagaagagctaatgtaatttcaatacataggaaaaggcaaagccaagatcaagtttaaattggaagatattatcttaaagggtacaatagtgaagtgaacgtgtatactggtaaatcacttgtcatttttgataacagtaatacaaaagttttacaacttgtccattagtgagattctcaaattgctttagagaatatagaaaaacaagaaagttggagtcctgaggttctgttctcctggtgattggagagaatctaaataataccttgtttttacatcattaattatttaatcaaaactgaaaacattatgtccataatactgcatccacaaagtgggtactgaggaatgagtaagtataaattctccaaaaatctctc

SEQ ID NO: 28580 - DNA, 1050 bp, Homo sapiens
tccatggttcatccattctacaaggtagcagggaagaattctgaagttcctttgttatctgtaaatggttagtgtgagacctgttgcctctgtcccttctcatttccctgttttccatgtctttcgttttgccctggcagaaagcagcccagcatcttcacattctgacttctggaatggaatgaaagcgtttctttctgtatagagaggtttgttttacacagagctgcctttgactgggaagactccccctaacagatttggatcataacgtgttggcaccaagccaggaaggatggccataaattgtaatttgaatgaggtttcaccagctctttgtcctgttatctcatttctggcgcggggatattgggcaacttaaaccaggagctgatttggtcaatgtgattttcatgatttaaattagaaatgttcattttgggtggcaggtatcaagatttttgtatattggtttctacttctgaatttttttcaaaggaattaaaatgggaggaaaagaggagagaaaggaaaagaggaaggaagcggtttgaaacatggacccttagagcttttggatgcaaaaagatctgtataggaatttggcacttgctgtatatgtgactttgaacaacttctctgcctcagttttttgctgtttataaaatgacacttacaaacgggcatgatagttctttgttaagagatcatatctcttcagagccaaacatagtgcttagaatataaaagatacctaaaaaatcctaattccctttcattacctctttgatgttacatctaaagatctgctgctaagttgaacacagactttatcacttccaggctggtctgaatataggtcttgctagaatgttgttcgcttaaatacaatcatatcacagcgatcgaaggatccctttgctttggtttctttccactattagaaaagtggaagggcataaaatattatttaaattttttttgtgtgtgtgacggagtctcactctgtcgcccaggctggagtgcagtggcgcgatctcggttcactgc

SEQ ID NO: 28581 - DNA, 1630 bp, Homo sapiens
gatcaagtgatcctcctgcctttagccttccgagtacttgggaccacagtttgtgcaccaccatatctggctaatttttttatttctgtgtagagatgagggggtctcactctctcgcccaggttggtctcaaactcctgggctcaagcattcctcctgcctcggcctcccaaagtgctgagattacaggcatgcccactatgcctggcctgtatctgcaagttttaagggccaatatcaaaatattaggatctaggaggaacagggagctgttggatattggtagagctctgcaaaatgataaatgtcatgagtgtttttttaaactttatttttaaataattgtggacttacttacaagaagttgaaagataatagagaggtcctgggtacccaccacccagctttccccagtggtgacatcttacttagctatactgcattatcaaaaccaggaaattgaaattggcacaatgcaagtcacagaattgcagacaataaataggtggaagtggtagctcaagtctgtaatcccagctactcaggaggctgaggtaggaggaccacttgagttaggaattccagaccagactgggcaatataaagagacccatctcttaaaaaaaaaaaaaaagaccatactggaatttcattagcttggcatacacttttttttttcctctttaaaataggacttagtgtaggatttgaccagtgttttttgatgagggacagaacctctgtctaaaactgtaataaatgttgtatagacacatggctttttagcatagctctgtttgcttaagtatttttaacacggcaaacagttgagtggactgtgaagtccagcagctcagttatgggatagagaccaagcaatttggttattttcatttatggtcttgaactccttggggttattatcttcacttttttgttgccttttcagagggaggatattttctaaagataaaaggataattcaaggtcattgtgtcatcttaagagctcttggagggaatgataaacaaatgttgtttttcctggaaaagggtgggatttcgattaatcagataaaaggtatggactgataagactcaaagatcatggatgcaatttcatgataactgttagagtggatttccttttacaatgacagccctgtgtgagttgcggctaagtgtcgcctgcttggcttgcctgtgattaattgctcctgcctccgtgatcccatcacgctttgctgagacttccaattagcctctgtcactatctgccctggatttgagctatttgtgagggtgactgtcttctcagctagactaggaagtctttgagggcagggactgtctaattcattttttgacttttctcctcgttctttcttccagtatcaagcaagatgcatcaagcagaagggatctctctattctccagcccccagcaatttttagactattccttattctagcttcacttctttatgtatttatctgggcatctgtttgtatgttatgtgtatttgaaaccagtaaggctgaatccatggtagattattttataattttgagctatcatgagtcagactggccttgttctgtagcgctacctgaatagctgaaaaacagcc

SEQ ID NO: 28582 - DNA, 1035 bp, Homo sapiens
gagttctgaaagcaattctactctgctggacaaagtttggaaaatacacacttggttaaaaccacatccaacactaacagtgatgtagaccacagtaaaacaagtcaggtggtcaattcaatgaattctaaatggttgcatcattttggacaatctgatatgctttgcttcgaggctttattgcatgtactcacctttagactctttagggtctgggatactggaaaagtttttcacaaatttcccttaagtaagcctccctggaaaggtcaactggttctttctattagttcctggaatttctgtggagcttgtgttcactgatgtccagaggagatgcaacagaagaggagaaggctctggtgcatgggtattttttacagacatggaggctgatgtggctgtcctgggctatgagctgttttgtccctttcaaggcttgttttctataccatgacatatcattattattatgtggcaaagtcaggaaattgcatctcatccaaccttgcccatttgctaggttctcaggtagctcaggttctcctgacagatatttttcctaaagtcgctttttcaaaaattgcagagaagtttcttataaggatgttatatagtttatttattttttatttttagtttttgagacggagttttgcttttgttgcccaggctggagtgcaatagcacgatcttggctcgctgcagcctccacctctcgggttcaagcgattctcctgcctcagcctcccaagtagctgggaccacagacgcgccaccacgcttggataatttttgtatttttagtagagacggggtttcaccatgttggctaggctggtcttgaactcctgacctcaggtgatccacccgccttgacctcccaaagtgctgggattacaggtgtaagccaccacgctcagtctaggatgttatgtagtttatttaattgcttctttttgctcatcattttgttttccacttttgtttttctacttgtggggtgtattaacttctttgtgtgtaaatctttgt

SEQ ID NO: 28583 - DNA, 1033 bp, Homo sapiens
gatggacacattcagtacagtctggtaagagctactgaacatacgtggagtgcatctcagagtagtttgggaggtgaagttgaaggcggtgcagaattaggtaggtcttcagatgagccaagttcaagttaagtcttagatgatgagtggttgttcttccagtggataagggggagaaggaaagcattttcaagccaggagacccatacatgcagaagtacagaacaatcaaagggcctggtcacctctggggatgagaattattattattgtcattatgttcttattattactattacatattcttaagtcagggttataagatgagctaagctggcaagatcagtggccagatcatgccaagaagtttggcttttcttctggaaaacaaccaaagatgtttttagcagtgaaatgaagtaatcatatttgcaattctgttacatatatacaaaaaatagaggcttttttaaattagaaaaattactttatgatagactcaaaatctaaggtgagagtggaggaaaagatacagaacaataaggaatttaaatgaagaaaacaataaagaatttagaacctaattcttagaaattcatacaaaatcttcagagaattttaattctaaaacaaatccatgcagaaaatctacagaaaactttaagaacggaagaatcaaaagctaactcagttcagcctagactgaaactatttttattttgcaggtatactttgatttcatcttttttccccctttgtctggtctttgtttattatacataatacataagtataaacgctagcttgatgtttttcccatttagtggtaaaaatggttgtgttgcaggtggccttaaatcatttgtaaatattcatttaacaagtgtttcctattccatgggtgctgcactggggtttacttagctcttgtttgcatgtatggtaattatcagtttgggttcggtgaggcgcatggcagagggatttatcatggggattccccactgtgcaatatatatatatatgtgtgtgt

SEQ ID NO: 28584 - DNA, 1098 bp, Homo sapiens
ctgatgtattcgttttcattctccttctacccagtttgctcaacctaatcacctgaatgatgttaatttgggtttaaggcacatttcagaagattttggctgtaaagagcaaggcaaacttagctcttctgcatagctctaaatgataccaataactataaatggcatcattcatactggtgaagtctttcttactttttaaaggctaggatcaaatctaggaaggcttgggtgactcccctgctctgaagagctctggctttcaatttctctagtacctattgcttcaattggttatttatctaccttatgttgttttggaaatgaaatgagagagactgaaaagagaacacaaaaggccattacttcaatgttggataaagacatacccacatacatttaaatttgttacatgtttcccttgcagtttcatttggcatttctttatctgtaatgcacagaatgtcccctccaatgccccttttatcattcatccagccattagagttgttttccgacatgtaattctgatcattgccactcccctttgacgggagcgaccacatacagattaaagtctgatctttgtgatacggcacttcagaccttccacagtctggccccaaattattttctgctcccgtctcccatcacacattctatttcatccacaaggcacatttcctgacactgcaggggcatgtcatttattttaacacccctgtgtttgtttctactgtttccctggaaaatctttcttactgtgccttcccctcccacttcatgcatgttgccgcatctttccagtctttacaagtggagttgcttttcttctctgcattcctatggctttttcacaaactggccggagagtgtgtctgggaaggccatggtcactattaccaggaaggtaatttagaaagcaggccagatcacccaactctggctcctcgctttggtactgccagcctgtcatcattatagaggtagaaacgcagtggcagaataaagagtatggaagggcagggcgtggtggctcacgcctgtaatcccagcactttgggagcctgaggcgggcagatcatgaggtcaggagat

SEQ ID NO: 28585 - DNA, 1050 bp, Homo sapiens
ggaacaagagtcctttgcttattaagtggctgccatgtgccagaggcagtggtggacactggtgattgaatgacgtgtatattacgtggtgcttgtccttgggggagcctgcagtctatagtggaggctgataaatgaatagatagatcccaccatagtgcagtaagtgttgctgtagggatgagaacaaagttctatgggacaatagaggttgaatagccaagtttcttcacagatataaaatgaggctttatggaggaggtggcatatgtgaaggatcttgtcttagttttgggctgctataacaaaataccacagactgcataatttataaacaatataaggttatttggctcatgattctggaggctgggaagtccaagatcaaggggctgcatctggtgagggccttcttgctgccctgatgcaaagcatcacatggtgagagagagtgagagagaacaagaaagggccgagcttgtttttataacgaacccacttccaagacagtgacattaatccattcatgagagcagaaccctcttgacctagttacctcttaaaggtcccacctctcaacattgttgcattggagattaaatttctaacccttgaatgttggggaacacattcaaaccatggcagatcttgatggcagtgtagaagtttatgaaccaaagtggggccaagaaacactaggccaatttttcatttgctttctgtaatgtgaatgggagctgcctacttagtttcatcccataatctataagttgctgtgtgaatgaaaattagtactattgtcattagtactacatgcagcaaacgtgtatgaatgattcagggctcaaattccactgggcctttttatatgaaaattagattcatcaatttcctggaattaattaaaatcttgtttacaacaattgacaaggcatcttgtgaccttataagcatgtatctttagagtaactttaaagttactctataagcatgtatctttagagtaattcctgggtgcataaagtaaaccctttttatcttcttgcctta

SEQ ID NO: 28586 - DNA, 1033 bp, Homo sapiens
gtgaaagatattggcctcgtctctcctcctctcctttcagttgaaggcctgaatggaacaaaactcgggccctacccctgagtgagggggaatttctcctgcctgactttctttggagctaggacatcattttttccctcctgctttcagccttggactggaactccaccattgctctcctagttctccagtttgccaactgcagatcttcagatatgttaacctccataatcacacgagccaattccttataataaatctcttcatgcagatatatacatgtgtgttgtgcatatatgtgcatatgtatagattctgtttatcatgagaaccctgactagtacaagcactcatccctggtcactgtccacctcctcatttctcaggccagcaggcatctgaccaacattcctgcagatgcttcagggaaacacgtgagccacagtctcttcacttccatttgcttttgctcctcttatctccgaactcacagttcagtttttaacacattcagatcactctcatatttttcctcctttattctaatttattgatcttcagagaatttctttcctatttctctgctttctccatttttctttccttttttccttctccttgcttttcttccttttttaaatcttcttgagatagagtcttgctctgttgcccaggctggagtgcagtggcatgaacacagctcactgcaggcttgacctcctatgctcaagcagtcttcccacctcagcctcctgagagctgggactacaggtgcacaccactacaccctgctaattaaaaaaaaatttttttcccagttgctaccagctatagtaaaataaagaaagaaaaattttgtagagttggggtttccctttgttggtcaggctggtctggaactcctgggctcaagtgatcccccttcctcagcctcccagagtgctgggattacaggtgtgagccactgtgtctggcctacttttctatctttcttattatcctaccctatcctgtcctaccttaaggcccacaa

SEQ ID NO: 28587 - DNA, 1032 bp, Homo sapiens
aagattaccctggttgagatccactggcttagtgaaacacctgcatacccaaggttccaccattattaaccttttataccattctttatcatttacctattagtgtggctgagatttgctaatgtataagaaagtgctttgaaacatagcatgttattcaaatttagatatgacaatgaccgtagttttcttttgtcatctacatttgtggtctccgttcctttgttatcattgtcttacttttcatttgtcatttatgaaatatctcccccctaaccagaatgttgctcttcactaatatattgaagtgtgtttgatggttaaaatcacagagaaagtcttgactggaaggaatcttgagggacctttggacaaatattaaatgtcctgttaatgtcgttgtcattgctgtcattatcatgatctttttcaatgcctttaatttaaagatgaggaagctaaggggacagtggtgcacccaaatcttggctaatggtagagcaatgaccgtctgggtgtttctgtggaatttacttgcacttttgttttctgtgaagttcgtgctgggattagcagagctctctacctcctcctctgagctccctgccggagcctgaacataaagtgcccgtattctgggctcatggaagatttgttaataagaaattttctaaaaaaatgatcagggaggagacatggggagtcagtaaaaagggggagagaggagcatcttaaactgcaaagatgttgaactggaaaaggaaaactgtgaaaaacattgcaaaaggaaaagaaatagaaggaatctgtggaagaatcaaatcaaccaagtgcaatgttgggtcttgtatggatcctgatttgaacacaacaactgtgagagaaggagagagaggcagacagaatcagggacatttaaacagggaatggttaattggtggtggtaaggatttttgggtggtgggtgggatgatgtttaagtaaaaggtccttctcttttagaaataagtgttgaggtattaatggatgata

SEQ ID NO: 28588 - DNA, 1026 bp, Homo sapiens
gcattccagatgtaaacagcttcagaagcctgacggtcatatggtgagcagtttacactttcatatacgccctgtcatgtgctttgaaggactttctaggggcatcaagggtatgtgaataaatttgctttttcacttatttgtctattatctagccccaaatctgtgcctgctgtttgttgattttcaccccctattcttttttttttttttggagacggagccttagtctgttgctggagtgcaatggcgctatcttggctcactgcaacctccgcctcctgggtttaagccattcccctgcctcggcctcctgagtagctgggattacaggtgcccgccacaatgcctggctgatttttgtatttttagtagagatgaggtctcgtcatgttggccaggctggtctcgaactccttacctcaggtgatccgtctgcctcggcctcccaaagtgctgggattacaggcatgagccactgcacccggcctcttacttcttttttaacatgacaatattctgttggaagtgaggcaagagcaaagtcagggagaccaattaggaggtgacagtgatgagggtgctggcgatgtagctggtactggcaatgggctgctggcgatggagatgcagcagattctggaaccctttgagggttgaattgacagggtttgctccgggcggagtgtgaagtgtgagaggaagatgtgtccacgagaaggaagaacccatgtatttggggtttgtgaagtgacagtggttgatcacggctgctctgggctcagtgggctcttctcggcccttcggcaggtaagagttcaaagctggagtcgaaaggcttatgtcttgagctctcatcgagttgttgattagttcctgggtaaggtcactccctggtagagcagttacctcttttgaattggtgaccacagcctgcgtccccagccctggtgtgctgctagacataagaagaggcaggctggctgggcgcggtggctcatgcccctgtaatcccagcactttggg

SEQ ID NO: 28589 - DNA, 1073 bp, Homo sapiens
tgttaaattctctgcccctcttcttcttctactgttgtcagtcagaggcttggcaggaaagtatatcgcacactcacaggtgacagaagagagtcacgagagaaagtgttttcacggagttaagaaaagcagacaggctgggtgcagtggctcacacctctaatctcagcactttgggaggctgaggcaggaggattgcttgagccctggagtttgagaccagcctgggcaacataatgagaccctttctctaccaacccccctgctgcttcccagattagccaggtatggtgtggtggcgtgtgcctgtagtcccagctacttgggaggctgaggggcaagatcatgtaagctcagcacgggagttcaaggctgcagtgaactatgatcgtgccactgtactccagcctgggtgacagaatgagaccctgtctcaaaaaaaaaaaaaaaaaaaaagggattggttccactggggcagcaggaggaagcccctttgttccctagaactgaagcctgagagaaaaagggacttgtgatcgagagacctccaggtgctgctgtggggaggaagcagggggtcagtgttcctactgtcttgaccctcttccgacagtcatccctgcccgtggtgcctccccagggccagaaagtgtggaagggcagcctcccaggcacagatcccagaggaaaaagaggaaaagtcatctgaagggcaatctgagagtatttagcacgtcgcccttctaggttcgttttttttgagatggagtctcgctctgtcacccaggctggagtgcagtggcaccatctcggctcactgcaagttccgcctcccgggttcacgccattctcctgcctcagcctcccaagtcactgggacaacaggcacccgacaccacgcctggctaatttttttgtatttttagtagagacgggtttcaccgtgttagctaggatggtctccacctcctgacctcgtgatccgcccgctttggtctcccaaagtgctgggattacagccctgagtcaccgtgcccggtcttttttttttttgagaggtagtctcactttgt

SEQ ID NO: 28590 - DNA, 1034 bp, Homo sapiens
gttgggcgttaagcaccaagagctaaaatgcatagctgctgtgcagaattagctgatgctttagcagggctgactaaatggacaatggccgcactgtatagtaggtgttccctaggagggtggagaggggtaattactgcatgctgtgagagcacgtgtaggggcatctcaggtggagggcagacgccgggaatggcttttctaaaagagggaaaacaggcagggaatcccagtggggaatagggtttcaagcagagaaaatatgaagtgtatcaatgtggagatatgggggaacagcccacttggaggactttgtaggcacttacaggtactgtttctttgtctttcttctcctcttcttatccttcctttttcacttccttcagtggcgtgttagtaaattggctcccaaggtgaataaagaggcctgatttgtagtgttttgtcgatttctatggtataaattttcccatcatcgccaattccaagctatcagcatgatatcaactggtctacaaaattcctaaaactttaacaattggtcacaagcctatacaatcccactccagcagacctctgccgctcatccatccttccatccatccatccatccatctatccatccatccttccattcatccgtccgtccgtccatccgcccgcccctccgtccatccatccatccatccatccatccatccaatcatccatccacatgcataattataaccagacagaatcacaggaataaatcatgttgcagattttagagtttttttaaatcaagtcctctcattttatagacaagaaaactaatgtctagagaggggaagtggctttttaaaattctgttcattgagctattaggaccgttttctccagaattcaagtaaagaatatggtttagcaattcttgagttgaagcaatgtggaatctaagttgtgcagaccacagttgtgacagtcctaatgctcacgaagctgtttttgttccttgtctcaatagttgcttgttcccaccaggctcacgattt

SEQ ID NO: 28591 - DNA, 1052 bp, Homo sapiens
aaatttcatgaatgaaaatttaggactcaaaggaaaaagtaaaaccgcactcaaaaacctattattcttaaacagttattgctagtacttcttttttttattacagtaaaatatgtataacatcgtttgtcattgtaaccatttctttttttttttttttgagacagagtttagctcttgttgcccaggctggagtgcaatggcgcgatctcagctcgccacaacctccgcctcccaggttcaagcgattctcctgtcccagcctcccgagtagcttggattataggcatgcgccaccacacccagctaatttttgtattgttagtagagatagggtttttccatgttggtcaggctggtctcgaactcccgacctcaggtgctccgcgtgcctcagcctcccagagtgctgggattcaaggcgtggccaccgcgcccggcccattttaaccattttaaagtgtcaagttcagtggctttaagtacatttacaatgtaacgttgcctcaccagcagccatctccagaacttttcatcttcccaaatggaaactccgaaactccgtacccattcaacaataactcccatttccaccctccctccaggccctggcaccgccattctactttctatctctatgtattcgactgctctagggacctcatgtaagtggaatcttaacagtatttgtcttttttggcttatttctcttagcatgatgtttttagggttctgtgttgcagtgcgtgccagaatttccttcccttttaaggctgaatagtattccattgtatggatatgccaccttttgcttatctgttcatgcgtcaaagcacgcttgggttacttctatcttttggctgttgttaacgggtgtacaaatatctgttcaatttcttgctttcttttgggtgtttactctgaagtggatttgttggatcatgtggtaattctgtttaatttttttttttttttttttttttgagacagaatctcgctctgtggctcaggctggagtgcagtagtgcgatctcagctcactgcaacctctg

SEQ ID NO: 28592 - DNA, 1040 bp, Homo sapiens
gttctcgaactcctgacctcgggtgatctgcccgccttggcctcccaaagtgctgggatcacaggggtgagccatcttgccccactgagtacgtactattatctccactttattgatgagcaaactgaggttcagagatgaagagatttgcccacagtcacacaattagtaaacagctaggttgagcctggaggcttcaggctgtatccctgatgtctgggagcttttgctatttcatgctgctgccctgaactattagtcttccttcctcactttcaaaatccagacatctttctgcattttgaagagtcttaaatgagtggtgcatatgacttgttctcatttgggaagaagatttctgctgcttatataaaatcattgtgttgttttagatttttcttaattgcactgcttaggactttttctgcaaaagcattgaactattcagttcattaggctatatttagtgaaaattgcacccagtaaaatttcagggcatcctttttatgtctcgatgctgtagctctgtactttgataccgtttgtaatgggaaaataaacataacttacatgttttgtttgatttacctctctttgcaggtatcttttgtaaggtgtgataagttgcaaagagaaatattgctttgcagaggagttactgctgcttaaaaacatggcattgggtgctgttgaaatccgtgaatgatgacagtttattgagaatgattgagaatgtgctaaaaatttattttatagctggtcggtgaattattgtgattgctcctaaatttaaacgacagaatttgtggttgtagcttaaaaacctatgacattgaaatacggggtagtgttagatatgagaataagtgttagatatgagaaaaaaatgttgttttaattggtcaaatcaaaagaaacttcctggtcatcactatttccaattcttgatatgttatagccagtgatcccatttggatagaactttataaaggactgcttcggttggacagatgggccttacaagtgttgtggaacattcg

SEQ ID NO: 28593 - DNA, 1048 bp, Homo sapiens
acaggggttaatagcatggactctggtgccagactgcctgggtttgaattctggccctgctagcagtgtgactttggggaagtcacttggctctgtgcctcaagtgccttgtctataaaatgatgattcctaatagttggggtatttgtcccctccaaatctcatgctgaaatttgtttcctagtgttggaggtggggcctagtgagaggtgtttgggtcttgggggtggatccctcatgaatgccttggtgccattctcacaaggagcgagttctcgctctatgagttcccgtcagatctgatttttttttttttttttgagacggagtctggctctgtcgcccaggttggagtgcgtggcgcaatctcagctcactgcaacctctacctcctgggttcaagtgattctcctgcctcagcctccgaagtagctgagattacaggtgtgcgccaccatgcctggctaatttttgtgtttttattagagacaggtgtcaccatgttggccaggctggtcttgaactcttgacctcaggtgatcggcctcccaaagtgctgagattacaggtatgagccaccgcgcccagcctcagatctgattattaaagagtctggcccctctctcttttcctcctccttgccacgtgacatgctcgctcccccttttccttccaccatgagtggaagcttcctgaggcctccccagaagcagatgttgctgccatttttcttgtacagtctgcagaaccatgagccaaatagaccccttttctttgtaattacacagtctcaggcattcctttgtagcagcacaaatgtactaagacaaggatgtgtctgcctccctgagatgttgggaagagcagatgaatcacatgatagaagtttggaatggtacaaggcacacactaaatgctatgtaagtttttgctgtaattatctagctaaaggagcattgcatgataaaatggatataaaactcttgggcatagtgttcaatacacttcagctcttttgcttataagcttggcagagagagagtaaact

SEQ ID NO: 28594 - DNA, 1027 bp, Homo sapiens
gcaatcttcctgccttggcctcccaaagtgctgggagtatagggatgagccactgtgcctggctttgggaagtattttaaatagaggtcacatacttagtgcattgatagtgctgcctcttccctggaagaaatattttcattgatcggcatcccccctccctgctcccttaatctccctagttatctctttctctctgtcagtgaatgttgtttaaacactgaagtctcatcaatcttgtacgctggaaagcctagaatcactagtttagggcttcccatctcagctatattaacactgtaacacttgtatcaacaacagtctagcatcctgttggaattaacacacatggtgctcccactctgttcctgtttgtgtagggagaagcaagacatttccttgggagcaaatctgtttctgaagggtagtgatgggcttgatcaggggactcaatgtgatcaacattgagagactgttgaccacaagtggcccaggtgagtggagactgggacacactgaggagattctaagcattgggttgggactggtggcctttaagatcatatctgtattttaggattttgtgataagtgacagggtggaatggggtggggcaggtggctgatagatgggtgattttagctccatcccttccctctgggaatgtcttaacacccaatcagaagaaaatggttaaaactggagagtcagctgtgaatttagtaatccatcagggcagatggagagctggcaaaaatgtgtgctaggtccccatgctcttcgaatgtctcactcatctttgtcttgatcttttagatactcaacgtgtttgctatttaaataatagattgtagtttaaaatcacttccacttgaaatcaggccctctatttttagaactttcctgcaaagttgagaggcacctaaatgtggtctttttgtgtctctgggcctcctctaagattctgataacctgagtttaccctactcattctctaccaaaattttctatttagaaaatgcttgtg

SEQ ID NO: 28595 - DNA, 1034 bp, Homo sapiens
agctggagtgcagtggtactatctcagctcactgcaccttctgcctcccatgttcaagcgattctcctgcctcagcctcccgagtagctgggattacaggtgcgtgccaccatgcctggctaatttttgtggttttagtagagacagggtttcaccatgttggccaggctggccttgaactcttggcctcaagtgacctgcccacctcagcctcccagagtgctgagattacaggcatgattatgttgagatacgcctggcctgaaaatttaaaattatgttttcccctggcctagagaaaggctgtccacctatcttgctgggataacctgctagggtaggtatatttatttatttttttctctttgttgcccaggctggagtgtagtggtgtaaccacaactcactgtggcctcgacctacaggacacaaggatccttttacctccccgtcctgagcagctgggactgcaggcatgcgccaccacacgggctaattttttgtagagatgggatttggccacgttgcccatgctggataggatggggaaatttctcttatttcaggaatttcttaattttaatgggccccttcaccccacaaagcgtgtttgaagctagagtgcggggagattaaaaagtacaaggctaagtggtttccaaaaatgaattttcatcactagcatattggaaagataggaattttctctgcagcaaaattaatgtaggcacatttaaaagattaggtagacattatatcagtgcctattgtgagtaacaatagctctgtgtatttaattgcttgactcccctttaaaagtctaagaataaagaagtaagagtagtcataaaaccttaaaatagtttaggaaaaattaatgaaggacataaaagcaagcagcatagcatcggagggggaggctcagcctatcaagaagagattttgtgtgttggttggtcatgtgtgtaattaccatcagcactgggctgttttggtgtgtgcagccaaggctgtgcctagttttagttggacca

SEQ ID NO: 28596 - DNA, 1401 bp, Homo sapiens
ttcagcttttctctaggattgcctcctggttcatgaatgatcccatcttctctgaatgtcccaaagcattgatgatttccaagacatttaattcatgtctttgttagtttcctcccggtaacaaggtacctcaatctggtgacttaagacaacagaagtttattctttcacagaactggaggctagaagtctgtaatcaaggtgtcaacagggccacactccctctgagggccctagggaaaattcttttcttgcctcttccagcttttggtggctccaggcaatccttggcttgtcacattatcattccaatctctgacattatcacatggctgcattctccatgtgtgtctgtgtgtctgtttccacatctccccctttctcttataaggttatcagctattggctgtagggcccagcctaattcagtatgacctcttcttaacttgattatatctgcaaagaccctgtttccaaagaagctcacattcacaggtaccagggattaaggttttgacatatcttttttttttgagacggagtctcactctgtcacccaggctggagtacagtggcgtgatcttggcttactgcaagctccgcctcccgggttcacgccattctcctgcctcagcctccccagaagctgggaatacaggcgcatgctgccacgcctggctaattttttgtatttttagtagagatggggtttcaccatgttagccaggatggtctcgatctcctgaccttgtgatccacctgcctcggcctcccaaagtgctgggattacaggcgtgagccaccgtgcctggccaggattttgacatatctttttttgagggctacagttcaacccataaccatgcccagctgctctgttagactgcctgtttgtttgcttgtttatttatttattttgagacggagtcttgctctgttacccaggctggagtgcaatggcgtgatctcagctgactgcaacctttgccaccggggttcaagtgattctcctgcctcagcctcctgagtagctgggattacaggcgcccaccatcgtgcctggctaatttttgtatttttgtaggggtggggtttcaccatgttggccaggctgctcttgaactccttcgtcatttcgaggtttccatttcaccggaaccaaatgttagctctggtggtctgggacagcaagagggatcgtggcccttttgagaaagaaatgggcttttcatcctgacctcatgtaatctgcctacctgggcctcccaaagtgctgggattacaggcgtgagccaccacaagtggcctatttttatttatttatttattatttattttttgagaccatctccctctgcccccctggctggagtgcagtgatatgatcttggcactgcaacc

SEQ ID NO: 28597 - DNA, 1024 bp, Homo sapiens
agcctgggtgacacagcgggactctctcagcaaaaaaaaaaaaaaaaaaaaaaaagacacaaataacaaatactattcgagatcacatgttgaaatgtcttaggaaagaatcttgtactttctagatatttggaactgagctatcttgaggcatcagcttttggttattattttagctggaattaaattaagaaagtgtatcttccttttatacagtagaaagttctttaaagctagataataatttcaggtgttttgggcttttgtgtgcttgagcaagttctttcaattaatgtcttctggatattgctaataactgtgtcatgcaaagctcatccttaaccctcaaatctgttatggttaatatattgctgggtgattattacaaaattactcctcttaagcagtttatcgagcattgaaaatattttcagaaaacgttccaagtgtggtgcatggtctaccatgacattttagaaaagatgtgtgaatgttcaaataattatctcatcttgaaatctctgtgattagaagttacaatttcagtgccacaattatatcaattgaactttaacatttcattgtaattataaaaattaaaaccttgtaactgtggttcttagttaactaaacaatttagcaatcgaattccttaaaagtagattgaaaatcctcaccctgtagtttttttccttttttccccctgctgacggacagctaattgctttaattttgagggttggatctgcctgcaaccttggccctgtgaaacctcaccaattgtatcaaacaattcaaattatcttaaaagtttgtgggagtctgttgccacaatttcagtggacttcaagtaagaatacacaaatgacagtctctttcttggaagatgggctcaaaaccagatatactttgtttctaaaagttgccggttagcatgaggaacctgcagtcttcatgacaaagactttagagatcccagttaactgcccattctttaaaacaggaccagttaatgtagcttatt

SEQ ID NO: 28598 - DNA, 1033 bp, Homo sapiens
tagcctccacctcccaggttcaagcaattttcctgcctctgcctcctgagtagctgagaccacagatgcatgccaccatgcctggctaatttttgtgtttttagtagagacagagtttcaccatgttggccaggctggtctcgaactcctgacctcaggccacctgcctgccttggcctcccaaagtgctgagattacaggcgtgagccaccacgcccggccttttaaaaaaatattcttttggatgtaaacctaagaatggagttgctacgtcatacgtaattctatgtttaacgtattgaggaactaccagattatttcccaaagtgggtgcaccattttacatcccaccagcagtgcataaagagtccaattttcccacatctttgtcaacacttgttattgtctgtctttttgattatagccatcctattggatgagcggctgtatctcctcatggttttgatatgcatttctccaataaataatgtcattgaacagaacatcgtttcatgtgcttgtaggctaatcgtatattttctttgaagaaatgtatcttcagacgtgttgctcatttttaatttttttttattaataagttgtaagaattctttatctattctagttataagtcccttatcaaatatatgatttgcaaacattttctccattctgtgcgttgtcatttaattttcttgatgatgccctatgcatatttatttttaaaagctgaaagtcaataaaaaatgtttacttagtcatgattctgccaatacttttcactacatatgtaggtggtatgctaatttacatttccttttctacacttctggcatgactaattaagttatagatcaagaaaaggaacacaggaaacattttgttttaaaacaccaatttcacacttaaaaaaagcaaaactttgtttacttaaaaaaactctgaatcactcagttattttatttatcagagcttcttgaaggaaatatttgcaatgagatttggaagtgaactacctttggtatcagctttt

SEQ ID NO: 28599 - DNA, 1048 bp, Homo sapiens
gttgcccaggctggagtgcagtggcatgatcttggctcactgcaacctctgcctcccaggttcaagcgattctcttgcctcagcctcccaagtggctgggattacaggcacctgccactgtgcctggctaattttttttgtatttttagtagagactaggtttcaccatcttggccaggctggtcttgaactcctgacctcatgatccactctcctccaagcctcccaaagtgctgggattacaggcgtgagccactgcgcctggccttatggttcttgaattgattattcttcagtctttatattactgacatagacctttaatttagttacatcaaccaatgacagtgacttttaatccctccctgcccttgtgaaattagaaatggatgtcctgatcttctctttttctccttaactttcttcctggctctacccccagctccgtcagcagtcaggagtggtaatgttgtgttggtacattgtatttctgtaatcatgattaagtcttctaggttttctctatagattgtttttatttttatgacagtattattaagatatacttccacctctttttaaagtagacatttcagtggtttttgataaatttacagagttgtacaaccatcaccacagtcgattttaggacactttcatcaccccaaaagaaaccctgtacccattcacagtcacttcctttctctacccttcctcccagcacttggctaccactaatctactttctgtcaccatggatttgcttagtctggacattaccgagaaatagaatcctataatatgtggtcttttgtgaccggcttctttcatttagcatcatgttttcaaggttcatctgtagtgtgacgtgtatcagtattttactcctttttctggctgaataatattccattgtatgggtatactacattttgtttatccatgtatcagttgatagacattgggttatttccaccttttggcctttgtgtgtagttactgttatgaatgaatatggcacaagtatttgtttgaatatctttttttt

SEQ ID NO: 28600 - DNA, 1033 bp, Homo sapiens
agaggttcttctccctctgggctgaggcagagctgggagactgcatcctaccacggagccctggagtggggtctcagctcactgaaaggattgcagaggtggagggggtgggggtactacgcaggcatgatctgagagccgatcaattgtctgctttcagaggatgttaaacaaagagtgatgattcatcgaagaactctgtgggaggaagtttctttcagctgagcacaatctcagtttcagaatgggcccagggccctttgaggcttggtcctgtcaccaagtatttctttccttaaaggaagacttgggtgtagttggagtgggggcatcctagccttttggaacctagcaaaactgaagtataatatggatgttttctgtttgggaccactttgaattcatgaaagaaagatgaaagggagggggaagtgtctttggttttaagaaaataacacctgtattatttattccagcttctgccccgctagagtatgattttattaaagagcaaaggactctaatgcagttgtgctgggaaaaagatataattgggaggcagtggggctgagtgtccaagcttggaatgggtggagaaactgattggagattgggctatgaggattcagttgcttttccttaaagacccaaaacacgcttctctgtgaccatgaggaagacaggatatcctgccaaaaaatcctggctttgcaaagcctgtttccaaaggagcgttctcctgcctcccttccactgtccctcccaccttgcctgagagctgctaaccttgtaaacataggtcaatccatcaatcctagttcctgctcttggtttcctctgcccactctgcaggggtaataatgagccccagaaagccaccgcgtcatctgggggcagggggaggtcacgatgaggagtgggtcttggaatcctcttcgctaggggaaggggagatgtcaggaccatggaaatggggtgaacaggatttgctacccattgcttgctcaggagggaaggtgggatcgggacaata

SEQ ID NO: 28601 - DNA, 1078 bp, Homo sapiens
taaattgagagattccaatgcttttctgtacctaagtggtgaaccccaagcagaaaatgacaggttgttgaacttgcgtgactcttatatcagtatgagcaaaccctcatgtagataggaaaataaaaccaagaagtcattgttatttcagcagcaccaaccttaccagacttgccacctttggaagaatgaatagaaataatgaatagaaggtgaacagctgaacattgagcattattcaggtcgtgatggcctcgcaagttaaatatcatgctgtgccttgaaaaaggaactgtaacagtaaacttcacatttgtgtatggatctttgttttgtagacattagtgtttatttgatgcacattgcatagtaactgcatgaggcattttaataatatggactaagtgtagcatggagtcaaagagatcttcctctttcctgggttttctaggtcagtgacctcatttttttctagtaataagacggggtgtaaattttctaagtgtgcacctgcagtatgcttagttagcttgaatagttactgatagtgaatgtatttatctcattaggacttagcacactgtgtttctcaaatgtatttggagtgggaagacagcttctaatgaaagctacaggagattttgacatactctttgaaaattggtattaccattactattttatttcccagtttattctggcctctacctgtattagatactttaaaaatgtctttgcaattgcttgccttaggttgttactaggcctcacactgggtttgtgacagagtggcaaactatgaaatttgaagattgtgggttgaattttattttgctttaagcgccacagaacacagctgaaactggagtgccatcttcggtggtgtttacatttttatttttgtcgtcttttaggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcac

SEQ ID NO: 28602 - DNA, 1047 bp, Homo sapiens
attacaggcatttgccaccacacctggctaatttttgtatttttagtagagacggggcttcaccatgctggccaggctcgtatcaaactcctggcctcaagtgatctgcctgccttggcctcccaaagtgctgggattacaggtgtgagccaccgtgcctggcccataaatgtttatacaaccaaaataaatgtatattgtcttacatctatccatccagattattcagtatcaagtttcataggctctgcctactttttttctgagtcttcattcttcagggactttgtgtcctgaagaaacttggatatgtacccaataagctgctgctttgagggacagggattttcttaattttcaccttggatgctatccttatgaaatttttaaatggattgaaaacttcataataaatgccatttaacatgaagatgtgttcttattataaaatatttgctgtctagtcagccaacctgttacttgaaaagcaatactagattctggtagaactgggtttaattctcaactctgttgtttatattcagcagtatggtatttggcatgtaacttcacttataagcttcagtttcctatttgtaaatgtgcaaattccctttcctggctttggcattcctcatgtgttagagttgttttgagggttaaatgagataatatatgttaagtactcagtatgttttttgtcacgtcataagggccgaaaaatgaaaaaccctttgaaaattataagaacttgacccatagttctatgtgtgatctactggatttttcttgtcttccttcctcagtttctcacattaaatctgaatcagataaatctgagctatcatgaaagtgaattgtgtcttcattttctcaatgtgaggggaaaactgtatgctttggtacattcttggctgtgatttaaatggactcccctagttggcaaactcttcagctgaccttctggatatgcccctccagtgcaggttctaagcaaaattcaatgtgtgtcagcactcatttacagaaagctgcctgatctgttca

SEQ ID NO: 28603 - DNA, 1043 bp, Homo sapiens
caacctttatattcaaacctcatgtactattttttcatgtcttgggtttaaagtgttttataactgttagcaaaactataaaagaaatgttaccactgtgttgatttttatttgaaatattgctttcttgtgccttgtttattcattgatgtatacccttagatttgctttcgtaccttaaaccagctataaagcagcagtaaggagtgaaccaaaaatttacagaatgtattcacttgcattattttctgaatctcatcagatgtcttcagaatacatttagtaaggtgtgctagacatatatttgatataaatcagtaactattaagatgactaagattttaatttataatatgactagggcatatgtaagatttctgattccataaggcttatcacctaggacacaacataaaagaaaaaccatcaacacttaagagtggagaaaggacagttacatgcaagtgaacaaagcactgagctggttggtaatcaagagacttgagctccaatcctagttctgctgttcattggcagggtgaggtgggcaagttattgcttccctggcttcagtttttatagatgtaatctttagatccatctacaaaaaaaccagttttttccaacttttatgtatatctttcactatcccagttctctttctggaagtactaatgcagttttctagaatttttaaaatgtatgtgagatttactatttaaacttgtggtgttgtaatatagttcatgaatattttgtgtaatgattttttaatgtaagctacagtgctgctcattatcaaatgtgaatctctttatgattgtaattttattttaagtttgcagtactaccctctgggtggggcagctggacaaaagaactactcagcaggatgttgccagtctcttggaagagtttggtccaattgaatcaattaatgtgagtgtttattcagttttttaagtacgatggacaggtgtgattaatgtcattttatgaaatggaggacctgagaccaaagttacaatttgcccaggtttata

SEQ ID NO: 28604 - DNA, 1304 bp, Homo sapiens
attcctctagtatttaaccttaagtggactggcccataagtttagaaaaaggaattctgtgcttttcttttgactaaaaaggtctgtttcaagcttctcactggaaataatttgtctgtttcagctactttatagatcttcagtttcctaaaaagcaactaaaatttctttttgggtagaccccattttaattttttaattgctttaagtattttaaagcagtattcttcaaactttaaagaacatattaatatgtaataaactgtgaagatcataggttttgttttttataggcgactttgaccagattttaattttggctccaattacttacagactgtcctgttgttgaattaatgtttactgttcagtagtgtaaaataaagatggtagtaaaaatattttattgttgccatgagggttaaataaaaatatgtaaaacagcaaggtacctgggctgtgatggttcctgttcagaaaatactaacttgctcatttgtaagaactttactcacttggcctagaactacaaagaaacataagttagctctatcccaaaacacactttacacttagtttagtcctatatactgtgttgtctaaggacagaacttttcatttgatttagaaatgtgttgttcaataaagcaaaaccagaatctctaggcagaactattatagaatgacaaggttcaggaatttaaggttgaagtctataagcagaatgagcacggcttgaaaggaaagattgcttattgaaagccagagactgagggctttgaagtcaaaaggactagtgtccgcatcctgattctaccattcactgactgtgcaatcttaatcatgtttcttaatcacctgagcctttgtttccttgtctgtaaaaaagaagaaactatctacattgcagtgttcttgtgatgaagtctatatgatctgatacacattagtaggtatttaagcattatcttttttctgaataaatcttacttaaaattgttcttctagatatgtgatctcattaagtctcttgaatttttttttacatgaaagtttctggtaagctgtgaagttatgagaaagaagcaagcgaacctcttaggaactgctagtgacttttttgtgtccttgccattttttttctttttttatattagtatattcttgaggaagcagtatatggacacttttctatatgcattatggtgattgaataagacagtctttttgtacattttatgctgactgaaaatgtatacccattttcatgtgcacaaagttccagacatttttaggctagggaa

SEQ ID NO: 28605 - DNA, 1129 bp, Homo sapiens
aaagaggatttgagttaggtcagtgtctcagctgctctatcgggcctataggtttcttaggcatgtttaagaagctgccactaaggatatggatatgctgaacagcttagagcttctcattgaaatttaaccctaacagctccactcttgtctgttttatttggtttatggctttataaaacatcatttgacttttcagttttcactgcaaaaaaactcaaaagtttgaaaatcagaactgatgcctttggtttcatcatctttaaaatatctgattctttccaacatcctaactataaaaacagaaggactttattgccaatagtctaaattaaaaatccacctagtaaataccagttttcattatatcttagtgatttatgagtgatgactgattaaacaaaagttggatacatttttttgagtaaaaaggaaatatatacttgcagaaaaaaaaaaaaacaaataatacagaaagttataaaataaggaaagaattccacactgcagtttgaacagatttgttcgtgtatattcttgcactcttgtttgcatgcacatacgaacataaactcacatatttggttttcctagttttttgttttatgttgtgattaggaaaactcctcatttgtattagaaaagatttctatattctagtaaggttttttttatgattgtctgttcagtccctctggaatctgttttagaatatggttgaagatagttaaaccattatgtttttgaaaatagccagttctccctcactacttttttatacactaaattcctgtatgtttctgtgtcttatctctggacactgttctatcccactaatatatttgtttatttctgcatcataataattcttgtgacagactgtctttcatttcctggtatcccgtctctccccctcccacttcactctttttcaaactccccctcatactttttcaaactttgttcatttatcatgaagtgtattagtcaagagttccagggaaacagaaccagtaattgaatctacatctgcatctgtctatctagattcttgaatgaaagatagatttatcttaagaaactggctcacgcagttgtagggactagcaaatttgaaatttgcagggca

SEQ ID NO: 28606 - DNA, 1677 bp, Homo sapiens
ctaggggtaagggaaacattaggagctgctaatcaataggtatgacatttcagttaagcaagatgaataggttgtagagatctgctgaacaaccttgtacctatagttaacaattctgtattgtacacttaaaaattggctaagtgagtagatctcatgttaagtgttcttatcacagtaaagtaaaatttttaaaaaataatatgaaaggcgcatcatctttaaagaagatatcgttggaaagatgtgcttgtgtagttgagtaaggaagaaattgtgcagtaggaaaagacagcgatcatctgattgtggttattccagaaagaaagagccaataatagatgttcttccccaacatatagagatactaaagtttaagtggtattcattagcaatcagactacagtatttaattccttatatatacagttggctttacaacatactatataaaagtagaaaaacattacagatatagtagctgactataagtagataggaggaattatactagtaaacatactcagaataatgaagaacggagacatttacaataaacagcatataaatttcagtgtcataggtgctgtttttatattcttggaagaatgctcttgtgggaaaaatacacccaaaaccaagatgattccttgagtaaagataaaagttgtgcccatgaataacatatattctctggatcttcatatttgcttggccacataatttaagttttgactacaggccagttgcttaaatattttagctgttataattactctgaagaaattctccttcatttacttcaagatagcttttttttggggggtcagtgatagtttatttgtaaccataagtaaaataaaatgaaaatgtcaaataataaatttctttttattgtctgggtctatagtccatctctgttccttactctagatgataccactgaagaaagactaattagtttaaccaggttgtaattctgatttttttttttccttgtttatgaaacacacatagtatggaaatattagcctagggagttttcctctcttttttttgtaagagtataatcggttatttatgcaaatatttattgtatatttgtgtttctcatgcgtaacagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggtatggtcagatgtatctgtgagctcacacaatggtatgattttttgcacatgaaacagtcagagtttatgtgtattgaaggaatttttctataagaaggaaacttgagtttacatcttggaaggtatgattttctttccataattcctatttataataaaggtctgctcttctggtagttgttacagtataaactctagtgccacaatctctatattttatactttgttaaattggataaaatgttattttagcaaagaagcttaattaggaaaacttgtaggttaactttttttttaggccttaatgcccttttcttttttaggctcacctccacctccagtaaaagtttcttctgaacctcccacacaagccactccaaactccgtcccagctgtaccacagttgcccagctctg

SEQ ID NO: 28607 - DNA, 1036 bp, Homo sapiens
atgcttatcccttctaaagaagtcttgtatttggaggggctgttgttatttttatgcaggaggatttcatggttttctctggctgctttgacactttttattcattcacagataacattaattgtgaatacaggctataatgttgggggagctctgcacctaacggtgtttattgaatacttgtcctctgcggggtgacatagtacgagtcattccatatacaaaaactcatttagttctaactgaaactgatacctatcaagcagatatcagtatatcctttttacaaatgaggacattatggcttagagaaattaatttgcccagagtcatctgcatggccagacccagattcaaaaccaaatctttctcactctctatagaagaccacaatttctggtttttctcactagtagattttgttggaattatattaaattttgtggcttttagacttgatatataaagctaatagcttttttcctgaggtttgttgactgaaattggatgttggtcataagtaactgaattatctttgaatctgttgtctactctgtgtataatacttatgtgtatctaaacttgattgaaaaacatgaagtttttttctgacatggcagtgcttcttccctgccccccccaccccacccccgctccggtttgcccatgagaaatttattaatggtttgaaggaacctacacattattgaaaggtgactagcagttattttgggccttattttcctcatttctaaaaacaaaataatttttccctgggctgttgtccttcatatttttgaccacagtacacacagtaggaattatgtaattcattcctggatctcaacccacagtttgaaaaacactgctctggattaactccaggattctctctttttctcaaaagaattacgtgtagtactcattaatatctattgtgtatttactctgtgctaggtgttgctctaagtgcttttgtatgtattgtttgtatttaattcttagacttaactaaataaggagggactactgttat

SEQ ID NO: 28608 - DNA, 1947 bp, Homo sapiens
gcctgactaacatggagaaaccccatctctactaaaaatacaaaaaaattagccaggtgtggtggcacatgcctgtaatcccagctacttgggaggctgaggcaggagaatcacttgaacctgggaggcggaggttgtggtgagccgagatcgcgccattgcactccagcctgggcaatgagagtgaaactccatctcaaaaaaatatatatgtgtgtgtgtgtgtgtgtgtgtgtgtgtgtgtgtgtgtgtgtatatatgtgtatatatgtgtatatatgtgtatatgtgtgtgtgtgtgtgtgtgtgtgtgtgtatatatatatatatatggcagcagtttcccaaaaatttttttttttttgcacagtgtatgttgttcattttatccacagggcttcagttattgtaaggatttgtggggggaggggtgtttttaatttaattttttaatttaaaaatttactaattttgaaaggctttattaaagatttgcaagttactgatttaaacatagtaactgagcttcaaagacaagatttactctgtggacaagttatgtgataatggtgattctgtataaccatatttctttatcacttagttatatttataatcaaaagttgaacaaagatgtatctcagacagatacaaattaaagttcatttttaaatccatgaatttaattgttttcatttaaaaattaatgcaagttagataaatttgaattagtagataaaacaatcccatcaaacaccattagcattttagagtatttcctttgtctttttttctcctccacttgtgtttggaattttttatgtagttaccagatctttttaatagcatgaaattctctgtcattttctcaataattattgtggaaaatttgagaatatctaataattgccttagataaatttctagaagtagaattactggttcaaaaggtatggacattttttagttcttgttttatagttttaaatttctcttcggaattaaaactcgtccattagatctcaccagcccagtactctttttgctttatgctagtccacatgcatgtccgttggataatgtaagaattttatctccttgtattaatttgtactttgattattgattggtatggttgaacactttttcctgtgtttgttaattagatattgggattttgtttgttaaatgaattgcttctgtacatttttcagtttcattgtacctcttactgtgtgtatgtaccattgattaactcatacacagtattctgctttcaggtaaagtgacatagtggtacttgtttaacatgtgattggctttctttcctcgccccattatattacctgatattaaaaaagtattaacccagacacacatttagtaaattatatattgaaggcataagatgaaataccaggttaagaaaaggactgtacatgatcccttacctagttgttctagcagtagtgttttatggagttgtcttcaggtttaaattagatggataaagcatctttacaggaaagatgattttaaaacttgtttaaaattatcttttgttaagaaatttagcgtgtgctttgttatacagtgtctatgtgttgctaataaacataaaagttgtgttggatttaactatttggtttaagacagtgtctttgatatattaagttgagtatgaaagaggaggaaagactgtagaactaaatgctttgatatttgcatctaacaggaaggagatttgaatactagcctgtcattgtgagtatatatgtatttcttttaggaaacatttctattttttctttaaattcaacttcacatagtaataggagcttaagggaaaattgctttgtcatcttggaggtcatactaccaaaggaaggaatactggaaataatcagtgtaatccgttacaaagtaaatttaggaaaatacattttt

SEQ ID NO: 28609 - DNA, 1062 bp, Homo sapiens
gtgttcatcccccttctccgggattcacgcacttgggaaatagggctaataaacggagagggggtggctcgttataatttaaagtcgtgaacataaccctcttataggctctatggccccaacgtgacgcctaaaaagttgaatgggagagaagagtattcgctccgccttagtccgctagaaagctggcgttgtcctccagttccctaccctcgcaccccctcccgaggtagttaatcctcggctcccttctacgaggacatttacatgtgaaaacctctccaaactgggaacaaagctgcctgcggccttaaagttctctagttgtttctctgatcattccaggtgttgcttttggagtgtagagtccatacatcctatttgtcagaatcgatttgggaggaggagacttgaccattgatgatttaaaatgcagttacagaatgggaactattgtcatgggttgagttgtattgtcttccctttccaaataccaaagataaagcaacattgaaaaatcaaatgttgtagttcgagatgtgtggatgtggcgttaaaaacgtgctgcatctcacagattttgtaggtttacttgtaacaattatggtgcaataactttcctttagatttgcagtgccataatatatgggactttccaattacactgcagttgagacaatttattgccatataaattatcctaaaagtgattttcttcaattgatgggtacataaaatgccctaactgcagaagttgcaactggtattggacagtgtcttgtaaaagttcagttgtgatgattttcaaaacaataaaaataatatgtcctagtttttgatcgccagagaatttgtgataatgctccaaacatttcagggttggaagctgattgttttctgaaggtagaattcactggcatgttggctcctggctccatgagggcaggaagtttcagttcttttccccgcttctctaccaatcaaaacaggtgcctcgcaaataattgttgaatgagaatttaaacaaatggcacaacaatagttaaaatatttcaagtacat

SEQ ID NO: 28610 - DNA, 1050 bp, Homo sapiens
tgcccctgactgaattccatgttgtcctgctgtcagtggcctgccagtgtctgctggtgtccgttgcgtgatcttctgcttctctcaacgtccagctgcttgtgtctgtgcccgctagggtctcagggtttttatgggcacaggatcgggggtgaagtggttaggagtagtcttggacaatgcaacatttgggcgtggaaacaggagtgctggttatcacttaggtccatgggcacaagaccgagggtggagccctcaccaggagccctgcccttctctacccagcacttccctgcccccctcccgtatcaaaaccaccaccatctcttgcttgggcttctcaagagtctcctcactggtcttggcccactcccatctccttcacagccggactgagctgctggaaactttcatctcattgggccacccctctgcataaaacacttggcttccccatgtcctaaggacagagattaaaattcccttccttgctttctgcctgtagtcgatccttgaaagcttccacatccttcctgctttgggggtctccctacgggctgttttctctaactggaaagccccttttcctattagacctcagggctcagtctcaagctcactctcttcctcttcacatgaggccattacctgccatcacctgtcacaccacctgcactctgccttctcagcctttattacagattataatgcagttggtgttggtatttgcttcctgactatttcccctgctgtaagctgcatgaaatcagggtttgtgtctatttgcccatcattatcccagcacctagctcactgttagtgcctagtaagcactcctaagtaactgttgagagaatgacaaaacaggaaagcaagcctccattgtatcagattttgggagttgcaatttagcccttaggcaaatctaacagaattctagacaggatgtagtctatgttagtttcctgtggctcccgtgacaaattacctcatgctgtgtggcttaaacaagagatatttattctctgacggttttggaggccagaaatc

SEQ ID NO: 28611 - DNA, 1903 bp, Homo sapiens
tttaattttgatgaagtatgatttatcttttttttgttatgctttggtgtcataatcaagaaagtactgcctgacctaaagtcacaaagatttaccccaacagttttctcctaacagtttcatagttttataggtttagctcccacatttaggttgatgatccattttgagttaattttggctatggtgtgaggttggaatctaacttctgttgtctttatatggataaccagttgtcccaacaccatttgttgaaaagacaatttccctattggattgtgttagactcttgtcaaaaataaatttgccataaatatgaaggtttatttttgaactcccaattctattccattgatattttggtctatccttatgccagtatcatgctgttttattgttaagttttgaggctgggatttgtaagtgctccaactttgttctttttaaagattgttttgattattcttggtcctttgcatttccatatgaattttaggatcatcttgttagtctctgttaaaaaaaaaaaaggaaaggaaaaagaaaaggaaaaaaaacgcatctgggattttgatagcaattcctttgaagctatacatcaatttggtttttaaaaattgtatattcttagggtgtacaacatgatgttttgatatacatagtgaagtgttactatagtcaaatggaatattattcacagtttctttatccattcatctgttgacagacacttaggatgttaccatatcttggctattgtgaataatgctgcaatgaacacggaagcacggatatctctatgaagcactgattttgtttcctttgggtatatgcccagaaaaaggattattgtatcctatgatagatctatttttaatttttagaagaatctacatactattttccatgaaggttgcagcaatttatattcctatcaacagagtacaagggtttcattttctctacaccctcaccaacacttgttatcatgtgtctttttgataatagccatcctaaaaggtgtgaggtgatatctccttgtggctttaatttgtacttctctgttgattagtgaaattgagtgccttttcatataccttttggccatttttatgtcttcttcagagaaatggctattcaagtcctttgcccattttaaaataagcttgttttcttgctactaagttccatagaccaatataggggagtcttgtccttctggcagtatgaagttttctgatccatgaacatgggatggtatctttgcatgtttttaggtcttctcttatttgtttcaacaatgttttctagttctcagtttgcaaatcttgtacaatcatgtgccgtataacaatgtttcagtcaattgtggactggatgtatgacagtgatcccataagattataatactgtatatttactgtagcttttctgtgtttagagggttagatacacaagtacttataattgtattaaaattgcctacagtattcagtcaagtaatgtgctatataggtttgtagcctaggagcaataggctataccatatagcctagttgtgtagcaggctacaccatctaggtttgtgtaagtacactctatgatgtgcatacaatgatgaaattgtcttaaagacatttctcagaatgtgtccctgtcattaagtgaaacataactgtacttgttttgttaaatttgtttctaagtattttattctttttggtgctattatagatagaattgtttataaaatgtttttcaaacagtttattgtcagtgtatagaactacaattgaattttgtatattgatcttgtagactatcttgttgaattcaactttgatgaattcatttattagttctgacagttttatttgcagattcattaggatctttttataca

SEQ ID NO: 28612 - DNA, 1044 bp, Homo sapiens
tggaagcctgagtaggatggggactgggtgcctatatgaatcttccgggctgccccaacaagataccacagattgaggggctgaaacaactgggctttgtttagacacagccgtgtagcttggaagtccaagatcgaggtgcgggcagagttggtttcttctgaggcctctctccttggcttgcgggtggccactttctccctgtgtcttcacacatttttcctccatgtatgggtctatgtcctaatctcctctttttatgaggactgtggtcagattaaggcctaccctaacggcctcattttaacttaattacctctttcataaccctacatccgaatatggttacctcaggagatccaggggttaggactttaacatatgaattttttgtggcccacaattcagcccaaaacaatgtcctccaactgacaggcttgttaggaagacattcccaaaggggtccactctagccatgtcactagccttgcaacaggaacatggcaggctctcttcaaattttggtactcttttcttctctctgcaaagcactagctctctgccactaaggaactccttttccccaagggagatgatgcctggagctgtgaaacaaatcctgagccacgggatgagtgtagacttgagactccagagtttgggatcctggtccagatcatgccactgcttaccaagtaggtaagagatgtcatcgtttgggtcagtttctcatggatgaaatggggtgggtaggtagaggcaagtgggcccaatgatcccatgattcagtgattctaaatcttgccttggttaaggacagagcgccaaagtgaagggtaaataattggtgttgacgagagttgctgggaaagccttcatgcttgctcaaaatggagtgtttcccataatctgcgtttgggttggagccagtcatcatctatgactgactgaattttttttggtcagaagcaactcgtctctttttcttctgacaataaaataaaataaagttccgcccttcagagccaaagcagcacatatttt

SEQ ID NO: 28613 - DNA, 1035 bp, Homo sapiens
gcctcctgggttcaagcggttcttgggcctcagcctcccaagtagctgggactacaggcgcgtgccaccacgcctggctaattcttgtatttttataatagtagagacagggtttcaccatgttggccaggctggtctcaaactcctggcctcaagtgacccgcccgcctcagcctgccaaagtgctgggattacaggcgtgagccactgtgtccagtctcattctaagactttagggattacagccacattctccacctctcctggagaaaacccaaaatacctgaaacaaatgacttaaaattttatataagtagttgatgttatgtacatctattttgctctccccagataggataaataactgggcagttgcttgccagtgaacacccagagacaatttgttagcaatgacttttgaactaagggagaataacttattttttgatctaatctgacatattttgggtattgatcattaatttttttagtgagagctgagttctatctgtaggctaattcactatttaggcagctaatcacgagggcacgagtgcagtcatggccagtctatagagttgtagtttctttgggatagtcacacctgtttaaatcccagtgataagctcgaaggtagagaagggaggggagtttgggatgaggaatggatgtgctggggcctagagttttattggcctaaatgtgatttcaaatagaactggcctcatttcattcaagttggctctgtggacctctactaattagcttaacaaaattaaatgaactctataactctttttttccctgaacaattaccaccatggtttttagttcttctcttatctaattttaaggcagagatggacaaggtgacccttcaagggctcttcaaccttctaattcacgtaaccctgaaaggaaatgagaaatgttgaaaggggggaagtgagaccatgaaccaactgtgtggatctgaggaaatgggataattgaggtctctccaggatgtcgtcactttcacgtttctctccatta

SEQ ID NO: 28614 - DNA, 1030 bp, Homo sapiens
tgaagcaacatagtgagacgtcgtctctacaaaaaaaaaaagaaaaaaaaaattagccaggcatgcgaaacgctgaggtgggaggatcagatgagcttgggaggttgaggctgcagtgagccttggtcatgccactactgtgttctagtctgggcaacagagtgagaccttctctcaaaaaaaaaacccaaaattgtagaattacttctatagctatattttatgataaagaagtgattgtttctcaaaatcgcattttaaagacgttttatggtacttgttggaattgggacttaggagttttgattttgataagaaactgggataattttctgaactttttttcctctgtatcacatttatttactatttttaaaaactttgacatttaacacttgggacaacatttattataaatgataagaaaaatcttagaggtttgtctacccacagtgtcatggaatcttctctgaaaactaatccataaagttccctggagaaattggtcagaatgatctgtcagaaccatttgaaaacttgctcaagagcagttgcttatatatagtaggattttactttttcctgcttatgtactactatatgcttaaaaaacctggaggaatacttaccaaagaggagtaaccatctctgagggtgggattctgggggaatttttgtttttttctgttttctataatgtgaaacttttgtagtatgtatttttctaattgaagagaataaagattaaaacaaagtgctttaagattgatttttacaaactgaattgtatttaactgagatcagaaatcctggtgctgtgaaatccacacattactgagcatggcagtgtggaaggcctgctcaggaatataaaggtaaccccaaatttccccagacccctttgtttctgggtgtgagtgaggtcacggaacagtactcagtggtatgagtaactcagcgtttgctccgaagttccctgattacttgtgagaatactaaagttctcagagcaaaaggtcctaagtcacat

SEQ ID NO: 28615 - DNA, 1080 bp, Homo sapiens
ttttcccatggcgctctggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtcagttgggtcgagccgggcagggggggcgtggggtcgccttcttccaggggtgccgcgcgtgggcggcccgggaggaggcgggggctccttggggctgcccagggactttaagagcaaaaagtctgagagtgtgagctgtggcaggaaaaggggaggagggtcacccctccactttggctctcgggcggtgggttcttttctggggtccccgatcccagaagagcagtggttgaatcagcatcatcgtgagcattactcagaaacaaagggcgacaaagaataacacttttaaagaccctaaaaaaagagaaacaaatggtcaactagactgtaagcacttgaggtgcagccagtactattactccccatagaaattagcaggctgttggtgtatcagcggatgcctctacagcctccagtgatagagccgcagagttgacggaacacagtgctatagggaagaaagggaaggaaacttgcaataaaagcaccaacaaccccatgaaaactggcgaggaaggaggatgtagcaaaagagttcagaagaaggcaggaattagtttctaatcctggttctagcagttacctcttacctctgttgttccactgttccctcattttgatgtttttgcagtatttagggataaagtggttcacatattttttatgaattggtgtaagaatggctgttgtttttggattg

SEQ ID NO: 28616 - DNA, 1052 bp, Homo sapiens
ggtgagaatgtagtttaggaagcaaccacaaccacaaactacgaggtcatctttttcaagcatctcattttgtcctcccataaatatgatgattttgtggttagctgaggttttgttttgttttttatttttttgagacaggatctcattctgtcacccaggctggagtgcaatagcataatcacagcttactgcagcctcgacctcccaagcccaacccatcctcctgcctcagcctcacaagcaactgggactacaggggcgcaccaccatgcctggctaattttgaaatctttgtagagacagggtctctctatgttgcccaggttgttctcaaactcctgggctcaagtgactctctcgcttcagcctcccaaagtgccggggttacaggcatgagccaccatggctagccttgtttttatattcataatattaatacaaacacacttgtgcctatagaggaattcattttgcatcagccaacttctccatgatgtgcaggaggcatcatgcctacaaaccatgatattctgaaggaccatgaaaatgtttcaatttttttaatcaagagcaataaatgaacttacaggtctaaaaatgttttatgatatcattttaatataatcatcttcatagcaatgtgactataaaatgaaatttttattaactgttttatggagagaaaggcctactaaggcaaaaatagggcccctgaaagtcaccacgcagctcggccttgtattccttctttcctggggcatcctatcatagaatttaagtattgacaataggaacccaaagtctgagacaagatgatcctttgaatccccaagtaactagccacttacttaaagaactcatgtggattgtatcaatgttgtaccagagatattatgcttgaaaacaacagtccaggaaggtcaggcttggctctacaaaagtagaaggggcaaagtatggtgaggcatgcctgtagttccagctacttgggaggctgaggcaggaggatcgcttgaggccaggagttcgagaccagcctgggcaacata

SEQ ID NO: 28617 - DNA, 1070 bp, Homo sapiens
gtctgtgtgtgggatcccttcccattcacgctccaccctgctcttgaccatggtgaacttgtatggattacatcaatatgctacgtgccctgtggattctggctggatatgggcaatggcgagttccagcaggaaactggagggacagaagagagcgaggtcagagaatttaatctcctgcctccctccctatgaggtcaccccagctggtgactgtgaccctggatggaaggtgattgtctcaaggtggtctgctcttcgcaactctccttctttctggtaacctcgcccagcatccctctaggtcgagggaggggtggtgttggcctcattgcttttaacctggattcctgtaccatccctcatggttctctcctacaaacctttgcaaagaatccctccccacacgagcagaattttagtgcatgctctctgtgttcttctaaggtcctcttagggaatagacaattctgtaggcactttcattgcaaacagaatcccagtgaagaaatggtagcgtcagtccaagatactaatcaacatggcaatcttcactacaggatgagaactgttttccctttgccccaggtaggacataggccgccttagccttccctgcctcaggtggggaaggggctgtggctggccctgctctttcccacctcacctgttccctgcggttttcatttctgcctagcctgagatggggaaagtgggggataggacagttttcactttgatatggtttggctctgtgttcccacccaaatctcatcttgaattgcaatctccatgtgttgagggaggggcgtggtgggagtaattggatcatgggggcagttcccccaggctgttctcatgatagtgagttctcacgagatctggtggttttaaagtgtggcacctccccttggcttgctctctctctctcctgctgccacgtaagacgtgctttgcttcccctttgtcttccgccatgattgcaagtttcctgaggcctccccaagccatgcagaactgtgagtcagttaaacctctttcctttataagttacccagtctcaagtagtt

SEQ ID NO: 28618 - DNA, 1050 bp, Homo sapiens
ttagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgc

SEQ ID NO: 28619 - DNA, 1072 bp, Homo sapiens
aaaaaaaaaaagaaaaaaagaaaagaaaataataataacaaaaaaataagcggggaagggattagatggcagtccaaacaccagtattattcagaggaggagatttccagcatttcaatgttgcctggaaggctctctcctcttctggtattcagtgtgtctgccccaccatgccatgtgtttcagggttgttttcttgcagaagcgctggtggacctgatgctgacggtggtggagatgtgcccctctgtctgtgagagcagccactttgcagtgcttctcggggcctatggcgccactctcagcgtcctaggtgagggtgtgagggctgggtagtgtgagcagggggagggagtgagggccgggggtgtgagcagagatagggaatgagagctggagggatgtgagcaggaggagacagtgagaccaggcggtgcaagcagggtgaagatatgaggaccgggccatttgagcagggagggtatgagggcaggtggtgggagcagcaggagggtgtcaggggttcatcttcctaaaccgatcctgctttgacttgtagatcagaagattttacttctgcttcgagcgtatgagcagaacaagctcagcctcatcaacttcaggtgagtgttgggctagaggtagactaggccttgaggtcacagcctgctctccacacagtgagctccagactcgagattttctctcattccattttggttctcagggaaagagtgaggcaggcagcactcccctgactcacactggcttctgcatagggtgctctggggaagcttggccttatgccataaggcatctgggcagggccactgcagctgactgatgggtgcctgtctgtctggaattgcccctgttgtgcactgtcagctggactggggtgtctcatttggttgatttttctgaaaacttttctgctcatgcctttaggtagattgacttatgccatagggatttcaggggaagtgtcagggggctcaactgtacataaaatctctttttttttgtctgtatgtgcatgcatgcttgtgtctgtgtgtgcatgcgtgtatgt

SEQ ID NO: 28620 - DNA, 1035 bp, Homo sapiens
gaaggtgaactgcatggccatttttaaaccctagaaattcaggttctgggatgtgggttagtttccagtgtctgacacaactctgaagatggagaaaggtggagtaattctccccagtaccctgtctcccttcagtctccctactttgtggcttgaggcacagcccattgtgccccatcaggtctgagttcccccacatgaagctggcgggagttgggtacagtagcgggggttatttagggctgtcctgttacgttgaaggagttcttgggtgccaatccatcccatgtcccagggttccctgccctctggggagatgttgatgagttgatgttgagtcgaggcagcctgggttcagctctctcttctgtctccactcactgggtttcagagctgaggcacttttcaattaccccaaatttaatgtaattcccttttgttgaatgcatgggtgatttttactcaccactttgcctctgttttgcataacttcctatcattgatgacagaggttttaaaaagtaagacagtgccctgcaagtcttctagtcatagtccatttaacattggtataacggaagacctgaggatgagtgatttataaagaaaagaggcttatttggcccatgcgtctgcaggctgtacaggaagcaaggagctagcgtctgcttcttgtgagggcctcaggctgcttccactcatggtggaagaaaaagcggagccagctctgcagagatcacacggccagaggggaagcaagaggcacaggaggtggcaggctctttttaacacctggcactctgggaactaatagggtgagccagaactcattcactctaccacaaggactgcaccaagccattcatgagggacctgcctccatgacccaaacacctcccattagaccccacctccaacactggagatcacatttcaacatgagatttggaggggacagacatccaaaccatagcagctaccctccctattccatggctttgaagaatgaatcccatatgaattgagaaccttggc

SEQ ID NO: 28621 - DNA, 1034 bp, Homo sapiens
atgaggtaaggacctggcagcatactgtgtgttcagcaagtgatggctcctgctacgttatgttttgttttttgtttttggagatgaagtctcactctgttgcccaggctggagtgcagtggcgtcatctggactcactgcaacatctgcctcctgggttcaagtgattctcctgcctcagcctcccaagtagctgggactataggcatgcaccactatgactggctaatttttgtattttttagtagagacagggtttcgccatgttggccaggctcgtctccaacgcgtgacctcaggtgatctgcccactttggcctcccaaagtgctgagattacaggtgtaagccaccacgcctggccccatggtatgtttctaatatataactatatattaaaattatatatgtaattatatatactaaaaatacgtaatattgtttaaactctaggaaggcccagatgcagaaattattggaggtgaacgatcagtattttacttactaatgaaaatgtttgtgaccagtagccatttacaactgaagtcattgaccaaacttctgatcatgaaggtgagcattttctaccagtttctaactctgaaaagcattttgtatagatcttccttatggtaagtgtttagttaacagttattgaattcaggaggtattggaattgtttttagttttaaaatagaaggttttatggcagtttaatttattgtgtcttacacttagctacattcctgggaggcagcctggtgcattggaaaaatgttttttttttttttttttaggtaggtcatttctagcttgttgtaggctcaatactaaattttggcttcttggtgtttattaggcagtgcctctttcctccttctcaggctctggcgttatccagggctttcagcctttttgccagaatccatcacccacagcacatgggtcatcaaagccagtggaagagaataggaatttatttccttatcttgttttgtccttgatactcatgtttccagagctatgtcaggtctt

SEQ ID NO: 28622 - DNA, 1368 bp, Homo sapiens
ctgttttctcaccactcttccctctccttcttacacgcactcctctagactcgcacccccctccctgttttttgcatcttgttaatgtgttcagttcatttgtctccctttgtggttgactacaactaatgttctgcttctttttcccatttagattttgccagacctgaacactgtcgtgtgggtctggcagtcacttaaaaagcaagagaccaaacaggatgacaagaaagggcagaaaaggagcgatgggcccccggctgcctgcgatgctcaccagtgcggtaaggtctcaggggtgagggggaccctctgccttttgcatgggacagagctgacactggcagcctaggatagctcctatccagagagtcctggagcagtttttgtttcaaggcacctctggctgtgaatgtgtctatatccttttttgcttagggagaagaattggaaaggaatcatagattgaattttagtatctgttagaaacgtgcccatctttatgcgagcactgtgtctctctgaagacttgagtgttgggtgccatgtgctctggcctttccagggatgacagtatgggggtgctgtctcttggtttgcagatagagctcagagccttgttgttggtcaggcattgaggtttgtgtcttatgtctgtatcgtatttcatcctttcggcagccctgcaagggtaggccctgctgtatgtccctgttgctcagatgaagacacgaaagcacagggagacagagtgaccagaacctgtctaaggtcacagcagtgaaatgaggttttaacccagaccccctgaacagttttaacgttttaccacattgactcattagatctaggtactgagcagtctgtctgcagcctcggtgtacagcatgcagttggctgcagtgtggtgccacacttggttcagctgctcaaggacaaagaaccagtatgttttctaattcaagctattttctttctttctttctttctttctttctttctttctttctttcttttttctctttttctttctttttcttttttttgtgcagatgatgcagaaaccattcttttgaaagctgttttgctccaggtcatatgcctctaccagaaggtggtcccccacgtggtcatgcagtacaactttgacttcagcaagctcctgaaaggtgggtttcaaggtcttgcagacaagccgccactgttgctgccaataaaccagagcagagccctgcagccaagaatcaggaaggctggtggacggttggctgcgtgctcatccgtcagcctgagaaattgtacttgcatcagtattttttaaatagctggtcttccttaagtaaatatcagatgaacacctggtagcag

SEQ ID NO: 28623 - DNA, 1300 bp, Homo sapiens
acgtcaccatgagctctcagggtgctttgaccattttctgctgacctctccccatgtgtctttctctaacagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaaggtaaaaaaacatgatatttaaaagtctgttagctaagctgggcgtggtggctcatgcctgtaatcccagcacttcgggaggccgaggcaggcggattacctgaggtcaggagtttgagaccagcctggccaacgtgacgaaacctgtctcttactaaaaatacaaaaattaactgggtgtggtggtgtgcgcctgtaatcccaggtacttgggagcctgagacaggagaattacttgaacctgggaggcggaggttgcagtgagctgagatcgcgccactgcactccagcctgggtgacagagcgagactccatctcaaaaaaataagtctgttagctaggtaggggggcatagggagttaggggacaggcagacattctcatctggtaaactatacaatatgaagacctttcagggataaaaagggatattttagaccatgtaaatttggtgtccttatcttctatagcgttttgcctttcactgagctgaatttgaggtttatttagaatcttttgagccaatttatcctgttcatcaagattttgcttagagtgaaatcttgttgagtctcagcacagttagactgggattgatgagttgcccgattatctcttctccatctgggctcataaaaagtaaaataaaatgaaatgtctgacttgtaggatagtttttaaaggttgctgcttcaattagaacaacttgaaataagctgtggaacgttggtctgctggtttaagtggatgtgcgttaccttccttttgatcataatgtcagcatctgcccattttacaagtagaggtacctactgttctttggcagtaatgcctgacttgtttgaactctctgtcactgattcatggtttgcctagtggtaaaatacctgggattgtttcttgtgcctctacctgggcctggcattatctataaaaccagcttttattctgcttgagtgcctatgcgcacagtctccacatttacccttgggatgaggaggatgtactccaccccttgttttggtacagacag

SEQ ID NO: 28624 - DNA, 1082 bp, Homo sapiens
tcctgggtactggtgatcctgccacctcagcctcttaggtacctaagactacagtaagactacaggtgcgcaccaccatacccagctaatttttaaatttttttttggagacagggtcttgctatattgcccaggctggtcttgaactcctggcctcaagggatcctcccaccttggcctcctgtagtgctgggcttacaggcatgagccactctgcctggcttcttgatttcttatgtcatggaagtggttatttctaccggaaacttgtatagttaaaaaaaaaaaacttgaaaaagtaaatggcattgtttgctgtaccacctaaacagtaatattctctcgtctattctcattttcaaaatatttttgaatttaatgctttgaaacttttactttcagaatttattccttgcatttttagctcagggataaaggaagataggatctctaccatcaatattttattatccacactgaaaacaaaggtatgtgcttggtgatccgcgtttctgttgtctgttttcccttgggaatggagatattctccggtgttttacaggactgtagagctacaacatcttatcttacatagattgttgtattggttgagtggaaaactcttccctaagcagaaacttgttcttgttgatgagcatatcctgggactagaaggttaaagaatagctgaagcagccagtgatgtccagacatggctgctgttttattacagcagcagaaaagctgctggtcaacatttcacagcaacccaaagtaatcattgtgagctgtaaattataaataatacttcattcacatatctagcaaaatgttgttctgtgtcatgttccatattctgccttttgcaagcatcttattgatattttaaaacttgctaaaaagatcactgcctttaatacagaaacactttaaatcatcagtaagaaaaactatgaccctcccaacatgacaagttgtccagagtccacatgaaaatggctaataagcatgaaaggactttattttcgaagtattttaaagagtgattctcaaatgggggcaattttgccttctacgggaca

SEQ ID NO: 28625 - DNA, 1089 bp, Homo sapiens
aggagcagtcccatgtcctggccggaactctgggagttattgaggaggagtagcagggtgctgtactcagggtgtttgggtctccagcccttcttctccctcccaggatgggagatctggactgcccctggaacgtgactgccgggacgatttaggaggagagtgcaggtggcggtcaccctgtatgtggtcagcctggtctgtgtggggcgctctattgctgctgtggtggagcagcatgagagtggagatgtggtctctgcataatgcagcggacagatttttttttttcctacttgttaccaggcactaggttcaggatatcttgctgctgccagggccagtagtttcttcaaattcccgtgggccatttcagctgtctggccttttattcagtgacagttggtaccatttacactgttgaagggggctggaacatactacagtttaatgtttctgctgggaagtttggctgtacacatcaaaacttttaaggtgcttatgcatgggtttggatttatgatgggcccgtccccctggacctctcatagtaccccatgccagagcaaactgtagccctgaaccattgcctggcctctgttcccgtaggctgctggcactgaagtgggttgcacaatagataaagaaaaaagataaaaaaacttttaagatacttgatcctgcaattccatgtctagtcatttatcccagtgaaataattaaagatgtgagtagaggttttgttagggaataatatttatattagctggaaatgggtcttctaactatccaccagtaagggattggctgagcaaattggggactggtcataagatggaatgcagcgattaaaaatactctggaggctggccgtcgtggctcacacctgtaatcccagcattttgggagttggaggctggaggattgcttgagcccgggagttcttgagaccatcctggacaacatagtgagattctgtctctaccaaaacaaacaaacaaacaaacaaacaaaacaaaagttagctgggtgtgttggcgtgtacctgttgtctcagctacttgggaagctgaggtgggagaattgctt

SEQ ID NO: 28626 - DNA, 1019 bp, Homo sapiens
cgttattttgaatctttatgcttttttttttctttttccttaaaaaaagagcatgtctttttccttctttttttctggtttggggatagcaaataacacaagcagcttgcagctggctttgtggtgaggcggctctgtgcttctgctgttgttgacgtgtccgatttcctctggttccctgtgcaggttggctcgcgcctgcctgagcctgatgaccgccatggtgacccagggtccggaagctgccagggacgtctgcagccattttgatttgaataaaaagaccctgtacaccctggtgaccaagagggattcaaaggtgaggggaccacagtgtctcgtgccttccatgggtctccttcccttggaggactgtagtggtttttcctccattctctgcccctgatccccacacagatgaaatgagaggtgtctatgtagaaaggtgtgtgtcagcagccacaggatctgtctgtgaggacaggactcgcttcaggctggcgatagggccagaacctggcagagcctgaacaatggggatatctgaggaggctcctgggggctgagtggcacagggccttcctggttgtgaggatgacttagctgtgggcatctcctctcctggtaaatgaaataccctccatgtgcccatggccctgaagcttgtagtgtgtgccagtcctctgttcctgttctgcccacctcggagaaagcccttgaagctctaagccagtgacgtcctcagagaggacttttatggctttttaataagtgacttttgcctcccagttacaatcttgtgatgggtaagggttggattgtgcccaggaaaaatgggagtgtggatggttggttttcaggaaacctgtgaaacaaaaattccctggtggcttttgaaatttcacttgggtttggaaaggttcttggggagcaggcacacttggaggactcctgagcttgagagagggcatcctcccatcgcgtgtgctggctccaggttgtctgtcgtagggcctctt

SEQ ID NO: 28627 - DNA, 1063 bp, Homo sapiens
aggccgaatgtgactggattttcactgctgctgctgaggacacccggggggctgcttatgttttgagggtttaccttgacctaagtgtgatgctggatgctttatgtgtaaattagcctttttacgcttcatacaaaccctgtcaggtaggttctgttcttgttccgttatacaggtgaggtacccagagctcagagttcagtgccttactgagtaccatgcagctagtaagtgactgagcggggatttgtgcccaggagtctggctccaattttgttcttttctggtatgtttttggtgtaatggcgtgctcatgcgtccccggcagatgtggcttagcagcgtcaggacttgaatctgagacacgcagaattgctgtccaagaggaagcatgtgttggtcctctctgctcagctagtggagctcacctgcagtaccaagccctgttctgggcctcatgcttcaagggaacatagagagtgacctgaacacagaaggatctcgaaactctcatttctggagagaggttaaaggaagtgtttggtgttcagaggtgctgactagggtgatggcagctggtgtgggaaagaaggattagatccattgcctgtggccccaaggcagagaaggaaggaccccttagggatgcccagacactccctaaagcagaccacgctattctgatgtgtctatgaagactgtagtgtatttcttaaagtttgtggcattttacattttactgtattggtcattactaagtgggttttaatagaaatatttagtcccttcctctgctttttttttttttttttttgaataaggtgaagtcttcactccccagaagagatgaaggcctcagtaagatgtgttacctttagcttacgctctcatgcggcttccaacccactgccatgccctgccttcctagttttgagaagtatggcccaaagagtggaaccagagagaggcagggttttttttgttttgttttgtttttgagacggagtctcactctgttgccaggctagagtgcagtggcacgatctcgactcactgcaacttc

SEQ ID NO: 28628 - DNA, 1166 bp, Homo sapiens
atccagaatctacaatgaactcaaacaaatttacaagaaaaaaaaaaaccccatcaaaaagtgggcaaaggatatgaacagacacttctcaaaagaagacatttatgcagccaaaagacacatgaaaaaatgctcatcatcactggccatcagaggaagtggcttttcaaaaggattgtaggatgggacagggacaggaaccttactggcagaagaaagagcacgtttaattgttaaaaagatgtagtatctatatttcatggtcttgcacagagagcctcatgacattcaggtgctacatcatttgaacacatgtcagaaggagacccaggttgacagggcatgggtgtaggtgagtagttgaaagatggggcaaagctgagtcaatgggtgaaagtgtggatcccttgtttgaggctgtgttgaacttgtgtttgaatctggtctgtatcttggattctctcctcctctcttcctctttatacgctctcataacctatgataggattgctggaagatcagggaagtgaagttgatggctgttaggagactttgttttcaccaggcatgtgagggaagggttctgatgatgctcccttcgtgtagtggaggaacaagagctgccaggttagattggtaaggactgaggatattccagagtggatcagtgtcagcctgtgggaagatcccccatcaagaagggtttggctctaagccagttcctttgaaagtgtttgcccacgactccactggtgatagagaaaaggccatactgtaagagagtacactaatggttaaactcttgatctccttctccccacattgcttctggtttccccactgcataagtggtaattctgattagctggatgttcctgccagaaccctccgtctgcatcagtctgtcccctggccttggtggttgattctcctcctgagaatttctggaatctgtctgctccccctctttccttcatcatcattctagtccaggcatcatcagtccctgctgggaccgtggctggagttgcccagagttggtctctcttgctgttgcttccctgcagcccgtgctgtgtgcagcagtcaaatgatccttcagagctccaaatctgattatgtcactcctctcatgacacccttcagtggtatcccactgcccttag

SEQ ID NO: 28629 - DNA, 1148 bp, Homo sapiens
tgcacccactttggaaggactgtgatgaaatgatgctgatgggagggtaggaaaaggtcagtctattcagaaggtaaccaaaatggcagcaatgaccccatgaactttcaagaaaggttaggcaaattgtggtactttttttttctggccttgctcctccctacccccaacacccttgcaggcgaagtccccagcctggccccatccctgtactctggccagccctggtgctggagcctgcctcagctctgctccctagctgggtggtcttgggcaactttgttaccctctctgaggctgagttctcatctgcaaatgagactggtcctgatctcacagagttgctacgaggatgaaatcagataaaactgagttcaattaacttttaccctcttcctttctgtttcttccctgaaactgctgctaggctcccctttccaataaagcacctgggagaccaaagccatcaataacagggaccacttgtgggccgagactcttctctgccataaaaagagccggcagaaaacttttcagatgtagtcactttccatggaaacagatgagcagattcagacactggctattcatctctcttcttctgtggcctctagacaactccttcggacatttggtttgtttttctttagttacgagctggcttttcactccataaatttttttaaagtaaagataaatcttgaataaaaaggatgatgtgactgaggcatcatgaaatgcagagggaagggtgtgtgcatgcgtgtgtttgcatggctgtgcatgcacaggtgtctgtgttgcgaggtgctgatatgctggggaaatacagtcctggtctccctggtgatgagccctagggtagggggtgaaggggacacccagccacactctgtgcccttggatgacctgatgcatgggcagaaggtcaccctcccctctgaactccagaggtgtcctcaactctagctgcatattagaattgcctggggagctttcaaaaagagatcagtgactggctctcccagggccaattacatcagaagtcttggggtgcagcctgaatgtccatagatatttttttagtctccccaggagattttattgtgctgccaggactgagacccaatgcttatctgaaagcaaat

SEQ ID NO: 28630 - DNA, 1014 bp, Homo sapiens
tctaccttctggactcaagcgattctcttgcctcagcctcctgagtagctgggattacaggcatgtgccatcacacctggctaattttttgtatttttaataaagacgggttttctccatgttggtcaggctggtctcaaacttccgacctcaggtgatctgcccgcctcggcctcccaaagtgctgggattacaggtgtgagccactgcgcctggcccaatgaacagctcttgaatgaatgacacagtgaagaagactactagagcaagagcagatcaaaagtgaataattgagtagtaggttctaattaatcctcatcagcaaccaacataacccagggcttatagatttctctgtgtgatatgctacacacacatctacggaaagagagagagatcatcaaccaattttaaaaagttaattggttgacatctgtcaaccaattttaaaaagttactctaaatgtgctgcgttggtcttgtattacaatccttagattacactactattttatttcaaacaggactggtagaaacttcttcatgccttttcaaccaaaggccttcaatcctataaaaatgaacaccttgttctttgaccaagtaccaaccttagaaagttatgcagcgaacaccatctgacttagattaatttaaaagtaactggatcaatccccctttaccccaagcaactaaacggaacaattttcttttcttttcttcgggacacagcgtaatcctcaaactgcagagccacttggcgatgaagccaggatcacagtgcatttgataacttaatgcaactttttactagcacttaaaactcagatatgaaatctatacttgatcttttctgcttggaattggccagattagtggttctgccctcacatacaacaaaaggctctcagaaacactcagggtcgctaaccaatcggaaggaccaacagagctcgacaaacagacaggagggtggaagggcaccgcctcccatcccacccgcttagacagcct

SEQ ID NO: 28631 - DNA, 1062 bp, Homo sapiens
gctgggactacaggcacgtgccaccacacctggctatttttttatttttagtagagacggggtttcaccatgttggccaggctggtctcgaactcctgacctcaggtgatcctcccgcctcagcctcccaaagtgctgggattacaggtgtaagccaccacacccagctggatgtagactcttttttatcagcttcacatcgctcagggatcttggtgcagctcatgtgtaactccaagatactcttccctggtgaatcctcccactgtgtatcagcagaaagtcttatagctactgccatgggtaaaaccttcctcaaaggagtatcctgaaaggtttgggttgagcaaatcttagaacagcttagaccaaagttcttaggttttcattttttgaatacagatgaagagttcacgacatgaacccctaagagtggcaggagctctcctctgtcttctgaaagacacagggaagtccttcttgggatcgtcatcctcatcacatttacaaggaaaatccattaatattcaaataatccagtgactatagaaagaccagtgtgagaggaaaataaatcttggggccccatacttactaagccaaagggaacagtcaagctgggaactgggtcgcacaaacctgcctcccatttggttcctaactaagacggctacaaagataaaaagctacatacatcgctcaccttttgctcacaaggagattccttgcaggccccaagatctttacttgaaaatatttctgttgaatttcaccctggcaatgtcaattgatagcttatccacagatgtggaatgggacaggacagaactcaaagtcatccttctgctcgcctgaggcaaatgtatatctgattgcttcctctgcactattgtttacgttatcttatgtaaaattgcagattcccttagccggacaagtgacagcatgaatgactatttcctctactcaccctcctatgaaaattgtatattcccccaatatccatcctttcccctttaaatattgaagccctcaaaattatctttggagaaaggcatagac

SEQ ID NO: 28632 - DNA, 1046 bp, Homo sapiens
ctatcttaagataagcagagagggtggtgaggaaaaattgtacataccttcccctcaatgaagaggtccccgcggtgtggccggccttggtataagccttctggctctgctaattcatgagggctgagtctgattgatcctcatggggaagactaacaagggaatccttgacaactattaggaataacactcatgacccagaaagtggctctgtcttcatggggcatgatctgtcttgtttactaagtgaccttctggctcatttttcttccagtcagggctggaattcaataatcctagttccttcccgaattttagagctgggaaatgcattcctcgggtttctacttttcaaaagcgaaaaatatctgtggagctcaactcctaaatagtgtgactttgtctgtttatgtggttctcttgctgactgcctggttacaactgtgcctgaactcaggcctctgtgtttctgaatcttagaagtggtggttggcatgttaaacttgaagtcatcgtcctttagttatctgagtgctataattgaacagcacatttattaacaagactttagtaaatccatcagcattctaggaagctttgattcattgacctacctctaatgtaagcaaaggctgccagagagttgctaacaagaattccatctttcctcagaaccttcgatccgcttgggtcgaagtttatacctgtttcatgaaaaatgcaagaccaattaatcacagctgttcatagtacgcctattctaagacacccctgctgctcctaccccagggaccgccggaataattaaaagtcacagaaatcaaacaaatgggcctctggctaaattacagaagattaacccaggaagagcacttattaaatagtaagcagtccccgacaatattaaagtacaaaaaggattagaaattgttttaagtgttggttccaacttcaggtgctggtcttccactccactgtggaagggaataagtggattttcccatcctaaagacagtgacattcatcacacccctcagaggcttaat

SEQ ID NO: 28633 - DNA, 1049 bp, Homo sapiens
tgcttggtccctgggcttctccctgaagcagcagcaaatgtaatggctgctacaagccccagcagcccctcagacaagcccggtgtatccagaagagtagaatttcacagcaggcagctcatggatggaaagtcagcattagcagcaagtagctgagctagggacgtgcgaacctcccagagggaactggcttcttttcacagggctcctgagaccccacagcttggaaactgtgggggctctgctgcccagaaagcacaaaagcaagaagtggcagcccatatgagcccgtggtccctgggaggacttccacccgggagcttcctcccagcagcttcctcccagccaccacagtccatcagcagtctctcatccaaatctgctctggtcattttcccgctggactttgtgccaagccaaacacaatctcagcaggacccttcagcctccttccacaacaagaacatggcattcttctttggggctctgaaaatgcaaagaaatatctcactgtatctgcacaggccaaagactgaccctcgagttggcaagcctgttgaccagctgcctctgtagggatcctgggagggtgtgtgtgtgtgtgtgtgtgtgtgtgtgtgtgtgtgtgtgtgtgtgtttgtgtgtgtaagcatgcatgctgggggctaatggggggaaattcagataagcgaaaacccattgtggaatccaagaaaaccatgtgactgaggccaatatgggcacagctctttcttcaactggtaacgtgaacatctgcagccccaagcagacggtcatcagccaccagctggacagcatttgtgttcatggggacagggaagatgctgccttcaaactggaaatagagacagacagctgctctgggagctgggacattatcaaaatgctccttgctgaactcagggacatgaaaggacaaagattctctttgattagaacaaaatcgttatgaaatagttggacaatggaattcactgcattctctgatatgatctggaatagatttctctccaggccaggcacagtgg

SEQ ID NO: 28634 - DNA, 1049 bp, Homo sapiens
aggctgtcaattctcaaaactcaacatttcctaattatttcaccttattttactattgtcttgaggtcattgacattgattgtacctgtagggtagaaacactatatgaaggacgttgtgttacactcgcgttggccaaggagggagtatttacaccacagaaattggcagatgctacaaatcagcacttctctgcccacacctggggttgctggttgttacagcttttccagcaactcctggcctccacccagcatggtgtctggcacagagcagggctcagctcgtgctttgtacatacagttccttgagtcatcccagtgtgaatgtgtcccctgcttctggctggggatctgtgactagtccatgcctcgccttgtgccacttccactcttgggagcagctctggaagcttctgtgctagtttctgtggctgccataactaatgaccacaaatggtgtggcttaaaacaacagaaatttattctctcccagttctgggggccaggggtctcaaataaaggtgttggcagggctgtgctccctctgaagaccaagaagggggtcctgccttgcctcttccggcacctggtggcccctggcaatcctttgcacttttggtttgtggctgcgtcactccagtctctgcctctctagtcacgtggcattcttctctgtgtgtctgtctgtcttcccccttcttagaaagccgccagtcattggagttagagcccatcagtgccacctcatcttaactaattataactgtgaagaccctgtctccaaataaggtcacattctgaggttccaggaagacgtgtatttgggggagcagtgttcaacctactatggaatctctgccatagaaactgcaggtgatgctgtccctctaaggtcgtgaggaaatttccaagggttgcctgacaccagtcatgaccaatgagcaaaaaggccctcactgaaaatgtttggcactttgcttttacagtgactttgtggacagcaagagagcggctccacaatcatgtcctcatgccatggggtcatgg

SEQ ID NO: 28635 - DNA, 1035 bp, Homo sapiens
gtgatccacccgcctcagcctcccaaagtgctgggattacaggtgtgagccaacatgcccagcctactattgccagtttttaaaatatatctgcacaaacacaatcaggtaagcagattcactgactggctaactttaaaaattttgaagttaattgcagaactatagcaaataggataattacaatgtattttgcccaaagaaagtaacttactaaaatatataaatataacttcatttatgtaacaagtaaataaataaacaaaatggcatactaaaacattctctcttgatacccctcctctcactattgcttcacttatctgtgcctctttatagaagaataactttcatagataactttaggacagtggcccacacctgctgtttcctcccttcttctcctgatcctactccagctggctctggtccacattactcacatgcacaccacctcacaaaagtggctctggccaaggtcactgctggccttcatgctgttggatccagtggtccgtcacctgcatgagttctcagcaacactcaatgcagcctcgcgagtagctgggattacaggtatgcaccaccacacctgctaatttttgtatttttagtagagatggggtttcaccatgttggccaggatgacctcaggtgatccgcccaccttggcctctcaaaatgctgcgattacaagcatgagccaccgcgcccggccagtttgtggcaatttgttacagcagtcacaggaaacaaatacagagcccaaagtctaagtccttcacagggacccaccccctacccccaacccatcttctctcatgatcttctgcaaataggctgggtgtccccaggaccttggcacacaccatcccttttcctggagctctctttccacccttcttaaggcttgctcctttgattcctcctggtttctgctcaaatgctgtcttattaaagagaccttcactggccattttgataaaataccacccaccccccagaaaagtgcacaatgtgggcaggactttttct

SEQ ID NO: 28636 - DNA, 1052 bp, Homo sapiens
tcaaagtagcttttaatattgcagaaaaaaaaagagtgaggggaccacagtgggcattggggggtggaaaatgccaactttctgggttaccatttgtggtttatttgctctctttatgcatgtctttgtttcccagtgattaaaacttggtataaatgttgctacttatccacctgtcgaggatagtgtgaaaatgagtaataatgtctgagccatatttttgctccttagtagaaaggtgctatatacatacaaaatgttatttcattaaaaatgcttgtacgataacagcatatgttaaattcaatttccttgaccaattggataaatatattttggtgttacagtatggttgtttttatggtgagtaagtgtgtatcctacactctgtgttctattttccacctgggtggtgtaacatatcaaatgtttaagaaaaataaggacaccattctaaagagatcaggaagctattgctaaatgttattctgggggggatttcaaatagatgttagcgagatacctactgaattattgaggatatgaactgtacaaccgtataataggacattataaatatgtaggctggtatacacctgttttgagtaaacagtatatttttcttatcaatcttagttctatcttggtggtttgcagcccatgagaccaaagcgttttatgattaaacttaagagcctgggcttcagtggccagagatgatgcctgttagcatcatttagtggggcattggaatccgtgcgcagcccggggaaaggacatcccttcttgtctcagaccatccatccagaaacttcttttgctgaagaggaggatttgaatccctcccatcactacagcaagcccagagaatgcagatgtggcagatacatggagacatggcaccattatagcacagtgtggtcatttttggataatttttttctaatgcagtatcgaccttcaggcaagtcatgacaaaggccctctgtgccattttctcccacccacatttttctcagcaatttacttgacttattgcctcacagataaga

SEQ ID NO: 28637 - DNA, 1020 bp, Homo sapiens
ctcgccctgaattctttctagcatgagatccaagaaccctcttttggggtctggattgggactcctttcctgtagcatctttctggtgaccactgaagggactgcagtgcagaaaacccccacccaaaggctaacttttggtaagtggtgggggccagtaacatttttctagtgaaccctgaggggacgatactgaagaaaccccccgacccaaaggaaatagagtgcagcactgataggccaactttgggtaagtggtggggtacccaggtaaaggatggaattgggttagaggcccaacttaggggagtcagagtctctcctaagacagagtgggtcagaggccgctcttgataaaaggcaaggacacctgacctaccttgggttaaaggcccaacttaggagggttagggtcccttttaagatttaaggggttagaagcccctttcagtaaagtcctttttggctaagaatgggtttggtattatgagacgttaactgctattctctttggattaatctgccttgaactctttgctgagggctgtgggtgacaggattaggcacatataggattgtgggacatggggagctttttcctccctaaaaggggaaactcgagagctgatgataccactggaaaatatcccttttctactgacaagcagctgcctgaacttttcagtgtcactgcaatgggtgggtctttctgtggtctccctgagcacctggccttccccaccctgcctcaagcaatgcttcctctccctctctctgtctgtttctgtctctctctctctgtgtgtgcaaactggttgaatgaacggtaaaaatcattgtttatctcctccgtaaaagtttagattaatggaaaaaaaggatttgtgaggctagtcctaagctatagtgaatctggtgtgctttgtgtgtctttctgtattgctctgccataaagaggggtatcataggatggaacatggtcttaggacacctgtaagccgactgttcaaggtggcccag

SEQ ID NO: 28638 - DNA, 1703 bp, Homo sapiens
ggcattcggttacaagtctgtctccctggatggactgtgagatcatgggaacgagggcactgttgttagatttttaattttattgtatttatttgtttgtttattttgagacagggtctcactctgttacccaggctggagtgcagtggcatgatcttggctcactgcaacctccacctcccgggttcaagctgttctcctgcctcagcctcctgagtagctgggattgcaggcacgcaccactgtgcccgactaattttagtatttttagtgaaggcagggtttcaccgtattggccaggctggtctcactcccaacctcaggtgatctgcctgcctcagcctcccaaagtgttgggattacaggcgtgagccaccgcgtccagcctctaccatggcatagcacatatgctcacatactcttagaaagatcacaagaaactggtgaccatggctgcttgtggttaaaactctagggggcctggaggatgggctgggagggagtcacggttcacaggatggtcttttgtacctttgaaatccacctattcaaataaatgcaaaaccagttgcagtacagccacgtccacggcagcatgattcacaataactcaaacgtggaggcaacccaagtgcccatccacagatgaatgagtcaacaagaggatgaatgagtcaacaagaggtggtgtatccgtacaatggaatattattcagccttacaacggaagggaatcctgacacatgctccaacagggatgaaccttgatgacattacactgagtgaaataagccagataccaaatgacaaatactgtaagattccacttatacgaggttcctagagtagtcagatccagagacaaagcagaatgatggttgttaggggctggggacagcagggaaggatggagagttactgtttaatgggtatagagtttaagtttgagaagataaaaacattctggagatggatggtgctgatggttgcacaagaatgtgagtatcactgaactctacacttaagagtttttagtttttagttttagctgggtttggggtcccaggcctcaggcctcacctgctgcctcaggatctccagggccctcccagatcacagacctaacagatcttaggacaattggcccagggtcatcagcgcaattgatgcagctccctccctctcttgtaggacattttcatggatgttggcatttggtatcagagcagctgaagttattatgcattttcagtgtatgtatttatgtagatagtggtacgctcttttaattttttttttttttttttttttttgagacagagtctcaatctgtcaccccccaggctggagtgcagtggtgcgatctcggctcactgcaatctctgcctcccgggttcaagcaattctctgcctcagcctctcaagtaactgggattacaagcaccccccaccatacctggctaatttttgtatttttagtagagatggggtttcaccatcttggccaggctggtcttgaactcctgacctcatgatccacccacctcagcctcccaaagtgctgggattacaggcgtgagccaccgtgcctggccatgatagtggtacactcttaaatgtttaacaatagctttcccaaaatacatgtgcatataaatacagatgtaagtttgttataaattttgctgatatcaaggatatgt

SEQ ID NO: 28639 - DNA, 1095 bp, Homo sapiens
ttaacagggaaggtactaaagtcagcaaggacttagagtgaggtgcgggagtcaggcctcccatggtgagcacggggagaaatctgtcccctgccccctgctgggaggggctcagctgggctctgccccctgggtgggaacacacagtcaagccattcttacgactggccccaggcagggctcaacgtcattaaagaggcagaggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgtgtacaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacaccttaatccacaatttgctctgctctcctcttt

SEQ ID NO: 28640 - DNA, 1040 bp, Homo sapiens
agtagctgggactacaggcatgtgccaccacacctgactaatttttgtatttttagtagagacggggttttgccatgttggccaggctggtctcgaactcgtgacctcagatgatctgccggtctcggcctcccaaagtgctgggattacaggtgtgagaaagcagttctttacgtttaaaaattgacctcgtcatttctctacagacttacaaaatactgtactctgtagctcctttggtaaaactctaatctaggatgaattaggtagataaaggaagcttttgtcttgctctttaataagttgcagcttgcttttatatgtattcgacgaaccagatgaaatgaccctttcccttctgtagctcaaaaatggttgagtattggcaatttcatgtgtttccacctaataattgttggcaggtcctcaccgcaatgtattcagagttgtgttttgttactgttcgcaaatgttgggggatctttcgagatggactgtgtgaaagaggaaagggaaagcatgtcagcacatggacttccctgatcaaggacatgcttctctctggggcagagcacttcagtacacggcaaaacactgaggaaattcctctcctttcagtgtttggctgatcatgtggaattgatgataatcctttttgatagcttattctttttaacctgcattaaaagcgccatttaaaacactgtaattgaacagccctaaaacactgttaggagtaaaagaacagtattcctgcaaggcctttagcagctcaaaaatacatttttttaaatatcagggatagtaagaattcctagtattttttcctttcaatgttaacctgaaaaatggttgtcttccacagctttcttacgtaagaagatgtggtaagatgaggaaaaaaaatatgagaaccagttaacagttcattattcatcattaaaccaatatgtaatatgttcttaaattaaccaccttttttttttttttttttttttttgagacagagtcttactctgtcacccaggttggagtgcagt

SEQ ID NO: 28641 - DNA, 1031 bp, Homo sapiens
tatcttaagagtctcagtatatgaggaaatgatggatttgggcagctttttatcattttacctgagtaattaatgaagatataaagtaatccttcattaaaaaggattttaattacatttcagaaaaaaaaatgataaattcagtatagtaaaactggttctaaaggtttttttctctttttggtttttttcttgatcaggttcatcatattccgtaaaggtattagaaataggagagtagatgttgttacaggatttttccctacctgatgaatgtgtcttttctgtatgtttatatgttctcttatacacataggttttttattatttgaaaactttctctggactataacaggtaatcaagaacagagagaaagagcaaatagaaaccagtaatcagtgacttaggctagtccagtaggagctgggactactgagaggcccatatctgaagagtaggaaactgagagctattactgtacctagaaattaagattattaagattgtgagaactgaggaaaccacttcctatgaagatagaagctttttgtcttttctgttgtagctgtccacttaacaatctgaaggttcttttttatatgtaatattactcttcaaatatttatcctccttttttcaaaaaaagggaaatttgccattcactgatcccatgaccacacttggcacaagaactttcttgattctgttgaataccataagtataggaaaagaaagtcaggatttttgtgagtttaaaagttcatattttgcttaaaataaatattgttagcttagatccttcagcaaacatatgaaaatagaaaaaatatttttcactgatgagtctttcagtgtatttaattcggaatattgagttagtcattcaaaagttgtacttctgtgtttaaaagcaatatatatggctgggtggcagtggcatgcacctgtagtcccagctacgcaggggactacattggaaagatcgcttgaacccaggagttcaagtctagctggagcaacatagcaagac

SEQ ID NO: 28642 - DNA, 1062 bp, Homo sapiens
ccataggaagggcctgtatccattttaatcctgtttcctgacatactttccctaaactatttttgatagtctgattcattcgctccacctttccagaactctgaggtcagtaggcggcatgtagtttccaagtgattcctaatgcctttgctgtcttctgtaccaagtcagccacaaacaccggcccgttatgtgagccaattcgtaagggcagtccaaacctaggaataagatctcggagaagcacacgggttacttcgtaggccttttcagtttgtgttggataagcctccacccacccagagtaagtacacacaagaaccagcaaatacttgttaccttcacattttggcatttctgtgaaatccacctgaagaccctcaaaaggagccgctccataagcttgtatgctgggtggaaccgtggggccttgcctcacattgcgctgtcagcaagtaacacaccattgtgctactgctttggcaagggctggcaagtgtgagatgtagaagtaccggcctaacaacttttcaagtgactcttgacctagaagagtggtttcatgcatggccagtacgactgtggctctcagcaactgtggcacagctaccttcccatctggcagtctgatccatccttcttttattacttgccccacttctgtgtggaaaaagtctttttcttccttagaataggtaggtaccaggtcaggtgtttgagggagtaagggggctgctactgatgcacagtaaggggtagatgctgcttttcgagcttctgagtcagtttgggagtttcctaaggccactgaggtggaggctcgctggtgtcccctgcagtgcatgactgccaccttctgaggtttccacactgcctctaataattgtagaatttcttgttgatattttatgtcctttcccctagagtttaacaggcccttttccttatataatgctccatgcacttggagggttagaaaggcatatcaagagtcagtgtagatgtttacagtcttaccttcactgagttctagagcccgagttaaagcaatgagctcagcct

SEQ ID NO: 28643 - DNA, 1048 bp, Homo sapiens
cactaaaatatgatctgaaatcttttaattttaaaaagtgccaagatttctaacaaagaatagttaagtgtgtgagacctaaagactatttattatttttcttgcctatttattcctaggaatctcacgtcttcattctctgggcaaggtttatgatcttgtctttaaacatgaatctgtggcaaaaggaatgaaagcttaactcttgccagaaatttagttgaaaaggatttgctatcacttaagaattgtttggcttagttattgttctgaatgttttgagaagctgttgattattttctcgagaagggtagaggaagagagcacctagatatatttttgagttatataatgaacaccattttctgaaatagtatggtatttagggatggacatctgttgtttgagcatagactcatttcttttttaaaattttttattttattttatttttttgactctctgtttctttaagcacattaaggtggcaccagttaagaataaactaggactattttttatctttttatttcatttaaaaactgacttgactttattagttcatacagtgaggcagtacgtttttattcacacagttcattgtcttgctgaatattttaagccgtgtaattattatagaacttgtgtgttgatatagaatggattatagacactatgttcgcattggtaacaagcagtgacttcaatttttaagagcaatgataaaccataattatagagaattatttttatctaggtacagtcagctttgaattaaccataccaacaggccagacaagtaatctgctttcattaccacccagacacctctatacaagcaatcaaagcaaacagctaggtggtgagaaatctgcatatctgcccctggaaacaatggggatatacttatctaaatcagcagttccacaggtcaaaattatctttacaagaatactaagacatcactcgcctttttcactctcatttcctcataagactgctatatcttggtatcataagagaatatcataataaaataagatcatgt

SEQ ID NO: 28644 - DNA, 1049 bp, Homo sapiens
taaattttatcatttaaccagaaagaagtccttatcaatacttgtagtttccattgatacagtatttgttttaaaaattgaaatgatgggaaataactcagcctagtaaactgttatgttttcagaagctagtcccaaatagtgctataatgataaatttttggtttgattctggtagttcttaaaagccatattacaattaatatattaatgtacttataaaaatttcttgtttgctttttaagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaaggtatatctagatctatcataacattacagaatatcctctttttcctctcttcataaagcttttaaatggccttttaaaagttaatagatggtttaaattaatagatgtgtcttagaattctgtttaatgtgcttttatgccttctttgatacttcctttcacagtggatactagtgaataaatggaagataggtatttccctaagtttgggaagtatgtatatataacgtatctagtcatttagtgacaatccactaagatgatatatattgctctttttttcatgatttcccttgtatatctgttttactttttgtattgtttgttttgattacaaatatgatttttaaaaccatagacctcttaataaagggttctctcttatttggctttgcgttccctgcacttaacacagtgcctactgttaatagatgtgtgacgtatgccacttggacaagtaagtccatcaacagcttatgcagtgcttactaggaacccaagattagggcataattgatctttacttatcttaccttagaaaggtggctatcaagatgtgccaacgaagtgtgagatatgggccaggtgtggtggctgacgcctataatcccagcactttgggaggctgaggcaggtggatcacttgagacc

SEQ ID NO: 28645 - DNA, 1048 bp, Homo sapiens
atgatttttaaaaatacctttaatgcaagctttttttttcccccaagttggaatttagctcttgttgcccattggagtgcaatggcacagtcttggctcaccgcaacctccgcctcccggcttcaagtgattctcctacctcagcatcccgagtagctgggattacaggcatgtgccaccatgcccagctaatttttgtattttagtagagacaaggtttcaccatgttggtcaggccggtctcaaactcctgacctcaggtgatccgctggtctcgaactcctgacctcaggtgatccagctgcctcggcctccccaagtactgggattacaggcatgagccaccacacctggccgcaacttttttttaattgggtaaagttatggttatttaaagccttaacactttctggagtgctacttttatcacgattggcaatagctctgttattgtaaaacttttctttcaacattgagtaataaaacctagtctaggaggccatgatgggaggattacttgagaccaggagttcaagaccatcctgggcaacatagacccatatttctacaaaaaaataaaaaaataaaaatcattcgggcatggtgacgtgtgcctgtagtctcagctactcagcaggctgaggtgggaggatcccttgagcccaggaggtcgaggctgcagtgagctatggttgcaccactgcattccagcatggttacagagtgagaccctgtctctaataacacaaaaacagaaatctaatctagtctagccagtatattgctatgagagctgtgatacatagctgaatgtatatatgtgttggggaacagagtggtggaaaacaaccataggcattacctggaagacatgaaaactggatttttttcaccttatgcaccgttgcagtactatgcaaaataaatgttaatcagtaaacaaaaatgctaagttttgaacttgtatggagtgataggcaattaatctgggattactccaaagaaaaagtatcaacttgtgagttttctgcagtctaaaatgcttaat

SEQ ID NO: 28646 - DNA, 1049 bp, Homo sapiens
gtcctttcagaatcagatttccctattcttgccctacatttgtgtagtcaagtgttgccattagcttttatcatttaaatgttttgtcagtttctaagtgtcgagcactattctgtcaagaataaaagggtaagaagacagagttcagatcagtggacaggatggattaattaatagatggtcttggaataatttattaactctttgggaagaatactaatgttactagtttaagaaaatatgcagtacatttattttaagaatatcagatttagaaacttttgattgaaactctggatttatacttagctaaatagaatccaatgtttcaggtcatttttcttaaactaaaacttttttttgtagcatctgcagaaaaagaggcaatcaagggtacatactccaaagtactggatgcatatggactcttaggtgttctgcggttaaatcttggtaagtttatcattcagtagaattcatccattttttcatttctattttgtaattctaaggatttgagagggactagctatgaattattgtagactccatatttaagctacacatgtgctaacatcttttaaacattaatgtagctaatattgtgataatgtttgttgcccaaaaaggcgtgctacatgctcaaactcatgtgagtggaagttcggagacagtctctggtttgaccacttgaagagataagtatcagttgtcaaaagagaaaatcagaacattctcctttttgttgattcagtgcatttaggaaaaagtgtctgcatgagaactacactgatttttcttggtttgtattggaaaagacatctgttttgaattcagaaagtgtctgcttgagccttttttttttttttgccacgtaatgtcaccgtgagctgcagagtaacctttgcagttactagtttatctgtaattttgcagctcaaagtgttcttcaacattggtactggtccataaatcattttgttattgatccgtgataagataaggagcttgcactatgatacaaatcaacatgtggcttccttcattga

SEQ ID NO: 28647 - DNA, 1026 bp, Homo sapiens
tgaactataagtagaatgaatcttcttttttcaattttttttttttttgagacagagtctcactttgttgcccaggctggagtgcagtggcatgatcttggctcactgtaacctcagcctcctgggttcaggtgattctcctgcctcagcatcccgagtagctgaaattatgggtgtgcaccaccatgcccagctgatttttgtatctctttattagagacaggtttcaccttactggccaggctggtctcgaactcctgacatcaagtgatccacctgcctcagctccccaaaatgctggggttacaggcgtgagccaccgtgcccggcctctttttgtttttatttttaaattccagaatcttataattaaataaatttctagctggttgtaccttagtgctcattagttgtctttccttggttagcattgggaatatatctttggcctatcttgttcccagttttatcaattctcttagagaatggagtagaaagtacagttttcagatttttagttgtggcaaagtgacgtaggattgatgagagctgggttgaataattatgttggatgacacaattgagatccagctttttgaaactcagataatgggttagaacccacaaaaggaaaatgcacttccccttgcaccggattgagtgtttgtgtattcctgaaccaaaaatgactgttgagatatcatgtgctgtttgcatcaggtagatcattggcagaagaaggtagaaatttctgtgatttccatagtatcacaaactgtttggtggctaccaaatgaggaagagttggaataggtaccgtattgatggtcttaccaaccactgcatatcctcaaacctgatctttccttcagtctcccttatgtcaatggattgcactccatctaccaagttgtttcaaacaacttaagaatcatcctcaacacctcttcccctcacatttcacacattctctctattaccaagtctagtcaattcctcctcttaatttccttgagattccatgca

SEQ ID NO: 28648 - DNA, 1134 bp, Homo sapiens
cttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaatatatcctttgttgtattttcctgacgactaaatttgcagcatttcaaatgactctaataaagtgggactgtgagcaggcccatgtgtacccttgatcaggacataatatgcagaacagtgtcatgcactgtatttgctctgttaattttatcttatccctacatatttgtattagttcattctcacgctgttatagggacatacttgagactaggtaatttataaagaggtttaattgactcacagttccgcatgggtgggaaggcctcaggaaacttacaatcttgacgaaaggcacgtcttcacagggtggctgcagagagaaatgagtgctgagggaagggggaagtcccttatgaagccatgagatttcatgagaactcaggagaacagcatggcggaaaccaccccccatgattcagttatctccacctggtcccgcccttgatgtggggattattacaattcaaggtgagatttgggtggggacacagaaccaaaccaaatcagtattcattctggatgaatttttcattacaccttactggcctactaagtagaattaaagtcagaacacctattcctcatcttaagtagaataaaacataaaacatgtatctgtatcacatacagatcatttaggccttaaactgcatattatttccaaacccattagactaattactctgcttttaagaactcttaaaatagagtttttatcctatgaaatctgtcaggctatattggtttcaggaatgggtttgaacatcacactaggaatttgatgtagggtacataaaacaatggtttttctatcccaagcagaacatttttattcctgaaatagcttaaggacattatttcttatgaaaggaattatcaaaagataaatccagagggttacattttaataaagctggttt

SEQ ID NO: 28649 - DNA, 1664 bp, Homo sapiens
attagctgggtgtggtggtgcgtgcctatagtcccacctactcgggaggctgaggcaggggaattgcttgaacctgggaggcagaggttgcagtgagctgagattgcgccactgcattccagcctggtgaaagaccaacactccgtctcaaaaaacaacaacaaaaaagattttaatggtaaaattctttggcaggttttggctgatttgattttgttcttagtgtgtgccattttgttatttgttggcactaatatttttttctctgtgttttctactagataaattttatcacattttaaactttgatttacatatatttaacagtgtttctgtttggaagttaaatatcaacaaatagtgtttacttttctacagaaaagaactttaacagctatgtaagcacctgctttgtgcagtgcacataaagcaggtttcatgtgggttggaaagttttgcaaattctaattcttccctaataggtgcttactacaattctgtagaagagatgagacaattactaatgtcatattatgtcttgtttctcgtgagtggtttaagctaaatgttaaaacagtcattcttaaagtgtggtccctggaccagcagtatcagcatggcatgggagtctgatagacttgcaagttctcggggccccactctgggcctcttgaatagaactcttggggtggggccagggatgatctgcatttcaacaatcctctaggtaattctaatgtgtgctaaaatttgaggattacttcctagtaagaaagcagaatgacttctagctggagtgataaggaaagtcagattatactttatttagtgaattttggtggagtggaaattatgctggatcttgacagattggtgatgaagagacacaaataacgatttgtgttccaggtatacgctaaaacagccaggactctggtttgggaaggaatgggagacaggcctctgaagtagtttgaaaacagattgctttcttttctttctcaatattaatgaaactcattgatctcaatgaattttgttttgcttttttaaaatgggtcccctgtctctgggctagtcatttaaacatatgtaagttttgttctatatggataaatgtaaacttttttttttttaacatgctgtagcttgcatatctgtttcctttctttgaaaatgtgtgcttggaaaaattgattgcagaagctctaaaatagccatgaaatcagtagcaaattttctcttagatatactaattaatgagatgctgctatatttttttcttttagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaac

SEQ ID NO: 28650 - DNA, 1561 bp, Homo sapiens
tgtgggagacttaatacctaatgccctaaggcctccattgtctataatgaattcttctttttcccctgcatctgtaacagtactagctatgtatcattcttgggagaactgagtaaagagccacacaaatcattttctgtaggtttagaactcttgcagagccctgcttcagaaaggctactcagtgctcttgctcataatcactggagtaactgcagggttctgaagagattaaggtgggtcagattcggaggatggcagcaggaactgagggaaatggacagactggatggtcgtggagacacacaacttgagagagaggtcaggaatgacctccagacctctgccgcaagcagctggttgaatagtgttaccatttactaagttgagaaacaactgggaaactataagtttttatggtgggatgggatggggctttcattttatgatgatagctttcattttctatatattgattgagcttgggtagcttgagatgcataagtgatataacttggttgtagttcatgatacatggtagccatgcagggttgtagtcagactctcccatcttttgtgggcagcgcggggcggggtgggggtgtgcatagaaccagctagagtgtaattttgaatggaggacacttacctaagactcagcactccctgatagtactgtctgcaatgatggaaaatgttctgtatctgtgctgaccagtgctgtagccactagctacatgtggctgtttcgattttgactaattaaaattgaatattcaaatgtaaccattctaggaaatatctgtacctttgaaagtattaatatttcttagtactttggcaagacatggtctgctgtatttcatatggtgttttactatgtaacttatttactttgtacctaatctaattgtttcacattacctattttttttcttctttccagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtgagttaaatgcatagtacagtttttaaagcatataatttaaaatgaattaagtttttgtttgtttgaagagggatttgagaattttatgaaacccctttgattactggacttgcatgtaaggttgacagtttgcctacccaggtagttccaaccccctacagcattttttacataaaaatgcatactgttatatatatatatatccatctatatccatatttttatagatattagtgaaagttttgatatttttataggtataaataaaagttttgatttcagaataataaccttattatcttaacctcagtctgggccaactcgacttcccttagcagcatgcatggatgtctattcgtggaattattgcaggggatgggggtgctgtaatttcatttttataccactcatttttacatcaaaagctgctggaaaaggaaattcagtatatttaggccatcctag

SEQ ID NO: 28651 - DNA, 1054 bp, Homo sapiens
tttcttctaggatttttatagttttggggtttacatttaagtctttaatccatcttgacttaacttttgtatatggtgtaaggaaggagcccagtttcaattttctgtatatggctagccaattctcccaacaccatttattaaacagggaatcttttccccattgcttgttcgtgtcaggtttgtcggagatcagatggttgtaggtgtgcggtcttattgctgagttctctattctgttccattggtctatgtgtctgtttttgtatcagtaccatgctgttttggttactgtggccttatagtttgaagtctggtagcatgatatctccagccgtccagtttttagttgtttgcaaccaaaggttaaatccagttcttgtttctcttatcatagctggaagcagaaatagccactattttagtatttgggtaaccttttaaatgtcttttaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacaggtaaatctcctgttctctgaattgagcattcagacacactggctttctcaaatctatttttatgagtttataattcagagcatgtttccttatagaaattacatgagaaataatagttaccacctggcccagagatggctagagggcagaggggttcttatcctgggacttgaagaccactttagggtgggcctgtagttgagtgcagtaattgcttcataggtgaggtttagaaattcaaagactgactgaagcaaaattatacagagtttgagggaggaggatatgcatttatgtggggagcaattaaaatgctttcataagttcctcaaaaaagattaggaatcattgatacaggaatctattttaaatactagaaatgttagtttgaaattcttgatgccaagacaacatttctacagaaatcctcttttttcctaatctttattttccc

SEQ ID NO: 28652 - DNA, 4147 bp, Homo sapiens
catttcatcaaataccttttcccatctgtaatttgttcttgagaatatggagctatttacttagaggggatttgaaagaagagttgaattatttatattagtttgattgaaagttggaaagaaattaaaagatactgggaaagtgaaaaatacagtcctagagggagtatacattaattgccaaagatttgaggaaaatgacatgggatgctggagaatcaattcattttctgatctgttttttaaagaagtaaagaatagtctgaaattcttctgtttagatttataagcacttatctgcaattactgtgtataattcttacagaaatggaggaggctatcacttgagtcatgttagactcacctgtctcctccagtgcacattttacaaaacctatacatgcagtgatgttttaagtataatgttttttttttttttttttttttgagacggagtctcgctttgttgcccaggctggagtgcaatggcgcaatctcggctcaccgccacctccgcctcccgggttcaagcaattctcctgcctcagctacgcctggctgatttttgtattttttttagtagagacggggtttcaccatgttggtcaggctggtcttgaactcctgacctcgtgatccaccagcctcagcctcccaaagtgctgggattacaggcgtgagccaccgtgcccagccgtataatgatatttttaaaaatatttcttgaaggaaaactcttgagtctggaattatttttatagtttgggatattttagctaattcatctggggtgtgtagtgaactcacatctagggctgggaaatctttctggtttagtaatttttcattgtaattgatgcactcaggaacatacctccttcctaatttcagagctattttgaaatatgaatgaaaaactcagtaaaaaaaaaagtcaacttttaaaaatagtagggtctggtcaggcacggtggctctcgcctgtaatcccagcactttgagaggccgaggcggagtttgagaccagcttggccaacatggcaaaaccccgtctctaaaaatacaaaaattagctggtggcgggtgcctgtaatcccagctactcaggaggaggctgaggcgggagaatcgcttgaacctgggcggcggaggttgcagtgaactgaggttgtgccattgcactccattctgggcgacaagagcaagactccgtctcaataaataaatagatagatagatagtaaggtctgataattaggatattctgaagtaagagctaaattttggttttgtttttcctgttgctgattttggtgacacatctctgttgatatcagtaaatatcaattgataagtaaaaaaatatgcaagtcttaacttggatgtctttcatcttgcatgtgctcacctccctcccctctcacccagtcgtttgggttgtttgcctccccttactgtcatatcttcatagtgtggaactaaaacgtagaaatgagggaagtatagtggacagatgtttcccccaccccttcttttacctaggcaagagattaggggagtcttttttgattaaagagagtaggtccaaaataaagaccctgaaacactaaaatctggggatccccaacaaaagaactggctcagtacctagtgatccgacggagacacctctgttagacagctcctgcccacacacacagcttccagtcttgctcttctatatgaacaggcagttaacgatgatcataaggaccaacctgagcagcagaaccaaagggactgaggaaacagacagtgctggtacaagtatgcaagttttctgtaaacagattactttcaaacagttgggagccccagggagataatagaaggtatcctactcaacaggagtatatagaatgctgtagaagaggaatattgtaagaacaagaactatctcttgaaaactaaaaatatgataactgaaatataaatttaaataggattggaagctaaagctaggaaattaccctagaatgttttttgagaaatggaaaatacgaagaccaaaaaaataaaataaaactatgctgtgaaagagaaagattagcatttgagaaggcggaagttggtcctgctcagatgcggttttcagatgccttattctaaaaatagtgatagaaaacaaatttctacaaagcaaaattacaataaatttattaaactcttgcaacaaagctgttttcttatgtcttcctatgttttcctgctgtcattcaatgtgatgctgaagttcttcctccttaaaaatgtaatatttttccctttgcacaggtaatttagagttttaatttatttggtcatcatgatagctattcctgatagctgtcctgttacttagacataaaaatagtgagtaagcccaattacatatttgtagggttgttgaactcttaaaaagaaatcacttctttaatttttctactttttaaaatgggaacgcagaataataatgaaatttgttctaaaccaaaaacctacctggtttaccagttattgcagaatcttgccgttgagattagcaagcagtctgtcgtaatggcttattctgtgcaaactctttcctcaagattgttgaaagatggcttttaattttaactgttgttgttttgcagacaaagctctgatggcaccaaatcttgactcctttggacgcgatcgggcactgtatcaagagcatgcaaaacgtcgcattgcagagcgggaggccaggaggtaattctcaaaacccttgctctggcttgtttgggaagggaggagtctctgttatctagtttgggaacttgatgtttattatttaggactcgtcgtagacaagccagagaacaaaccggtaagatggcagatcaccttgaaggcctttccagtgatgatgaagaaacttctacagatattactaatttcaatctggaaaaaggttagacatttatttggaaataagactcatcatcagtttagtttctacttgggtatggtttttaccatgaaatgatttgaatcttcatggtctctgcattagaaccagacacttcttttttaattgcagaaatttgcatgcctttttattagtgaatatcatgatgaattctcaaaaataggggtaacatcttctcatagggtgtacttagtatttgcataataaatgttgttactgttccaaatggtagaattttaagtgactggaaatgtgtcaggtccttgagggcagctctcattgcagcctgtctggtctggaaaggtaaagcttggcagtagagcactcagccctgaaggaaactcttgatttggggagtcataagtaatctcaccttagaggaatggttagtactattatgtgccaggcattttcagaaggatcccaaataaaagtcttcatttcccaccattggctataattgtttggaattatatcaattgcacaccatttggaacttagttggagaagcttctttctcttactttttttacagtgaacatttctaaacaaaatttgaaagactagcacagtgatcatccacatacctatcactcagataacaatgcttatgatttcaccaagtttgcctggctctttatacaaggagatgtgtgtgtttgctgaaccatttgaaagtaacttacagacctcatggctcttcactccccaaaatttcagagtgtgtttcctctaaatgagtatatttttctgtataatcacagtattattatcttttttctttttgttagatgcctattctgattaagtatttctttttttagcacaataagaaaacagatttcttaatatcatgtccatatataatttttctcaatggcatcctggaaaaaccctttttaggaactatttttatgggttattttgtggtttttgaaaccaggatccacctaaggttcatgctctgcatttggttatgacatttttaaatctggaataaatgagtaaccctaagtacacattcacacacccacccctattgttctttaaatttttgaagagaccaggccacttctcttatagactgtcctatattctagactggtctgtatgtttcctcatagcattgtttaacttgttctttgatccatttcttgtaaactggaatttagg

SEQ ID NO: 28653 - DNA, 1076 bp, Homo sapiens
ggtatgtgtagtggtcattagtgttacgtgaaagtctcatagcatttgattataacataaggtatttagaaaaagaaagttttctgttttaagttagctctcatgttcttttgtattctatatgaatcaagtaaatgctttagggatattaacctggaaaaattattgactttgtaagttcacaattcatgtaaagaaatttttataaaatatgggagaatttaaacatttgacaggaagagaacaactttttaaatttgagatatattgagttcagagaggttagtgatagctggaaattttattcgccctagtaattattttgtttacattaaaaaatctgtaataaagctacaaaatagtaaacagattactgtaacgtacttggtacatatgagtggcagagcaactgaaatgtccaaaattggagaattagcagactcttgttcttacctacttatagagccattgcacttttttggtaccacacagtgataatgttttactttgaactacaaaaatcgcaatgcagataatgctgctggaaaattaaaaatagatattaaaaagacttctaagtacttaaatattctctaagggaaaagctctaaaattgttgacatttctttacttgttctatgaatactgaagtgttacatttcttaactaatgtttgctccaataactaggcactggacattatagctctatgcatggattaaaagaagaagtgtcgtttcccaaacataaaacagaatttgctacttgtgtgctgttggggattcatgattattctgtccatagagagggtactttttcagaaatccggaaatagtatggaaccctcaaataaataagcagctgaggagtttggtgttacggagtgtgttgtatttttacaggtgccactgattaatgaacttgaatcagcaatacatcagctgtacaaacagcgagcttcccgccttgtccaaagacgacaagatgatattaaagatgaatcttcggagttttcaagccattcaagtcagtccatcttgaaggtttttattattcattaaacaaccttgtttact

SEQ ID NO: 28654 - DNA, 3772 bp, Homo sapiens
aacaatttgttttataaaagtaagtaatacagtgagaaaaattgcataaacgtaaacctatttttgttaatagtgttttgaggcagaattcgcatacatttgggtgaagttaagaaaatggcacaatagagaaagtcttggactggatgtcaggagtcttagattctaatctctggttgcccattgattctgtgaccatgggcaaggcatttatcctctttcattgatcaaaggtggccttaaatgatttttgatgtttcttccaactctgaactctgtttttctgaaaattattagaaataaatttagtgattccaccaagagataggacattcattcaatcctgcttttatctaattttgaagaattctgcaattattacataatatttggcaaataggtataatttttgctgttgattttttaaccctaaaggcatattattattttcaaagttttaactaccagatttcatctatatcccatttcttttctaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggtagggcagatcaacttcttaaagacctgtccgctagctttctgttccctcaggcaacatgtagtctggggtagcagatgcagaatatcagcaaagaagattcactggcccagcttcaaaagctaaacagaagatgacttcatactttgttctgctaccttcttggattacttctgtggaagcctcgaaaaattataaaaaatgccactccatgatcttgttgaagacatttctgagtttgtacctcttggactctgaaaaagtgtagtcacgctatggggggaaaagcaaaacagtgagattttggttagcccacaaaactgtgaaatctgtaaactgccattttttgttttttgagaaaaaaagcagtacagaggaaaagatgccattccaaatatttttatgttctaatagtggagctaaatgcatattttaatattgcaagagtcctgacaccatagacctttggatgtaaatgtgttatatttatccttttgtgttcctaaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtaagaatgcaaaaatactaatctctttgaataaggcaaaattagggaggtctagatggccttgtgtagaacattctataattctcagaaagtacccactgaactcaacattagaagtgatgaaaagtcatgcttcatttttcttcacttcattagtggcattatctcttaagggcaatataatacctttgttgaaaacagaaataaagataatatcttaaagcacatttaaataagactttggaaagtcttatttcaatatggtggtagattattattggcctgtgctgaattcttagaatataagggactcatctgataaaattttcttttctggttcaggtttaaacttatttttaaacgtttctacaagcaattctaaatatgcatataaagttgcaaatttttattagttttttttttttttttttttttaccctggatgatgattaccattgttgctaatagtttttatctaagtaagcctatgcttgatttctttcagaaaccatttcattggatatcattttttctaaggtttcatttctcccaagtttgtttttttcaataggatagtcagttgacaaaatgtttggcattcttatactatttattgtttacatttaaaattaggtgcaaacagctagtttctcaaatgacctcctaattgattttttttctttaagataaaagtattggttgaggcactggtttataagcatttgtggactttgcagccttatctttaaaaaaaaaaaaattaaaactgtggtccttaaatatcctgtctgaactttggattggaaggcacatttccctttgttattggctatgtagattagcttagaatctgtaagcatatagtgtggttaaatatgtatttcaacttttgttatctttgttgattacttgaataccctaaaaccaatggctgggaaaagatcattgccagactatgtcttcctgatggatctttcttcctgatgggtcttaatggttccagtcagtctgtggccagattcaggatgagataacattcaccatgtcctctctgtagggtttctcatgttttgtctttatcacctggtttctggagaagcagctgcagtctgagttatgataccacttgtggtgtatcagttgcttagggtggggaagaagtataggcttgtctgtattcctctgtgccgggagctggagtcaagattggaagtggaacctaagtgtcaagagttgacagtcatgtccttcctactggcaaaactcttctgagcccagtgggcatggtgggagctggtctcataacctttgtgactagagaaaggatctttttcttaaactatgctttatgagtttgtccctggagagctgcttcttgaagtgtcttggcgcttgcttcggaactttcttgagtaaattaagacattcataattgcaaacacaactctaaaaaatttgacagtaatatgatcagctagatcataccaaaagtaggacaacctagtttatagtttttaattgttgaattattagtgtatttcatctcgattaccttgttcctagagaagtttacttcagattatgctaatgtggttatacagagtcacttagattttttggaacaaatcttaaaccttatacagtgactacgttttaattaaaagagaggtagacatagcttcatttaaagatgagtattatatttcattctaacattttcatgtgtatttcattttaagagtactgctcagcttagatctttagaagataatcttaaaaataaagaaaaaacaaaaaagtactgctgagttgataatataaattgttatattggagatacttagaaataattggatactttgaataattatactataataatatttcagagttaaccgtaaaaagataaagatccctttttttttcctctttgcttatgaaagtttaggtggtttttaaagaagttttaaatatttgtaaatcattttaacttgccattgtttttgtttccctgtaattatctttcttgggttctttgccttaactttggccctaaaatagtaataattggtgagagttttgagtttggagaggataaagaaattgtcacggtgcagactcttgagataaatcaatattgttaagaaacttgaatgagagctcacagtctgtttagggcttttattctcagtagagtttttctctggacctccggtaaaaggcattccagttaacctaaagagaaaaactacattgtcagaatcttaactatatgttgcaaaattatattctgtatgatgccagcttaggtgggtagttcctacagtacaggaagcttaacaatctctaggattaaaaga

SEQ ID NO: 28655 - DNA, 1051 bp, Homo sapiens
actattcttgggtacaagtgttttattggaatttttaaaaactaatatcattgtgataactcatgttcattgaacatttattgtgcagctggtattgtgcttagcagtttacatgcgtaaattcatatagttctatattcctaggaggcattagattttgttccctttgttgatgtcaagtttacagagattaagaaacacatccaagattttaactattacattaatactgcctttagcttcaaggaatactgtgtttaaaacaggcaaagtcaggactaccaaatgagagaggagatcatattagacattttagtaagattgagttaatagttttgctcagttcttgtgaaatgtcaggacagcatcttttacctctttgctctttgggtgttacttacttttctttgttgctcatggctgtaggaattgaggggagtgatgatgatgctttagtaactggagaacaggatgaagagctcagccgatgggaacaggagcagataaggaaaggaattaatatccctcaggtacgacaaaagaattaaactaaaaattaaaagtagattaaaaagccttttttattttgttaaagtaaaaaattccgtattgaatctttgtcattcatttcaagtaacaaaatcccatgaggagacacacacacacacacacacacacacacacacgcacgcacgcacacagagacacgtaggcttttagaagaaactgcagtgtgttcggctttttgcagtcagaatgatggaggaatttccaatttcttagatgagtttttctcaaagtggtccttcagttagcattagcattacccggtagctcattagaaacgcaaattaccaaattatcagcccccagagacctacagagtcagaagcttggggtggtggggccagcaatctttgttgaacaagccctccaggtgattctgatgcacactaaagtttgagaaccattgctttaaatggaatgtttttgtgcgtgtagcttatttttttggactttaagaattattttgaagaagatggatttctca

SEQ ID NO: 28656 - DNA, 2008 bp, Homo sapiens
gtcagcttgtggtggatgtagttactcagaattgacagcacctttttattttagatattttgtttcggattcgttaataacttggtgatgtggtttttcagaaacattttgaatgattttttcccctctcaaatagatgatttaaggacgacaataataggaaaattttgtgaagttacatgtgctattcctttaaaaagtctcaaaaatctcattacttcacagtaatttaggaagttgacctctgtttttgagtctgtgacagacttgaaataattatacaatgattttggcatatgagtatatatatttgggataatttggacagcacgtaagatcatgtgaaagaagggaaaatattttcagaaaatagttgctacagacttcatttaatttcctttttaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtaagtaccaaactaattgaattcttttgaaatgacaaaatgaaagctctttctcacagtgatttgctgtatatcttctgaactcattcagtggaccctgtggttgtcaagggcccttattgagtagcagtacagttctgttatttaattgtaacacagatgctttgtaaatgtattttataagaagacagaattgttgccactggaacatttctgctgcaatgactagattctctcacagttttcctacttgtgtgcagactgctgttgaacagagaaagaaggtttctcattttagcctaagacacaggtttatttctgtttgaaggagtgttgtgcaaattcttgtattttgtagagacagatttgcgatttctttggtggtatttccacagtggattttattcttagagaacttttaggaatgccctaaatttaatattagtattactcccattcagcagccttatctgatactagatgaagactccttagaataatgaggcaggtatattgtacagacatctcttacgtctctcaaaacctcagtttaaaaaattttaagcggttattttgtctttaggaaagtggatccagtataatattctatggtctgagttattctcctgcaaatgctattttattttatggaattaatgagaaaatcatgattttccagattctcacttacaggcttattgtgaaaaagtatggctttgtatctcaaatttacaatctagatgtgaagacaatatctcataaatgtgtaagaggactcagtgtttggcaaaatgttcaatcagtgttccaaagggtggctactctttcagaggagagaggactgctttatggaaaaagtgggactcgaagatggatctttgatagttaaaattccgaaagggaaggtattgggggtatgatcaaggattaaaatgactaaagctgttttggaaaagaacaagtacacctgacaggtcagagtagatgatttgtgaaggaagtagttagaagtttcatgtgaaagatacgttgacagattgtgaaggatgttcagtatccagtaagggtttacatttgctacagtggcttgccaagatggtgacatgataaatgcgttttgaaactttagcctggtattaacatgcagcatgaggagagattggaggcctaaagcagtttaaactcaagggccagctttgatccattaatagtgggtttaaaaaggtctcacagttgagcaagagtaaaggcttctactgatttagtaggaaattctggatgagttaaaaatgttttctgttgttttagggggagaagtggaaagaaagaatgatttgagaaccattccaagggaagaattgataggcttaatatacactttgccatattggatttaaaagaaagagtcaaatttgaacttttgtcctggagtgtcttaatccattttctgctcctgtaacaatactacagact

SEQ ID NO: 28657 - DNA, 1027 bp, Homo sapiens
acttcccaggccttaagaaagaatacagttatgcttagccatcgtagttaacagactgctttacaaaataagcaaattaagaccaacactgccatgatgtctaatttaatttttaaaattgataggaatcagtgaagtacctgtcaaagcatattgagaaaatgaattctgtgttgcttgttccatcggttttttcctcatgatttgttttcctatctttctagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaa

SEQ ID NO: 28658 - DNA, 1034 bp, Homo sapiens
gtttgctatgattgtgcctgtcagtagctgctgcactccagtctgggcaatatagtgaggccccatttctttaaaaacaaacacaaaaaacctcttgaattcatgaaagaaaataaattaacagactgtttaaaagtcaagaatttattttgtatgtttttacgattttgcatttcagtgttggccataggaggcaaaggagcaagttactgcttcctcagcagttttgatgtagctagaaccagcaattactttgactaaaagaaaactttgtaagttcattgacttttatccagagtaagagcagtcctttgctttgggggaattaaattggcattttcttctttcagtttcattatagatgtcttacagttaatgaataatagcagtatgttgtaatatacaaaatgtatcattatgaatggcactgatactttattactgccgtttgcctatataaccgtctaatctgttttactttgtgtatgtagatactgatgtttatccgggactagctgtgttttttcaaaatgcacttatattttttaggtaagttgccttattttttaaccacgcctgtaacatttacagaaatgtcaacttaattaaggcagcatatatatggaacacatataaatcccatggattggttacaatgatagaacttcttttaaaaggtgagaattccactgttacataagagcagagaggccttttaactagaggtcttgctgtgtatcaagactttagctggatcctttatatattttaccctttgaattcacatttaggccaagtgctgtggctcatgcctgtaatcccagcactttgggaggctgaagtgggtggattgcttaagtctaggagtttaagaccagcctgggcaacatggcaaaaccctgtctctataaaaaaatataaaaattatctggttgtggtggtgtacagtgccagctactcaagaggctgaggtgggaggattgcttgagccgaggaggttgaggctgcagtgaggcaaggctgcaccactgtac

SEQ ID NO: 28659 - DNA, 1100 bp, Homo sapiens
gtttatgttacctcatttcataaaaaagcttggaagctttttatggatgtcttttaacaattaaaaaatattaaacattaagattacatcatttccttataccatcaggaggtttttttgtttttgagacagagtcttactctgttgtttgggctggaccacactggtgtgatcttggctcactgcaacctctgcctcccgggttcaagtgattcccttgcctcagcctcccaagtagctgggattacaggtgcctgccactacgcccagctaattttttgtatttttagtagagacggggttccaccatgtttgccaggctggtcttgaactcctgacctcgtgatttgcctgctgtggactctcaaagtgctgggattacaggtgtgagccactgcacctggccaggagttttaaaaaggttatattttggaaaatggaactacttatatccattgtggcttctaaaaaaaggaaattcctgttactaattaatgtaccttgctctaacaaaaatggaaggggaagctgaataaagtgggcatattatacataagctacattttctctgagcttaagaaatggatcatagaaaatcacttgacttttaacacaaagagaaactgtttaactcttgataataatgagaaccttgaagtgggatagcactgagtcattcatgtataaatgtgaaatagacaaagaatccagaaaactggtccctcttgtataatctctggagagaagtgatagaaatctcttaaaataaatgtgttttctgggtgtactttatgaaaataagactaatgtaacatttctatcaactagcatttttattaggttaaaaatatgttaaattattcagatactgattttagttatgaaataatctgttttccgtctaagtgttatataaatatttgagtattttaacagcgaatactgaaattcatttgatgattttgtgccgttctaggataaatgctgtatccaatgctcaggtgagaggtgatagctatgaaagcggctgtttaggaagaacaggtaaagatactttgagctgttaatgggtgttgacaaaacagaaatttgtcaccaga

SEQ ID NO: 28660 - DNA, 1029 bp, Homo sapiens
cacgcctgtaatctcagcactttgggaggtcgaggcaggcggatcacttgaggtcaggagttcaagacctgcctggccaaaatggtgaaatcccgtctctattaaaaatacaaaaattagctgggcatggtggcaggtgcctctaatcccagctacttgggagagtgaagcaggagaatcgttggaacctgggaggtggaggttgcagtgagacgagatggcaccattgcacttcagcctgagtggcagagcaagactctgtctcaaaaaaaaaaaaaaaaaaatcctaataataatgaataacatttaataaggaaatgtccagaataggcaaatccagaagacagaaaatagattagttgttgcctaaggtggatagaggtatttggggtgacaaaaaaagggtacaggggtttttgtttgagtgatgaaaatgttctagaattgattgcagtgatagttgcacaaccacaagaatgtactgaaagccattgaatgtacatgtcaaattcatgattgcatggcatatgaattatatctctaaaactgtttcccaaaaggagagacccaacttgtctgtcactcaaaaaaaacaaatcaattttttttctttttcagatggagtttcactctgttacccaggctggagtggagtagcgcgatctcagcttactgcaacctctgcctcccgggttcaagggattctcctgcttcagcctcctgaatagctgagattataggtgtttaccaccatgcccagctaatttttgtacttttagtagagacggggtttcactatgctggccaggctggtctggaactccccacctcaagcaatctgcccacctcggcctcccaaagtgttgggattataggcatgagccaccgcgcctggcctaaaaaaaaaaaaaaaaatctttttttataaaaaatttgattcatagtttttttaaatacaacgagtacattgaacatgcttcacattcagaacatgaagtcttttaaatgaatataggtagaacttccaac

SEQ ID NO: 28661 - DNA, 1065 bp, Homo sapiens
cacttgtggtgtgatataaaatagacaatgcctttggtgacatgagccacacagaactaatctagcatctgtctggtggacaggtcactttgtggttagaagtcaagcacatagatgctatgtaagaacctcttgcttatttttaatagtacgtgccagcaacaagctggtattcagcttgaactccccaccttcctgtcaccatgaatgtctgttcagagcaccccagcatgcctttaactgtgcaaggcgggtacttgctgcttccagggccttcttggatgagaacttacttttacctcatttctgtgtttggcaaagaaaacatccatcccagaaatccaactcctgtttgacttcggatctagataggaaaacgtattcctttaacagaatacccaggatttttaaattctgaccactatgctttttttaatttttaggaaaaatgctcaatatccacccatccttgctcccttcttttaagggttcaaatgcccatgagcaagccctggaaaccggagtcacagttactgggtgcactgtacactttgtagctgtgagtatgtctttttctaccaacataatattagtagtcagatgtaaatgacactggctagaaggtaatgttcaaaacttttgcttacttttccaggaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagacatacagttttcttggtcttttttatg

SEQ ID NO: 28662 - DNA, 1013 bp, Homo sapiens
ctgtgcttttcacaatctattaatccattatcccaagaggaagggagtttttttaatttttaatttgtatgggtacatggtaggtatatatatttatagggtacatgagatcttttgatacagccatacaacctgtaataatcacatccctgtaaatggggtattcatcacctcaagcatttattctttgtgttacaaacaatccagttattttatttcagtttttttttgttttgtttttgtttttgtttttgagatagagtctcactctgtcgcccaggctggagtgcagtggcgcagactcggctcactgcaaactccgcctcccagtttcaagtgattcttctgtctcagcctcctgagtagctgggattacaggcacctgccactatgcctggctaattttttgtatttttagtagagatggggtttcatcatgttggccaggctggtcaggctggtcttgaactcttgacctcagtatgatccgcctgccttggcctcccaaagtgctgggattataggtgtgagccaccacatccagcctcttccagttattttaaaatgtgtaataaattattgttgactatagtcaccctgttatgctatcaaacactagattttgttcattctaactatatttttgtacccattagcatcccctctccccgtctctcccactacccttcctagcctctggtaaccatcattgcactatcatcatgagttcaactgttttaatttttagctcccacaaataagtgagaacatgtgaggtttgtctttctgtgcctgacttatttcacttaacttaatgacctcccgttccatccatgttgttgcaaatgacaggatctcatcttttttatggctgaatagtactccattgtgtgatgtaccacattttctttatccatttgtctgctgataaacatttaggttgcttccaaatcttggctagggagaataaacatgaaactgcaggtatctctttgatacactgattttctttc

SEQ ID NO: 28663 - DNA, 1058 bp, Homo sapiens
ccatgtaatactacttagactttttaagttacctgttacatttaactgtttctgcacgttctccaggtttctaatgatctattactaaaaattaaagatactgttcttcagaggacagtggatggcatgcagcaagagggtactccatatacaggtaggcccacccacattactatggaagccacctatagagtaactttctacttttgataaaacttattttccattcccttttttttttttttttaccactttttaatggaccattttttaaatgtttatgatttttccaaaactttgattattagaagtttatgtagtagattttatatttgtaatacagtgtcttcatcatagattttctttctctcttttttttttttttcttttttaatgaaggtattctctatgctggaataatgctgaccaagaatggcccaaaagttctagagtttaattgccgttttggtgatccagagtgccaagtgggtaaaaatatcaaagtattacttggtagaagatatgtggtattttaatcttggaatttatcagcctggaagtaattacctttgggaaattcatgcaagttctgctagtacaccagtgaataaaatgtttaaggaaaactaaaatttatcccacctgccatgtggattatgtttttccaggtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacaggtgagtgtcagggagcaagaggttggagtacaacgtgacaagtgccagcaccacagcagacccccctctcacactaaggcttgctctcgataagagtgtgaagccatcagaaacctttcagagggtcttaaccatgttgcttattggatatgtgtgttcaaatatccgcaattactgtattcagagaaccgttgatttcccttcctgtgcaaggaagacat

SEQ ID NO: 28664 - DNA, 1069 bp, Homo sapiens
cccccagcacaggaccataagcgattactggagggagatggtggccctaacacagggggaatgggagcctattgtccagcccctcaggtacttcccgaagactctgctgaagtcttgtagtagtttggttttctcagagaactcttagatgatactttctattttgttttgttttctgtttgtttgttgctatgaattatgttactaatcagcaattaaatgaggagtatcttttctggtctctaaaactaacttttcctaaaagccttttttgaagaactaaaataagccaatctaaagtatagtatgggttgaatagatcctcctattccctcctctctgcagccaatttttaacacatgggagcctgtcgtggtcttggattcatctttggatatccgtggttcagcacaaaagtgttgtctgtgtgtatctgtgtgtgtgtgtgatatgaattgagaaccaagtcacatcagaatttctagtgtgcgtgtgatatgaattgagaaccaagtcagatcagaatttcttgtgtgtgtgtgatatgaattgagaaccaagtcagatcagaatttgttctgatctttctacttcataacagacaacacgtttccaaacaatttcggcacagtttttgtttttgttgttgttttttgagacggagtctcgctctgttaccaggctggggtgcagtggcacgatcttggctcactacatcctccacctcctgggttcaagtgattctcctgcctcagcctcacaagtagctgggactacaggcacaggccaccacgccaggctaatttttgtatttttagtagagatggggtttcaccatgttggccagtatggtctggatctcttgacccgtgatctgcccacctcggcctcccaaagtgctgggattacaggcgtgagctaccatgcctggccttctgcacagttttttttaggaatttgtgctgttggcatataagtaggttaacaatccgaaaactcacctattcttttcattgaagatagtcataatgtttgtgctaatgtagtgcccctttacatatttttcttg

SEQ ID NO: 28665 - DNA, 1027 bp, Homo sapiens
tgcttatgacgacagtcatatttctcaaattatgaatcccagtttttcaaaaatgaatcattggatgaaaatgtcatttgtatgagtacaaatgattacttaaattatatttacaaatctggatttcttttttttttttgagatggtcttgctctgtttcccaggctagagtgtagtgacgtgatcctggctcactgcgatctcctcctaccaggttcaagcaattctcctgccttggcctcctgagtacctgggattacaggcacccgccaccatgcctggctaatttttgtattttagtagagatgaggttttgccatgttggccaaggctggtctcaaactcctgacctcaagtgatccacctgcctcggcctcccaaaatgctgggggtacaggcatgagccactgtgcccgtccctgggtttctaaaatgtgcatcctaagatataaactgtggttttctttctgcaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccggtaatcatgttttaaagtggggagtaatagttattatttgttattaatggtatgctgtcaaccatatctgtactttatgttaataaagataggctgggcacagtggctaatgcctgtaatcccagcactttgggaggccgagatatgcggatcatgaggtcaggagatggagaccatcctggctaacatggtgaaaccccgtctttactaaaaatacaaaaaattagccgggcgtggtggcgggtgcctgtagtcccagctactcgggaggctgaggcaggagaatggcttgaacccagggggtggagcttgtagtaagctgacatcatgccactgcactccagcctgggcgacagaatgagactcca

SEQ ID NO: 28666 - DNA, 1034 bp, Homo sapiens
ttgtgttttaaaccaggtatcaaactgaattattcagaattataaacattgcattaaatgtttaataataccttaagaaaatttttttacttcataggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtaaaagtttaggtttaaagtgagaatactatactatatagtaaacctattttggcctaaaagctatttaaatttaaaatgccttttaccagttgattagcaacattaagaaatatattatttctttatttctggctttttttccctcccccacaattatttaatccagcagtccgcaaactttttggcactagggatcagtttcatgggcagtgaggaggatggtttcgggatgaaactgttacacatcagatgatcattctttttttttttttttttttttttttgagatggagactcgctctgtcacccaggctagaatgcagtggtgcaatctcggctcactgcaagctccgcctcctgggttcaggccattctcctgcctcagcctcccgagtagctgggactacaggtgcctgcaaccatgcccggctaattttttgtatttttagtagagacggggtttcaccgtgttagccaggacgatctcgatctcctgacctcgtgatccgcccgcctcggcctcccaaagtgctgggcttacaggcgtgagccaccgcgcccggacaagatcatcattcttataaggagggcacaacctagatgcctcacatgcacagttcacagtaggattcgtgcccctgtgagaatctaatgcgaccactgatgtgacaggagatggagctcaggcagtaatgttcactcgacagtcgctcacctcctgctgtgcagcccggtttctaacaggccacaggcca

SEQ ID NO: 28667 - DNA, 1015 bp, Homo sapiens
cgtctcaatttaaaaaaaaaaaaattcttgtattgtggagaacgtcgacctgaagcagacaggttgaggggaaatatttgaagtcaggaaatgtttcttaaatatgggctttgttagccctggatgcagagtttcagaagcttaaaagatccaaaatgttttaacacttggaatatttctacttcaatacaaacatctatactaccataaagaactgtaaaaactaaaaagtgaaatctgcccctccaccacccctacccccaacaacaaattcccgcttcccataggtaaccatggttaaaagtttagtgtgactcctttcagacttttttacagtgtgtaatgtatttttcatgttatttattatacagcttatatgatttttacttttcagtgatcatgttagctgataaaatctttaggttgaaggttttttcttgatactcgactaatttttgcattctttgttttctaaagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggtaactctgaaataaaatagttatgtgttaaagtaacaaattaagtgtgaaatgctctcctttgcaaaatagcagatgctgccttccattaagtttttctttggaaatttaaagatacaaagacaggaagttttgtctttcccagatggtgcttatggtgctttcataccttttttttttttaagtcagattgagtaactgctcatacatttagagacttgtcttgcaaattaatcagtgttgcaggcaagaattgttaaattatttttctctaaggctttttgagaaagaaaatacaaagaaagaagtgaaaagcaattgggtgggattgcaa

SEQ ID NO: 28668 - DNA, 1030 bp, Homo sapiens
ggtctcgaactcctgacctcaagtgatctgcccacatcggcctcccaaagtgctgggattacaggcatgagccaccatccctggcccctttttttttttaattgaaaagaaaaataggactcaattggtattttataagtgaagagcttattacagtggtaaatatttaggggttatatatttaaatccacaagtaatcatatattgaatagaatgaccaatattgtctttttatgatgaaataatgatctttacatacagaacagtaagccttatatcaggcatttgatataatttgtttctaaatagacctatacttaatattcactaacaggtggttcatgattaacgtgtttgcttttacctcctatgcgaatgaataaatgtgttaaggtatgttagagtatatttgagttttacctgggattttaacgtagaatagatttgatactctatgtaatcttctgacatagctaaatgataattatgtttcttttttctcagactgtagaaaaataaatacaataactagatgatcattcattttacatttaatgagcaattgctaactgcttaggatataagtgaaacgaactccttgcccttaaacggttcactctctaggggagagacaaatatacacatgagcagattattatgtaagcttggaagaaagttgcttaacctggccagaagaaacaggaaaggcgtcttggagtaagatgtccaaatcataaggggcaagcatgttgagaatcacacctagcagggaggatattatgagcaaagacaagcaagtgaaagtgggatgtgtataagaattacaaagagtttggtattgctagagcaagataaagtcctgggcaggcgtcaagggtatggtacttggtagcagagaaacattttgtcaagaaaattctcctcctaggctgggcttggtggattacacctgtaatcccagcactttgggaagcagaggtgagaggatggcttgagcacaggagtttgagccaacagagcaagaccctgt

SEQ ID NO: 28669 - DNA, 1032 bp, Homo sapiens
aaaaccagacgactcctctcttaaatatattaaagtatgcagtctaatgaaggtttggctgtttagtgttttataatctttcttgaaaagcaaaaacaaatttaagaaagttcgtacagtatttttaaatttttttgaggaacatcattctatataaaatcctggtgcagtgcacagtgtattctgaaaggcagtcagaaaattgtttgattataatctttttttcatatgttcttcggcagtgctaatttaattcataaaatatttaattcataagaaagtgtttgtatggccgggcacagtggctcatgcctgtaatcgcagcactttgggaggccgaggtgggtggatcactcgaggtcaggagtttaagaccagcctggtcaacatggcgaaaccccgtttctactaaaaatacaaaaattagcgggacatggtggtgcagctattcgggaggctgaggcaggataatcgcttgaacccgggatgtggaggttgtgtgagccaagattgcgccactgcactccagcctgagcgacggagcaagacgttgtctccaaaaaagaaagaaagaaagtgtgtgcatggcacatccttcatttgtgctctaaaaaatttaagaaattattttttgatgctttcagcaaatcctgaaggaacccaaagtggctgcttctgttttgaatccctatgtgaagcgttccattaaagtgaaaagcctaaatgacatcacagcaaaagagaggttctctcccctcactaccaatctgatcagtgagtattagaactttttcatttgaggtgtcttgaaactatgactggaaatgtggtccatggactgtgggcggcatcagcatcacctgggagcctgttggcagtgaagaatctcaggcctcacagcaacctgctgaatcagagtctgtatcttaaccagctccctaagtgaatcgtttgcacattgaagtgtgaggagcatcgtctaaaggatactaggacctaagcatgtctaattgtatagtcagtagtttcaac

SEQ ID NO: 28670 - DNA, 1033 bp, Homo sapiens
atgcaggggaccgtttaaagcaaagacattgcagtaagctgaatgtgacctgctcaaaaaacagtctctcttctctaggtcctttcctgtgcaagggacattctggggtaccccgtccctcagccatcatttaatcccccaggaaagatatttgaggctgactcgcaggtttgtggttatttctgttgtcattagagatgtgctttacttctttcagaaagaagttctgatgagcttacgggacctagccccttgtttgtttcacattcatccttgtgtgttatccagttgtctcttaggaacttcagaattgcatatgagcgttttcccctccaagcttcctggtctcaatgatgagcacgcctgtccacacagtgactcaagctatggccataaaaggtgtctcctgtctccctgtacccgacttcagccactctcaagtcctggccattctctcttctatctttaggaaatactctcatactccacccccagagccattctcttaattcagcccccatcatttctcactttattataagcaaagcttcccccattccttctctacgctactgtcagagcgagcttttgaaagcatcaagtcttcaagcctatgtctgatcatcttcgaagaccagtctcagcctcctaacatgcatccatgtaccctggaaattctttctcacctcccgtgaagactgcaggcatgacagggcgtctgcagttctctgggtgtgccatgcgtcccctacctctgtgccttcaccttcgatgctttcctctgactttccagcttcaaatcattcttcaggacccttcttgagcatcgtgtcctttgggaagctttgcctgacatctgctcaatcccaccaagcagaactacatgtctctgctccgggctcctgcaaagccactgcattccccagcacaactctcaccagactgcaacagttggcttccctgcccatctccccagctagtttgccaatgagttcaatgtatttgtttctgatttctcagcacctagcagaat

SEQ ID NO: 28671 - DNA, 1050 bp, Homo sapiens
aaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaaca

SEQ ID NO: 28672 - DNA, 1027 bp, Homo sapiens
tttaaacaagaatgatttataaattatttttcataataaactacactgtttgtggaaactgaacattgcccttggagcaggcagaagtaatatccattaaatgcatagcaaaacatgaccctcagataatttttgttttcagtttctaatgccacagatttacatgaagcgattaaggacgggtggttagtgtatatttaattttgttatttggattcaggatgctcttatgaatcctctggtgaaagtcagaaagcagaattatgggtacaggttgattttcaaaaagactttgtcaccaggcaagcaggtacacgcttctgcaatggtttgaggaaggtattatcttttcagtttttacctcctttggactgacgtcctctgtgtcctttgtagttttccccctggctgtccctaattacaccatctcatctagcaatttgatgaaaacctcaataggtgttactatcaacaggattatatttcacagtggaatgtaattttccactgcagtcagtgatggaagaagagtggtcagtaagagaaaaccttttttgcaagagggatgtatttgaggatttattcacaagaacgaactatcattatgaagttttatttttgcaaggtacaattttttttttaaccatggtgacatctgttttcttagatgtggtagaaacattcaaaaagagaaatactctggtgttggaaggcttatttttcatcatcattttgctttgaagttgtttggtgaatgcattctgaatgagacagtttggctatttctagcacaattgagtttctgatttccctttggattcttaatatcttttgagggccagggagggatattaatagagattacttgaaataagctgtgagatttttctgcgtctagaatacaggcaacaaattgttgcacgatgacagcagcaggctgtgattgttccaggctgtccttggccagtcctatcttcaggaatccaagtaggagcaggaacaaccattcccttattccattcaggag

SEQ ID NO: 28673 - DNA, 1398 bp, Homo sapiens
atgagggagggttgtgcactgatgtccaattctagggtcctgtgagatatacagcaatcagtgaaaacccaaaaaccaggtgggctaagggagtcccagtctctgagggcaaatagctctatgcagtgggcaacctgagagctaaagtcacagcgggtccttggtaagccttgcagcaagtggaccatttctcatttagctgaaaccatccttctaggtgggaatatgtagtttctgcggtttcaatgtggcagtcttactgttaagactggggtgtcacctttggatgatgtaatgtaaatgtaaatctactttaggttggtggtatctccccttgtgtaaacagatcattaactgcaatgctgacaaaagtccctgggggtctggccgtcccctccttagccagtctgttggatctggagagtgatggtgtgaggaaaaaagactggatcaaacttctttatatatagtcacatgattctgtaagcttagtcttcaaggaaagaaaaaaaattaacctgaactagaattcttttgaaaatttacatcagaagctgttttgtaactataattgcttggccagatatgtaagatttgttttcattggctggctcaggatcaatattgtaaatactgtataatgagtttgttaattaaatgtattagattcacactgttacagatgaatgaaaacttttattaaaatatgattattttctgtttgtacaaatatttgatgaacatattccattatagtactctttttgtgagtctttttttcttttctatttagaaaagcaaaacaattcaaaatgctttgaaccagtaattacatgtgctttgaattgctgaaaatggttagttggttccctggaataagagtttattcagtcatcatcaagctgaccaggaatttaagagttctcagataatattccgttcatttccaagcagtgaatatagttccgtatagtaatggaaacaaatacccttttttcagttgtctgaaatatgaatgtatatttgattcatagagctttgctggaaggctaagtcagaaaattatagaaaaatttactcttttcgcttgagtaaacttacctaaaaaaaacaaaaacaactcacctaagatttgtgatagatgtagtgctatcatgactttcttttaataacaaaatattcggatcagcatgaaagaagtagaagtgacatccttccattctttatgtgagtagagacctttgagcagtgctcccaaccttagctgcacgtcagagtctctagggagctttgaaaaattcccatttccaggccactccaaacccattccaatctctggggctgggaatcgcctggaaagctccccaggtgattctaattgttagctgaggttgggaa

SEQ ID NO: 28674 - DNA, 1030 bp, Homo sapiens
tgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcg

SEQ ID NO: 28675 - DNA, 1048 bp, Homo sapiens
agctgtcatggcaaatatttagccccatcaatgggaaaacacttccaaccaaaatacctggacctcctaagccccagatttcctactcttaaaaactctctgtgaatatcaggggatcccaactccccccacacttctgctgaatcaggggacaccaggccagccaaaaggacagaagagctacagctggatgggtgaactgcgcagactgatgggtttgaataagggatctgagacaagacacaaagatgaaaaccaacatttgaatatagcatttgaatctgagcatatctagaaggcctaagatattgtattatcaaaatgtgtgtaaaaaagatagtttgaccaaatggatggtcttttgtagtatgacgttgctcatgtgtacatagaagaaggatcacaggcagcattgcagctctttcttttggatgttctcctcacaagtgaaagaactattttcccccaacagctgagaccataacatcattccagtacttatgtccatgacaaatcacggactcactctggattccagtaacttggtaccatcaccacattaccatgtagtagttggaacctactggcagagcatgtccagacattgctgtaaaacagggtgacctttcgttcattttccagtggattcacctttttgtctcagggcaaatgaagcaagaggaataatgggcagagtcatttatttgtgtccagagtattgcatcagatgacaacaaactgactgtatttgcctaatgcttttcctcctgtcccagcttctccgtagactctataaatctaaatggaaaaatggagtaaagcttcctgttaactctcaaacatgtcacagctctccatgtcagcaaaaacaagtgacacagggcttgctcacagatggccccaaagagcgggcagggatgaaccctgtggaatgaggtgtggcctggctcgagaatgactagagtgtggccaaggaagggcagcctcagaaccactgtccgtttacaacgttttccctgcccacatgtctgcctggctttgaaaagat

SEQ ID NO: 28676 - DNA, 1114 bp, Homo sapiens
ccactgcactccagtgtgggcgacagagcgagacactgtctcaaaaaaaaaaaaaaaaaagtttccatctccctgcctacatcatccatctcttcttgcaccttgtcttctttttccactagagccattaacatgttaatcattgttaaattccctgtcttgtaattccaaaatctgtgtcacatctgggtctggttctgatgcttgctttatctcttcagactgtgtttttttcttgcctttcttgtaattttttattgaaagtttaacatgatttatcaggcaataggaacttagtaggcctttagcgtgagttattattctcatgtacccaagagttgggctgtatttaatgttttcagaaggtaccagagacttcaaattcctctagcgtccttgtttttgtctcccatgtcatctgtgagcttctctatgaactcctccttagtcagtatgttgaagctctttcagccataacccactgttataataatatattggatcctgtgagaatctggtggagttcctgaatgaaaaacccacaacagtgcacttcctcctgaaactgtagcccctaggagtgtcttattcgcacactagtctgtactgagcctctagcaatctgtcaaaatcaccattaagtgttctcatcagtttatgaattcagaaattctgctcccagcaagcagacctcactatgattctctatatttgcctgcttctcaaaatttggggttgcagtttgccctgcaacttcagctttccattggacttaagaaaagtcatggattttcagtttgttcagcattttttcttataaaaacaagagtgatgactctcaagctctttaaattttggaactgaaactagaagcaacaggacattctgacatgaattatttaaaagggtcattgttgactctagagacattttaatattgctgcatcaaaagataaaagcattctcctttcttcttgtgtgatatatgccgtgtacacctctgagctcaccactaacctcaactctaccttatccctaacttcccatttcaaatggaagggaatggggatcaaggagtagaaggcctgttttacccattattgatgattaaaaa

SEQ ID NO: 28677 - DNA, 1045 bp, Homo sapiens
tgactgagaaggtgggggcagggcaggagaagggggaagaagggagaatggatcaaccccaggccggggaaagagatgaatgaaggtccacgccagagtgacatgctctaagtaggggaaatcttcctaactagagttcccatgactttggcaacatttgaaaaaaaaaaaaaaaaaaaaagacatccttaaacccacaaagtactcaattgtccaagccccattatggccaacttcccaaagctggctggtcagagaccttggtgttaattcctcagccaactaaaaaaagatggtgtaagttctgttgacttaattgttggagtgtttctgagtggggccgcctccctcctctgcctcctcacagtattatgggctattctgcattacctgccctacctatcttcataatctagccgcaaacagctttggttgaccacaccacttccctattgaaagttaatactgtttgactcattctgtgttactaacctgaagccaaagaaaacaaggcagagaataactggcttgtgtggagtttggaaagctcttggaggccctgctttcaaaatcctatacagtagctttactatatctctccgctgcagctgctgagaaaatgaaggaagcagaagtggttaaaaaaaaaagttgggggtggggaagagactgggaagggagtggggcggggtccccctccggctgggaaaagacagggtaatctgcggcagtttatgagggctgtctccctgagctgaggtcttgctttcacacaccagagtgttcacacagaagagggactgttgaaggagttaaaaggagaggaaagttcaaaacagttgttgaaaaggcagctctcctattgcctgcgtaacacagaggagctgggaggctggtctcaccaggccaggcagccataggcagagactcaaggtagacaggccagggggaagttgtgtacctttcgaatcgggaaaggattgaggagggggaatgttgccggacagaaggctgtcctgggcgtccatccttgccctccatccct

SEQ ID NO: 28678 - DNA, 1044 bp, Homo sapiens
agatgccgggaagtacaaacctggagggaaggacaggcctctgcagctgcccccctcctcacaggcaaggatgaccatgtctagagctcacgggattccttttgggtggaggcagcgttgcctctgctctctgggcagcccgtccttgaggaccaggctgttaacgtagagtcttgtgatgtggtctgtttaagggtggggcttctagcatccatacatcaggtgacatctgggatactggcttagagggcagctagggagtaaggtaaaatgtgcagctttcttttttctttttttttttcttttttttttgaggtgaaatctcactctgttgcccatgctggagtgcagtggtgcgatcttggctcactgcaacctccgccttccaggttctagcgagtctcctgcctcagcctcctgagtagttgggattataggcatccaccaccatgcccggctaattttttaatttttttcatagagatggtaaggtggagccattacttacaaactgtagagtgcttcctgaggcactagctttctttctgtctgatttttgtttttagagggagttatagttaaaataggttgatcaaagggcctaatcttcactcagctactttttaaagtacttggttgagatcatgtcatatgagtataattcttctatgactttgagtgtgtatagcaaacctattatatatgtgaacatgagaaataggatctttatatatggagaatgtgcttcaagtgaagaagagaaatgcatgaaaagtacctatgggccaggcgcagtggctcccgcctgtaatcccagcactttgggaggccaatgcgggcggctcacttgaggtcaggagttggagaccagcctggccaacacaggaaaaccccatctctaccagaaaatacaaaaatcggcctggtgtggtggtacacgcctgtagtcccagctcctcaggaggctgaggcaggagaatcggttgaacccaggaggcggaagttgcagtgagccgagatggtgccactgtactccagcctggg

SEQ ID NO: 28679 - DNA, 1928 bp, Homo sapiens
tcttttccttgttcactggaaaactgagaggcaaatctgaggtgcatgcaaacgtacctagtgttgggacatgcggtttcgcactggcccattcctgcagtgtcttgtcttttctccttttgtcttcctttgtcttgttttctgccttcattcatcttaccttttattttgtgtgtacttatgttagcttctttaaatccttctggcaacaaggtatgagtccttttcggacacttcagcctaaaattaaatacaacaactggctgtttcccagaggtcttccttaggcctcttttcttgcatttgagttaccgcttactgagtgggtgtggagaaagcacgtgtggggctctggctggggcgtttcagttctttctgcctcactagctctgtcactcagggtgagtgcttcaactttgctgagtgtttctttgagtctagcatgcggattatcgtgctttctttgctaggtaactgtgaagattaaattaggtaatggttattcatgaacaccatgcctgacacacagtcatttcctttttctttactgagaactcatttcacctgtcatctctgaaactgaagccttctgagactattccgggctgtgtcttgccagctgttctgaatctaatgggctcctgtttacttccacagcagccatctttcctccccttcgaagccacttccacttccagattctcggtgttcagaatccggtcctccgtcgtctttctcccggtagttcttctttctagtgtctaggtctggcgctgccacctctgctccgcatcctgctgtggctcccttgcacctgccacagcagaccttccagagtgggccctgcctgctgactgagccccgtttcctgcgaacctttgtagtagagcactggaatgacctgcatggggatagaggcttgctgtagattcctccttccagacatggagcatttggctttgtgaattgtgcccagtttgctactattttggacagacggtcacttgaaggaaaacttctgcctttgctccttagtcctctgcctttcggctgtggactcgccctcctgttctgtcactggcttcgttcccatggccgggaacgggacttcattcactcatgggtcagacacaggtttgtgatgataataacattcagcccttgcctgcagagagtacccaccccccgtgcttttattctcagctcctcctcctcctctctcattacctggtcggcttccacatgggagctgcaagtggcatggaggtttggggaatctgcttatggaatgagttgtattatgctcctggagaaataggagaaggagtttatgtgttgcactgaaacaaaaaaatctgttttttgagagcctgctaaaattgtgtcatggaacattttggttctagtacatgctggaaaaaagtacttcttggggaggtaatttcagatacgaatgagaagacaagtttggacatagcccagaaaatatgctattatttcatagaagagactaatgctgtgcttcaaaaggtatgtttctagaatatgacatccttaaagaagtgtcttgattcagcagttccttgttttgtacatgttattagggatagtgcatttcataagagcattgtttagtgccttaaataaataaatgttgatgtaatctctatttttgttttctttgagatggagtttcactcttgttgcccaggctggagtgcaatggcacgatcttggctcactgcaacctccacctcccaggttcaagcgatcctcctgcctcagcctcccgggtagctgggattacaggcacccgccaccatgcccagctaatgtttgtatttttagtaaagacggggtttcaccatgttggccagggtggtcttgaactcctgacctcaagtgatccacccgcctcagcctcccaa

SEQ ID NO: 28680 - DNA, 1025 bp, Homo sapiens
caagctctgcctcccgggttcacgccattctcctgcctcagccacccaagtagctggaactacaagtgcctgcgaccacgcccagctaattttttgtatttttagtagagatggggtttcaccgtgttagccaggatggtctcgatctcctgacctcgtgatccacctgccttggcctcctaaagtgctgggattacaggcgtgaggcactgcgcccggccagctgtttactctttagaaaaaaaatggggagagaatttcctgttacttaggctttcttcttaagtatttgcagactgattttctcttgtcctttggccgaggttgcaggttacatgacatttagcaacctctttaaaaaggtgtttggctcttcagtcatttgctatgaggtcatgaaatactgaaatgatggatttgtcattatttgtttttctacttcagaaatttgacatttggatgggatggaccatcttggaggctactcacagcccttaagttgttatgtctggaagctgagaaattgtaagtttcacatgtgttggtcttaagctgtagcaacaggctagatataactttggagggttggtttgtttgtttttggcttgcattcagatacccagccagggaggaaaaagggatgtcatacattggagttgctttctcattatgtaacttgcccatgtagcgaatgtttcatttctaagttttaaccgttttggaattctggttttagactcagcatacatagttttgataatctttttgtttctactcatattttccttctggtgacctgaaatcctttaaaaagtgtgggcattggcactgttcagaggaaagtctctgagtaggtaggttttgcccaggacaagtagagctagagtccctaacgtcggtcctgccctgggggagatccagaaacctggctgaagagctggacttttccatgggggaggcaggtcggggagcccccggtgtgggtgtgcatcctggccaggctccctcatgttcctgcctgctgt

SEQ ID NO: 28681 - DNA, 1030 bp, Homo sapiens
gcctgtggtgcggagccttccttccttctccctcgttcctccttccgggactgaagcttagcttgctttcctgccccgtcccttttaaactggtgttgtagctgtcacagcatttctcttcgctctgatcgctgactgacttgctctttttcccactgagctctgaaatctttgagaatggggtctttgtcttgttcctctttgtcacctcagtgctcatggcagggcctggcacatagtaggtgttcagtaaatgtttattgaatggatgggtatttgtggggaaagggttctgggaaataatgaaagaaacctgatttgggaggtggtcacagatcgcctcctccccagcgctttccccaggtggctcatttaggaaatgagtgtatttgcagggcatgcaggggtagaggcctggcttggagagcggaagagagtccatcagttggctcacctgtaaccactttggggtgtgttgtggagggacatggctgggatctgtgtcctggccgtcgccttcatctgacattccactggagaagagcagccatgccttgtgagcccacgtgctaagctttcgtgctctctacgtgagatcagagcttagggaggttcccgctctgctttcttagcccaggaacaagggctgtctgcttgttacttttgtagaaagaagtatctttaataatcgggagcaaaggagcctgggattaggtgagtgtttctgtggttgatgttgacgaaataatatcaggagtgtgtagtgtgataggatgctagacatggggactccgtcagcagtgatttatttttattgggacttttggtgcatttatgtgccaaaccaatgagtttatagtttactgtaggaagaccacagcacgaactacagcctgtgggcgtgtggcccaagagccctgagctaagaatggtttttacactttgaaaggattgtgaaaatacaacaacttgtgacagagaccacatagtgctggcaaagctgaacgtatttactctctagctttttaca

SEQ ID NO: 28682 - DNA, 1035 bp, Homo sapiens
aggaggctgatggggaagaactgttttctggcacacgttctgctgggcctttgttttggggcatctttgaggacagagtgagagcgacccgcagtggaagggatttctaaatacaagggttgaaagagtataccgtttttttctttcttttttgagacaaggtcttgctgtgttgcctaggctgaagtgcagtggcgtgatcttggctccctgcaacctccaccttccgggttcaagcagttctcatgcctcagcctcccaaatagctgggattacaggtgtgcgccaccatgccctgctaattttgtatttttagtagagatggggtttctccatgttggtcaggctggtctcaaactcctggcctcaagtgatccacccactttggcttcccaaagtgctgggatataggcaaacggccactgtgcctggcgtatactgtctcttaaccattaggtaagtgctggtcttttttccccctggcatgtttttggaagagagtgaataggtcttttaggcctgtgtagagacaatgatgctgtcattgttaacattttctgaatcattctgaaattttgagtagaatgtatggcagtataggaatctggatgtcgaaggattgatgaaaactttctaaatacattcaggcaacatgagatctttttatcggcaattgtgcaagtaaaaatactgtgatacataatttgtaatagagcaggtaaacttaggaataaaagctttagaactgcaacaactgtatatgagcatattcagttttggtttaggttggtgccctccaatagagcttttagcaatgacagatgttttttatgcattgtccagtatggtggccactagctctgaatggctattgtgcaattaaaacatagcttatcttaccaagggattgaattttaaatattcaattctaaataattaaaggttaaatttaaatagctctgtgtacccagtgattactatatcggatggtgcaggtctcagttctttccaccattttttccccaccatatttta

SEQ ID NO: 28683 - DNA, 1029 bp, Homo sapiens
caaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaacagctagattgtttttaggatttttcttttcttttgtggaaacttcttgacttgacttttcatctgaacagtttttccccccaagattttaatcttatatgtcatacttaagtttaggaacagcttgaataattagcattctagataacacaagggccatgattcactaaaattccaagctactgtaattttatggcatttatttgcaaatgttctttgtatctcattttatctgtagcagtccccactagtctaccttaaccatcttatagctctggtaaattaaaacttacgtagactttatacaagatccattggccgtattaaacctcccccactcttagggcttagggcggaagggacgaaggcagggctgataggacttttaaaaggataaaaggagtgggggcaagggaggcggaaaatacaggctcttgcagataccctccgcgctgccctccacacccagcccactgctctacaaaggtatgaatggaatggcttttctagaaaagggcttccaagaacataaaggaattcctttccctgggaggccccgtggagggctgagccagccttgaattgggcttatttctcaaatccatttgatctggcatttttgtcaacatggtacatgttagggcctacgatgatttttttttcttttttgtaaaagagaggcatatgtattaaaatgcttcctcttcccctgccggagcctcacagaagtcaagaaacgctatccccagcttaaatgtgcagactcttcaagatggaggtcacaatattaggttgccacagtaacagctctgctgacttc

SEQ ID NO: 28684 - DNA, 2141 bp, Homo sapiens
tcttcttggacccagtggcatacagcacactcgatctcaatgagttattcatggcgtccaagagaaatacttctgagctgtatttcatgtgagatggagtgggcctggcacatgggcggcgaggccagcctgctcgccgaaagcgtcctgtgcctgttccagcagccgtgtgggaagacagctatctcagcagctgagcccctgccctgtgtgtcctgaggtctttttaacacgtgaagggtcttctgggctccttctgtcccaactgaggcctgcatgcgccgtcagacggagctctgtgagccatgggtgcacagtggacacagtgttgtttctctctgcttttaagtatttttcttctcttaccgagttccagccatttgtaaagttccacccagtttctgtagctgggaggggaggatgataagcttctcagcgtggtctttctctagcgctcctttgtcctcagcaggaccactgtggaagcctggagacttattattagaaactttatgttattacaaaatgccatcccttccgcatccctgtcctggctgctcccctccttccaagaaagaaaagaaaagaaaaaaatcaaagaggccccctcatctgcactgacaaagtggccaaacctgatctttgctctgttgatgaatcctacctcgaaccgcgcctgcgcagcacctgatcggcaattcctgggcacgtagagaggaactgtcctaccacggggttaaaatagggagagcgcagcttgcaggaaattctcagagtgggagtttttgtgtgatttttttttctttcctttttttgaaaaaaagttaatatcgactcatttggtggggatgtaatgcccttttctacctatcccccaaaggaaagtttgtattcttttcaatgaaaccattttaaaagcaggactgaagccgaaaacgatgcagagttctcctgcgtcctcagaaggtgtggatttatttaccatagttaaatcataattagttctcaggggatagtgtgtcttttaaacggctttattgccaccatattggttttctgaataatcagaaacttctgttatgattgtgttctagtgttcaaacagaagtgcaccctaagtaggaacaaatgtcaggaattgctagttgtcacttgaagaaggtacatacattgggggtggggggagaaagaacttggcaggatattctgatgaaatagaatctaaccaagtctttaataaatggagtaacggctcaggcaggtacacacgccccctcgcatgctctttttttgatgttaaaaggtgctttcttcatctctttcattctcacgacccaggttagaaaggagggtgatatccctcatggctccacattcctgaaggccagtggaaccaaagttggcccttccatggccacacacccccagatgcatgcaaaccctgtccctcctgtgtgagccattggtgccgcgggcgtgtccatgtctggcctaaccggtctttccccctcttcggcaggctgatgtttcagacaccgcaggaaatgggcttaatagtgatcgcggcccggcagaccgagggcaaaggtcagtcatcttttgtgatcattgctgttacttctgttttctaaactctgcaactcttgtggcccaggagcccattgaatgtgtgtgctgatcatctgggggactcaagttagtagattctgttttcataaccgcctggaatggaggaagaggaagagggaagcagtgatcagaaggttcacccttagtagaactaaagcattctgtcaaatcataatgcttatgaatcactggacatttgcctgtgatggcaaatgtgacctacatgaattccgggctttccaatttggggatcgtcactgtgctctagagacgtttattttcctgaaggttctccataaggagccttctgtgtctgtactgagcgtcatgtgggaggccttttgcatgccagttctcaccccagctggccctgggctgggcttgcatgtacatggtgggctctgcatcagtgcccattcacacagtgaccacagagaagcagagcgctgcccagggctccaccacctgcagatcccggagacgagagcccacatcctcccagacccatctgg

SEQ ID NO: 28685 - DNA, 1016 bp, Homo sapiens
gccagattggaaggttttcagacatagcacaaaatactgtctttggatggtacagccatgagttatgtcagggcagtgttaagagagatcgtgataggctgggagctgtggctcacccctgtaatcccagcactttgagaggccgaggcgggtggatcacttgaggtcaggagtttgagatacgcctggccaacatggtaaaaccccgtctctactaaaaatacaaaaattagccgggtgtggttgtgtgcacctatagtcccagctacttgggaggctgaggctggagaattgcttgaacctgggaggtggaggttgcagtgagccgagatcactccactgtactctagcctgggcaatagagtgagactccattgcaggaaaaaaaaaaaaagatcatgataaaaagtcactttaataaacttgtggatttaggtctgattatttttgtttctgtaggtgctgcattgcttgtctctcctgaatttttatttctggaagttattattcataaacatgggtcccccacatatccctcagtagaagagtcaaagggagagctaacattgaaagtagtttttcttccttctttgttagtggccccgataatgtttggtagagtctgtgggaagactggaaggctcagatggtgcatgggatcatttcctggtttggggaagtctcccaacgccctggattatccgagtcctggttcctcacagctctcgtgggccctgcttatacatctaaaacagattgctgtaaaatgcttaaatagtaaaaagaaatatgcttttgggaattagagaatctaataaaatcattaaattgatcagactaatagatcatttggactgacctagggctactgaaattaccaaatgtctgttctgcatctattcagaaaatcatgtgattttcctcattttgcccacccatatgttatgtattatgttgatacatttttctgatgttaaaccatccttgcatttctaggataaacaatatctgattat

SEQ ID NO: 28686 - DNA, 1055 bp, Homo sapiens
cttggaggagagctgcctgactagccctggacttgggccactgcagttggacttgtttcagctaatgttagcctgcctcgatgaatcacaattttgaaagagaatattatttgctactgttagtgtataaaatagttgtattcttgtataccttatgtcatatacattatgaatattgttattaaagaatattatatatatcatattgctgctaaaattgcaaatgaaaataagatcaatgctgaatgcagtggctcacacctgtagtcccaatactttgggaggccaaggcatgaggattgcttgagaccaggagtttgagaccagcttgggcaacatagttagataactgtctctataaaagaaattaaaaaatttaaaaaaaaaaaagaaaggaaatcaatctgtttgcaatttttataaatagaacataactactcacagtgaagcaaattaatatctgaagttttgctaaatttttgtgcatcccttgactaggaaggaaagttaatagactctctgagatccattcatgctagaaacattaataataataaaaagatgaactgccactgattaagtacttactgtgcaccagacatgctatgccaaaagctttgtagacaggatgggcatgtgccttgcaatgagatggcagatgtggccttgatctatgtatttgttctttctttcaaattatttttattcctgttaaaattgaactatgagacagatgcctgtgtttttttccttttcttgattgtcataacctctccgattgttataatagaatgtggcacagatgatttgggctggagagctaattatgcatgataacctgatttctaaaatatcacaggatagaggcaactactaaaatcaatttctagcggtcagttgcaggttgaaaagttacttgcgtctctattgtgaactgggtgtgttttggctggcacgaatgacaagggtaatcattgagggggcattgacggcttaccagtgattgaccagtctggtctttaattttcctacataaatatgttcagctgcatatt

SEQ ID NO: 28687 - DNA, 1038 bp, Homo sapiens
cgtctagtgatggacgcctctatgctgtccctgtggctagtggtctgttcacaccattcctggctacgttaggtgtccccagtgcagagaattaagtcatagtaaaagtatactctggattttaccaagaggtcacggagagcccctcttcccttggcagtcagcggcattcttattacacttcatttatctacttgggaggactcgggaggaccagctgggcccctgtctgcactcatcaagagttaatttctgagcgaggtgcagtggtcatgaacaagtgcagaaggtaccctggtggccctgccagacaagaggggcccttaattagcagccacgttcaatcaggctgcttaacctgccgcagagctggggaggtcatgtccttcctgccgccctgcctgtaaacacagcgcccggagccgggcccgggactccgtgcggcctgggaggaggaaggtacctggaagcaaggaagacagtgcagacccgaacctgacccacttccaggggatacctggactctgctgttactcttgatggagtagtgagggttaaccgagagagaaatttttttttctttaaaatttggaggcatcttttgtccttgccaacttcatatttcccaagctggacatcttactggcttgctttctttgctattaaaaaaagtattacttatgtcgtcatgtttctggcatcgcctagggctagccatgcactgagacctcttgctgtagtggaaagtcggaatccttcaccgattttgtagccttgcttaatctctccacaatgtcctttgctcagatacaaaacaaggatgattgtactggccctgccacctcatggagctgttaagagggaaccatggagagacagtttgtcaactgtcaaaccctgtgtcaaatatcagctgatagaattggacgccaggattggagtgcttttacttggctcattcattataggtagccaaggtccatttttattttaacagtcacatatagaataccaaaaacctgatgttgttggtagatg

SEQ ID NO: 28688 - DNA, 1443 bp, Homo sapiens
tttttaaaatacaatgatatagtcacccatgtaacatagaaaaatgcatcaaagaaaatataccaaaatgtcttttggtaaagtcatgagtgacttaatgccttagtcttacttttttttttttttattttctagattttctacaatgaacatgagttatcacaaaacttactttttagctattgccagagtcctaaagtggcacggtagtgtttcattttatacacttcactaagtttttctaatagtttttagctgattcttttagattttctaagtgaacagttgtgcaatgtgcccataatataacaattcagttatatattgagtcatgagacctgttaatgtctaactgtctgctttaatgaaggggagtgtccctgagaacattcaggcactgatcagtgcccagaccacagggactcccacctctggatgcgtccagccggatccacagaacagggtcgtggtgaggatgaaacgcggtgatgaacataaagtgccagactctgtacttgaccatcacatgctgtcactcagtgttagcggttattattgtgaggacgaacctctggcagcacatgtttctcagggcaggggacagagctgaacagtggcagcagccacaccaggcagtgggcggatcatcagaaaggatgagttattaacagtgggccccttagggtggtcagttctgagcagctgtgcctaagcatgaattctatctggcctgctttcctgattttaaaatccacacccgtatggagatgctctcgcttttgtgggccctgaatgaatgatgaacagtaataatgctgacatgtggcctagcatgtggcctccctccgtagcttctatcatttcaggaggctcgccttgggagaatcgggctccaggtttattccatgaataaagagtgtctctgtggtccacagcctttgttggtcctggtggtctctgtcctcaggttttcatgctcttgcgtaagcctctccccttgcaggtgggtcggacctactggatcacttctaacaaatcaaatatggcaaaagtaatgggatggcaactccttttttgcacttctgggtgacttctgtcttgcttgcttttcctcttctccctacccccagctctgagggaagcaagctgacgtgctatgagtagccccatggcaaaagattagcagctactggggcaccgaggcctgtggcagactacagatgaggttgggaagggacaaagtggaggcggagccacccccccaggcaagccttgagatgaccacagtgcccgctgacaccttgagtgcagccttgtgagagaccctgagctaaaggcatcctgctgagccaacccagactccaggcacacggaaatcgtgggtttcttaagttgtctcgggctgcttagttttgcgttcatttgttacacagcaatagataa

SEQ ID NO: 28689 - DNA, 1050 bp, Homo sapiens
gcctggtccatgtagctctaatgcagagaaatacttatctaggtaatgcaaaatacaaaacccagttgtgtctaatttacacaggtgatactgacactgtacatctggtggtagtaaacttataaaataaattatatagcacatgccttgccctgaagcacatgtgtacacacacacacacacacacacacacacacacacacaccctgcacgtttgaagctggtaaatgggctgttgttagtctcctcgtagactaagttcacacatacacgtatttgtgaatgcagagtacatggaaggattcctgagtcgtcttgcatccttgaaggaggttaacaagttcgtgtttctagtttgcaaggaatgatcacttcatgcatagtgaagagagattcgtattatttgtattattgaactgactgttccttataatgaaaggctaagagaggggtgtcccaggcaagtgtagagaggaaagaagatggtgtgtcggcaaactgcgagtaattccatatttcacagatgactgtcacctcttagactatccattgattcagtaaatatttgcctggttctcattctcttccaggcattgtgcatcattatccaaataagcaggaaatgtacttttgattgggttcagcttaatgtattactgtttgatcagttctaaaatacacattttaacacttctgaaattgggatgtatactaccatcagcggggtcttagattcatttaaaaaggctattagtcattgttgtatttggcggtgctttaacacacacgagaagtccaggctcacaggtcaagaaaacccgagtggttatgccctaatcaatataacaggtaattttagtgagtgatacatttaagttttactttgttgtttttatttcttttaaccctactctgaattaaatgctgtatttattggtaggttttaaaaattagttatcttgctttaaaaatcactgtcctgctctagctagatcttgtcttgttcttgttcttcccttttctgggaatttttccatgcatggataattg

SEQ ID NO: 28690 - DNA, 2726 bp, Homo sapiens
tcccgttaccacaggactggatgggaaaaggctgatgttactctgtgtgttatcttgcgagggctgctgggacaaagtaccacagcctggggtagcttcaacaacagacattcatttctcccagctctgaaggccagaagtccaggataaggtgtcagcagggctggctccttctgaggccgtgagagaggctctgttccgggcccctctctctggcttgtagaggctgtcgtctccctgtgtgttcctgtcacctctcctgtgtgtgtgtctgtgttcaaatgtcctcttcttacaaggacacgagtcatactggattaggacccacctgaattacctcatgttaacttaatcgcctctggaaagaccctgtctctaaatacagttccattttgaggtgctgaggttgaggacttcaatatctgaatttttagggggacacagttcagcctctaaccctgtgcatgtgcagccgggttgtactacaggagagggtccctaaaccatcagacgtgagctcatatagtgtagctgcgtgcctgcccctccttccctctgcgggagagggccggggagaggggctggcttcactctggaacttaagtaagtcctctctgggaagggaatagagtggggagatctctcaggttttttagtatcttgaaataaaagcaaattacatgagggaggagacagggtcttttttattttgatactagaaacatcttccattggatggcaccgtgaacccattgagaaggaaatgtaatcctaacaaactaggattataaatgtctgcatagttacaaatatctgtatagtatattaatattcagtaatatctagtaatatgacaatatttatagtaatacctgtatattatgcattctcttgtaataagtatcatctgtatagttaatactgtaaattatgtttatatgtcatgacacacaaaattggaatgtgtcaacttaatgaatctggagacaaatcatgaaagataacagttgctactgaacagagtgtgaatgttactacatttgacaaggtaaagggtgacagaggtgggcggggaagcagaggaggggaaagggactgaaaagctgagtgtggttgtgcttctcatacaaactgagcagcaagacatacatctcataggtaaaacagtgaagtacgctatttggagtttcacaggaatccagtagaactgacaacagatgcgtaagtgagcaggaggagagatggatgatgtgtgagctagatcctaacagcaagaatccaaagacaatgtgtaaagttgccaaaccatgaaaaccagtaaggggccgttggaaccagttaaataaaacaagctgcatttcagaaagcatttctcctgttagtttaggaacttggctagatcccaagggactttttaatcctgcattttccttgattagtagtagcatagtctaatcattgtgcatttgtctcccatgggtggttcaaaaattttaaaatggatgttttatttattattttctagaaactaggttttgcagcaatatttttattgcattttattttccagtaagtgagatcaaagtagtgatcctgaaaattatgcttatggtggacttaagtaaaaaggatttatgcaatcaaatttacagattgtttttttattgatcacaacttttatgctagggatcaattttaatctacttggcatctttaattgcttatccacttaaaaaattaactctggtgaatggaagaaccccttctaatgtgaattgtttttgctgttagtgaaaatatggtattatgtatctattgcagttagagggaaaagaagaattacttcataggctattcttcttttggaaaaaaggaagaataaaggaaaaaaagagttttgttcagcaccttattaacgtttccagggtgttgatcctgccgactccagtgaagtataaccatttattcactcattcattcattcattcattcattcattcattcattccacacacttctgaatgccatcagtgaaccaagtactgaactctagagttatgagactaaatttttttaaataaattatggcctattagcaaagctcagctcccttgttgatattccctatactggttccctgctgttattcagttacttctgaacccgctgaatcagacctgaacttgcacacccaacaacattaaatatccttctcctggttctcagaacatgaaacaactgtagaaaaatactcgccactgaggccaggtatggtggctcacacctgtaatcccagcactttggggggccaaggcaggcagatcacgaggtcaggagatcaagaccatcctggctaacacggtgaaaccccatctctactaaagatacaaaaaattagctgggtgtggtggcgggagcctgtagtcccagctacttgggaggctgaggcaggagaatggtgtgaacccgggaggtggagcttgcagtgagccaagatcacgccactgcactccagcctggatgacccagtgagactctgtctcaaaaaaaaaaaaaagaaagaaagaaaaagaaaaatacttaccactgagtttgggggtacgaaaaggatagggggtataatttaaagaaaatccctaaaggtcaccaaggtttcttcaatgagcacactcaagttgtaagtgagaagtattgcccccggagaactgagtttccttctgctgtag

SEQ ID NO: 28691 - DNA, 1042 bp, Homo sapiens
gttcatgtcctttgcccactttttgatggggttgtttgtttttttcttgtaaatttgtttgagttcattgtagattctggatattagccctttgtcagatgagtaggttgcgaaaattttctcccattttgtgggttgcctgttcactctgatggtagtttcttttgctgtgcagggaattgaacaatgagaacacatggacacaggaagggaaacatcatactctggggactgttgtggggtggggggaggggggagggatagcattgggagatatacctaatgctagatgacgagttagtgggtgcagcgcaccagcatgtcacatgtatacatatgtaactaacctgcacattgtgcacatgtaccctaaaacttaaagtataataaaaaaaaattccctcaggattttcactgtcctggtaagcaaataatcatcctgttgcagccccagggtaagtgtagctcttgctcctgtcttgcagtgggagaggtgactgtggaaggacatcggcccttaccagtatggagctgtgtaagtggggccgtgttccagaatagttttgtcacagtgactaggagattttctcgggggacttttgtgggactctgctacgaatacaagcaaaccgtaataagaatgaaggttcggacgtggcactggggataggagtggggagagaccatgagcagatttgcatgacattcttgggtaaggtgatgtgttagttgtgggcagggtggtggtggggtgtagaaggccactctaagccaggggactcctggtttgattttaaaaatgggaatcaggtctttgtgggtattaagaacacacaaaagggcccatggaaagagcatcacctctgacatgcccgaaggaatgttctcatgtctaaaattgtctaggtcctcctcattgctcacaaaacatgacatcttcacagaggctaattagactactccatggcatgcctactggggacagctgatccagggtgtgtggcagcatcttactcctgtgacagctgattctgccctggat

SEQ ID NO: 28692 - DNA, 1045 bp, Homo sapiens
caggtcgtcttgcccatctctcaggtttctgtctgaagctttataataaatgatggtaatttgattacaaaagagaaagataccatcattttatattgtggctgtggtggcgtttctaacatctctatttacaaaaggagagattttaaaattagtttaagctggatggctgaagcagtgcagcaaatgaattagattttttgtgtttttgaaaaggctacaaaaattgtgagagctgttcctggaatggccttttgaaaatccccttgcatcctggaagaaggatgagcggatggctctaaatctggtattgttggaccaatcgagccaagacggggtttgttgacaggaatgttgctgaagaaccacatggagttgagctgtttgccttcagatttagcagttgtttagacaagcaggactctttattcttgctcagacctgagtgagctgagcctcaaggttgaaaagtaaaaaggagatgtaagggaaaaacagttctttctcaacctagatttctgtgcggtatattgactttccttcagaattttctttgttctgaaaactatttcttcccattctgctgcctcaaggattcttcttttagaatttttttgtagtttcattatccactctttgtttcgccaaaaacaaagcaaataataacaacaacaatatcaacaacagcacaaaaactggatatacctccccccgaaaataaacaaatagaaacattcaggggaactgccctgcctggttggaaacaccagtctaggccccttggaaatgtcttggtggaggtcccaaaggtctcaggaggacagaggacctcgacatttattgagtgcctaatgtataggaactttaggaaaccaacatttattgagtgcctactgtgtattttctttaggaaaccaacatttattgactgccgctaggtatcaactttaggaagcaacatttattatgtgcctactatgtaccaactttacaaagccaacatttactgagtgcccaccacacatcaactttaggaaactaaatt

SEQ ID NO: 28693 - DNA, 1033 bp, Homo sapiens
tcctcagagcatctctgcagcaggaacagtcatgggtgccacagggtggcactttgacttataatctgtcgtcttaaaaaaatctctttaaattacttagacttacttaaatttaagcctagagcacccggcattcctacatggtctcccatgcaagtactagccaggcccaaccccgcttagcgtccgtgatcggacaagcagggtgcctgcgggctcttacggccatagactactgtttttctacctttttcctaatgtttaaaaatatatgtttctgaaatgtggaggactcttaagctttttaaaatttttattttttatttttgtgggtacacagtatgtgtatattttatggggtatatgggatattttgatacagacatgcaatgtgtaataatcacctcagggtaaatggggtgtccatcacctcaagcatttatcctttgtgttacaaacaatccaattatattcttttagttatttaaaaatgtacaattaaaatattttttactgtagtcaccctgttgtgctagcaaatattaggttttttccattctttctaactactattttgtccccattaaccatccccacctacctccctgccccccactacccttcccagcctctgatgaccatccatcaacatgagttcagtgttttaatttttagctcccacacataaataaggacatacaatgtttgtctttcgatgtctggcttatttcactgagcataatgacctccagttccgtccatgttgttgcaaatgacaatatcgcattcttttttgtggctggatagtgctccattgtgtatctgcagcacgttttctttgtccagtcatctgttgatggacgcttaggttgctcccaggtcttggctactgtgaataggctgcaataaacatgggagtgcagatagctcttcagtatcctggtttccattcttttgggtatatgcctaggattgggattgctggattgtatggtagctctattgaaatgtagaaggctcttaacctaatatc

SEQ ID NO: 28694 - DNA, 1035 bp, Homo sapiens
aagcaatcctgatacgggttttcaaacagacctccatattagagaagacttttaaacatgttgtttgacctattttggtagaggcatttattgctttgcatggcgccatgtaaactgaaatttgtgcatatcagaacagtgtcctcactttacactgtttgcaatggacatgcgtgactttcagttaatgtgggaccatgcaaagtgagaactgcctgcattagcaaattactaatttaaggtaatcaaagtaagatgctgcctggagaaattaccttgtatgtatgtctgtgtgtgtgtgtggttttacgtgctagtaaatcttagttcctttgctctggttttctgatttcagaatacattagctgtttcatgcactggctcatacccgcctcataacttgaggtgagggaacttgatccctagatgtggttttctcttaactaggtgattattggtggtgggtgctatttggacattcatttttttttccttccttctatttttctttttgttgctggggggactgtgttaccttacctgatgatatacttcctagaacagtttatgtttttatgctttcttagtgtgttaattgggtctggagggtttcaaaggactactattggcggtggtgtgtgttatttatgtcttttcgacccatagaagccgtggtatttatttgcaatctgagatagattctattttggaaagtctcacctatgttcattgccatttgtatgtcctttaaaatgaaagccttccgcagtctaaatagcagaagtgttctgatacttcatagctgttttaaccctgtaggggtcccacctagatgttctggcctacctttttcccctccagttctcttccatgtgagcaagtctggagtagcgcttttcaaccaaatttgaccaatactttaaaaaagctttttgaaatataaaccacatcccatacaattcaaccacttaaagcatacaattaattcggtggtttttaaaattatattctcacttgtatggtcatcaccacact

SEQ ID NO: 28695 - DNA, 1060 bp, Homo sapiens
gctgtgggtttgagacagacttttgaaactaaaagatgaaaatcttccatcttcctacctctgcaaaactcagtccacttacgcaaaagaacaagactacagttgtcctgctcccctctcctcttgtggaccctgtgggggtcccagtggagtttgcagagtggggagagctgagggtgcaaggtcagactcagaacaatggattcttcagcttagaaaccatttgtgagaagccagggaggttctaggagaaccaagtcaggaaaggaagaatgccaggacaaaagacaaaaaactccaagctggccaggcatggtggctcacgcctgtaatcccagcactttgggaggccaagcggggcagatcacgaggtcaggagtttgagaccagcctgaccaacatggtgaaaccccgtctctactaaaaatacaacaattagctgggcttggtggcacacgcctgtaatcccagctactcaggaggctgaggcaggagaatcgcttgaactcgggaggtggaggttacagtgagccaggatctcaccactgcaatccagcctgggcgacagagtgagactccatctcaaaacaaaacaaaaaacaaaaaactccaagccaaacattgggtgacttaggggcctcagaagaggtgtagcctgtagatgacaaacctggtaggaagtcctgccccagtggttcccagcctgttgtagatgtcccaagcctggggaggggatgatgcacgaggagcatttgggaactggctcactctgcaaatttgggtcatttagcctctggtgcgttgtgcatgggcttcctcttcacctggaaggcacttgccccgcacagctgcatggcctgctccctgtctcctgcagatgcccagaggtcctcatggcagggcgggctccctcccagcctgacaacagcagccaccacctcactgcaggcaccctccatccactattcttcaaggcctcctcagcccttgatgtactgcgttatttaacatctgtctctgtctctatcacttaaaccttacaaagtcaggaactttgctc

SEQ ID NO: 28696 - DNA, 1052 bp, Homo sapiens
aactcacaggctttgcatttcagaacctacaaaatcccaaccctgagcatggcagggaagactgacaagcactggccccagcctctctttccagccttgaccctttctgtgaccccgcctgtgaccctcatgctttctgttttagtttcactaaacacctgctatttcctgaaactggatctttgaatgtgctgttcccatccctgattattccccacccccacattttccatctgattccttctcagtggatcggcgatggtcagttctctctcctctgcaagccttgctgatgtctccaggtggaatctccctgtttagagcttttatggtgctatttctaaatctctgtgcatcattctatgcgactgtttttatgtttcttcactgactctgcacccagaaagcaggattactgttttacttgttccatgtcatgcctgggagaataatgtgcactcatatttatgactgaacatacatttctgtctcatgggatttggggaatttgtagcaattaagaaatggtgaagccaggctcagtggcgcgatgtagtcccagctattcgggaagctgaagtgggaggatcgcttgaggcctgagcaacataatgagaccccgtcgctttaaaaaaaaaaaaaaaaagagagaaagagaaatgacaagtgttgaattaggggcgtaacatggcttggtggaaagaataatccagagactttgggacttcggggctcacttctgccattgctgaattccttccttttggtgagtctccaggcctttcctcttccttccccttccaggtccaagagatgtgatgtaggctctataaggctcatcagccatgcgagagcagcgatggtggcccaggccccgactgtaggagctgaaagacaggcgaccacaccacattacaggagggtgagaggaacggatgcggagaggttctgaacttgtaggtcaaaatgtgaaattcgaaagaatacccaaaaaacctaagaaaattttgtaaaggaaaatagatttattattaagcacatgaaaagatgcc

SEQ ID NO: 28697 - DNA, 1069 bp, Homo sapiens
agaaaatgttaatggtaggtggtcctctacatcttcaccaatatttggtgtggtcagtcttttactttcaactggtctggtgggtgtgcagttgtatctcactgtgctttcaatctgcattttcctgaaaacagatattgttgaggatgattatacttattgtacctattacactgctggcattcttaatttgtgaaatgttgttcaaatcttttgcccattttgaagttggggtacttgtcattttattattgagttgtagaagttctttgtatatctcagataccagtcctttttcagatatatgttttgcgaatattaactcccagtatgtgacttgtctaggtggtgggtatgtggatgttcatgctaaattccaaccttgtggtaaagtgtcaatatttttataatgggggcaaataactgtggacagttttttcaagtgctatggtataataaaaatcagtgtaaattgatggaaattgtattttcgtagcgtttttggtagcccttgttgcatggatgtgtcatggtagcctgataaagggccgtctgtggtggtgcctgtgtccctttgttttccttccttgtctcctttcttttatttaaatgtgtgcaattttctctccttccttgaacaaaatagctcaaattatataaaaagtataaagttaaaagtgaagtgttacttttggtaacttgctgaattatttacttctttaggtattggggtactctaagtaccaaaatttaaaacaaaaatcacagtctgtattctcgttttctgaaatcccagtggtctaatttctctttatttatgcccctagtgaaaatattttaaaaatctaaatttgtatgcacataaagttttcatttctcacacctcatatcatgcagcctgctgtcatggcctttccaagtgtgtgcggaatacgaggctccctgctgggcacacggccggtctcagggttgctgtaaaatgttctacctcgtgttaaaaagaaaagatataattagcagcgtttgcattattgaaaatactctcattaatgtatattctgatgtaatt

SEQ ID NO: 28698 - DNA, 1086 bp, Homo sapiens
ttgcgactaagaagaaatttcttaaactgatgacagaaagcaataactataaaagaaaaatgatgttagacttcatttaaaaattctagccaggtgcagtggttcattcctgtaatctcagcattttgagaggtcaaggcaggaggatagcttgatcctaggagtttgagaccagcctgggcaacatagtgaaactccatctctacaaaatatttttaaaattagctggatgtggtggcacatgcctgtggtcccagttgcccaggaggcctgaacctaaaaggtcagggctgcagtgagatatgattgcaccactgcacttcaggctggatgacagagtgacaccctgtctctaaaaagaaaaattctgctcatcaagaggtactgatgaggaaatgaatagataagtcacacactgggagttaatatttgcaaaacatatgtctgacaaaggactcgtatctgacatatacaaagaacttctacaactcagtaataaaatgacaaatactccaatttaaaaatgggcaaaagatttgaacaacacttcacaaattaagaatgccagcaatggctgggtgtggtggctcacgcttgtgatcccagcactttgggaggctgaggcaggcggatcacaaggtcaagagatcgagaccatcctggccaacatggtgaaaccctgtctctactaaaaatacaaaaattagcttggtgtggtggtacacgcctgtagtcccagctactggggaggctgaggcaggagaatcgcttcaacccgggaggtggaggttgcagtgagtcgagattgtgccactgtactccagcctggcgacagagcgagactctgtctcaaacaaacaaaaaaaaagaagaatgccagcagtataataagtgtaataatccttaacaatatctgttttcaggaaaatgcagattaaaagcacagtgagataccactgcatatcccccagatcagctgaaaatgaaaagactgacacaccaaatattggtgaagttgtagaggaactgcaatttctgaacatcgttggtgggaatataaaatgatacgaccattttgaaaaaaaa

SEQ ID NO: 28699 - DNA, 1032 bp, Homo sapiens
ctcaggttctatgaacttgaaaataagacagtaataattatctaatctgaagaagagagaaaaagatttaaaaaataaacagagcctcagggacctatggataatatcagaatgtttaatatatgtgtaggagagatggaaaaaaaatttgaaaaaatgatggccagatgttccctcagtttggcagaagacataaatttccaggctcaagaagttcagcaaactccaagccagatgaatatgatgaaaatacatctaggcatattatagtccaactgctgcagaccaaagattaaaaaaaaaaacaagtactgaaagtaatctgaggaaaacagcatttcatgcagtgaggaacaatgatttgaatgtctgtggactttttctcagaaattattaaagccagaagagagtggaacaatatttttagagggctcaaggaagataaacttgtcaacccagaattccatatccaacaaaatgtttcaataatgatggcaaaatacatgtccaggtaaaagaacactaagataatgtgtcatagtgcaggtctgctggaaggaaatgccaaaggaagtttcaaaaggtgaaaggaaaaacactagagggaaacttgagtctttaggaaggaatgctctctggacaaatatctgggtaaatttaaaatactcccccaacacacatatatctacctaaagcaaaattgtagcatcatcttacatagtcttacattcattggtagaatacatatgacaactctagcaaaaaggaacaacaaaggggtggtaaatggacctataagattgtaacatttctgcatttgatctgacatggtacaatattaatgctaagttgatataaaaggtaaggatgtacattgtaatccctaggataaccactaaacacataaggcaaaagatacagttcaaaagccaatagataaaatgccattctaaaaaaaaaatctaaaagaagtcaggaaaagaggactagaaacacacacaaaaaaaagagagaaaaaaataaaaattaacc

SEQ ID NO: 28700 - DNA, 1048 bp, Homo sapiens
aaacaaaaactctctgctggcatcgcttccaacccaaacacccagaacgcaggaggggatgatacagtggcgtgaagaactcagctgtggtggaaaatgcccctcggctcccacgccctaaggagtgctctgggaggggtaaggggagtttgggcagatgtggagtggtcttggatgaggtcgtggctgacattttggatttcgatgttttgttaaagcttatttgacttactaacatagtatagaacctgccgtggaatcggagtgtggggtctgatatgcttggaatcctggtggagtgttcgaggtggattctgcaagtcgtggcaatctccctgctttcctggtttttattttcatcctttctactcattttcaataccctttccacttccggaaacaacctatggcatcttctcttttataaatggaaacaagatgaaatgtaatatgatttttttttttgcattctgtgatgcccattgaggtaatacaagaaacttagatgttgcaaacctgggctgtgaatctctgatgtggagctacttttagaatttgtttttgttttgttttgttttgttttttagctcaattaaaatgccttctctagcttcgtttcagatcttgttctcttttcttccttctcctgcctcctcttcccttctttctgttgcaaaatatgagcatgtttcctaactgctaagaggccttcttggaacctttgttccaggcagtggagatagagcaccgttgtaagattacaggcagtttctgtttttactgttgatacctggaaaattgtcatgaagtgcaccaaatgtttccagcaccatgttgtcatcattggaaacgaatgagggatttgacttctactgaaccttaaatcagacaaacaaatgtctgtccaaactctggcaggcacctcaggggccagagggcttgaatgccctctgcagtgttgtggatgtgtctgagcaccagatactgggcaatttcctaccatttgttcagtcaaatatttactgagctcttttttttttttttttct

SEQ ID NO: 28701 - DNA, 1026 bp, Homo sapiens
tggaagggcaaggagatgagaaggaggaatgatggggaagtctgtacctgcctctttctttgccctttggttccagaggtcaccttgatgctaatagagttttcagtttaaaattgggtaatatgtgcatacagaatttacctaaaaatgaaatacaaaaacctcagactgggccgggcacggtggctcacacctgtaatcccaacactttgggaggccgaggtgggtggatcacgaggtcaggagatcgaggccatcctggttaacatggagaaaccccatctctactaaaaaaaaaaaaaaaaaaaaaagaaagaaagaaaattagccaggcgtggtgacacgcacctatagtcccagctactcaggaggctaaggcaggagaattgcttgaacccaggaggtggaggttgcagtgagctgagattgcggcactgcactccagcctgggcgacagagtgagactctatttcaaaaacaaaacaaaacaaaacaaaaaaaccccaaaatctcagactgtaactttcttgcctgccattttgacacagcagcttgtgcgatgttggtgaatcactcagcctctccgggtctgtttctcatctgtgagattagagggttatactagatctgtggcttaattttttttttccaagacgaagtctcgctctgtcacccaggctggagtgcagtggcacaatcctggctcactgcaagctccgccttccgggttcatgccattctcctgcctcagcctcccgagtagctaggactacaggcacctgccaccacgcccggctaattttttgtatttttagtagagacggggtttcaccgtgttagccaggatgatctcgatgatctgaccttgggatccgcccgcttcggcctcccaaaatgctgggattacaggcgtgagccaccatgcccggccgacgtggagtctcactcttgctcaagctggagtgcagtggcacaatcttggttcactgcaacctctgcttcccagattcaagtgatcctcctgcc

SEQ ID NO: 28702 - DNA, 1051 bp, Homo sapiens
ataatttttaaattttttgtagagacaggggtcccactatgttacccaggttggccttgaactgttgaatttaagcgatcctcccaccttggcctcccaaagtgctgggattataggcatgagccaccgtgcctggtgtggtaggtgttttcttggaatggagtttttgtttgaagatttcgacagtttttttctcatactagaaccaattgtttgttgctggttactgttgtgccaaaaatattttagtccaactttttttgaaagatgagaaaacatagtcagttgtccatgtttgtgtttctcttatatgtgaagcaagtctctttttcattgaaccttctctttttttgaaatcttaaccctttagttatcattttcacaggtaattcacagtcatttcaaaagagccaaatctgcagtggtttgaacattttcgcagtcccttggatatgccttgtgcatcacccacaccttcctgagacccctgaaccttccatgacagtcagaaacacgtgcacctgacattactacattctctttaagctctaaaaaaaaccccagatgtttattactctgcagaattgcttgattgtaactacatttaatattcattttgtcaaatgcctctgttttatttaaacaagcaataaaagaccacaaaaggtaataaggcaaggtttagggttagaaaagataatcaataaagagggtgacagggacttctctatgctcttttccccccagttcaggtttaccttagagaaaaatccaaatgtgttgattttagtttagtagtgagctgaatctgctgagggttggaactgcttccactctagtctttagattgtaaaggagttattctttagcagaagggccaaagacatgaccttggaataaccagcctgagtttattagaagtctggtttcccactgggcaaggctgcatgggatgctgaaagcagggcaggctctggagcttcattggctactggcctggggcaaattccatgacatctcatcttaaaatggacaagctgcaataatgccc

SEQ ID NO: 28703 - DNA, 1030 bp, Homo sapiens
gttgctcggccaccttcagcacatgtccaggatggtgatcccagtgtttatgttcttacttgagccagtaagtgggaggaaggggtaaagaagctacatccccattcttcaagggacagaagttgcacatggcctttttgtttatgtattatgaacaggacctagtcacgtgacctacaaacaaggctgggaaataaatgtggtctttatagtaggcaaccatggatctaactggaaaccaggcttctatcactaaggaggaaaggagggtagacattggtagacattggaagacaattagaattctgcctcaggcatgtactttcagtttttcagactaccaagaaaaatacttggaggccctgaaagtagtataccttctgatagtgccagggtctaccagatttaggatcacaggtgaagataattatttgacttataacactgcttttgtttcagtgcttactcaaggtaattagaggaattttttttaggtgtttacacatctaggaggatttggagatttctgacagatttttgagggtgtggtattttttgagggctggtatttcagtaccagctgagctaccatggtactggtgtagagagctttcttttgatctctctgggcatgtgagtggcttgtcttagagcatgaaccccccaccgccttcaccttgtgtctccaccccacaaatttggaagtgtgtttgtgattgaatagaggggagagcactctggggagaggaagtagcacagggcaatgtgggtgccgcttgctgatgactgagtcccctccacccccagagtaaaaactcaaaaccccgttagtgatgcgctttccccaggaatctgacttggctgtgccacccaactcatttgcttagaaaacgtgatttcatcctttatcctgggctccagtcattttctctgacatgtcttcccgaccatgaattgcttttccacactattgtcagggtaacaccttctggatgccatgtgtattagtctgtttccacattgctataaa

SEQ ID NO: 28704 - DNA, 1050 bp, Homo sapiens
acaagaagaattttcagaactatggactgggttctctcaatgcttatttctctcttcgtctgtgtgtatcatttcttcagcaattgagcagctctttcctaatgggctgaagtaggagtgaaatttatgttagatatagatcttgatcatatgatttacaaaatctctttttctccgtctaccattccccatcatggaacctgcaccagctgaaaattgggagttgtattcctaaggaagacggggaaggacacagtggggaacagccagcagtttctgctgaggtcccagatatccacatgcatttgtcttcccctccatagaaaactctcacctcttcctcaaggaagatggccctggtatgacattcatttccttccacttgatcagattcaggatctctggatgatgtgccgttttctcttttagggccggatgtacctgttgaggtcttgcaatctgttagctgaaacagacgagctctctgcccccagcacaccatgtgccacactgctgtagtagaaatcacgaccatcaagtctccctgcaccccctgcactggcggccactatgtttccttgtcgctgtctggcaacccgcgttctgccctccgggaactctcttgcctgggatcttttggagtcatggctttgccttctgaaagggtcttctctgcaccacatcggagatggatgctggagaggatgggcttccaaaacccgcttgctgggaggatttggggtctgggtgttgttttgaggactgaatagtcacagctttttataggccagccttaaggtttctgtagagatacaagtctctcaggactttagtagccctctagtctgtttgcttctgattggttccatgtgagtaaccatcaagatcttgtctagacagtttttcagcctaaaaactctggtcttttaaaggcctcagcgctctgccattcctttccctcccaatttaatagcaactcccttgggccaaatgaaaccgtgggcttgggtggaaggccaggcccttaatcatatctttggcacaaggctt

SEQ ID NO: 28705 - DNA, 1044 bp, Homo sapiens
agatcttagtaagttttgtacaggcctcttgagatgatgacttccctcagccctcagttcctgataaaccaccctggaggaaggcctctgggacctctaaggtctggcgtgggggaacctcctccagccttgtggttttggggatagagtagagagctctgtgcctggattggacaacgtctcttctaggttttgccttccttctcctccttgtacctccatttggggcaaacagaaagcagctttggggtaccccactttccctttgtgaagattattgtcttctttgttggtgatcaacttgccttgtctttacaagaggaagcggagattctctaagatgtgaggctgagaccgagtgttcttgtatttgagtgctttgtgttctgtgacttctttcacccagggttttctgttgttgtttttgcaaataggataatgaatttctttgtggggcaaaaagataaaagttttccgtaaaatgaacggaggactggagaactacttatgaactctggactggaggggaatcttgaaaatcatgagagaatgtaagatgtaagataggaagtataatcatgaactgaactgattttcttggatcctggtttctgaagagcttattttatagtataagtatactaagtatatgattatcatattgtctaatcgtttagatgtatggaatatgttaatctagcttttcttggtcatgaattaggaagtactcatattaccaaaatggcattataaggaaaagctaccatgatctaatgtaatgccaaattacgaccatctcatttctttctttatgacacaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagt

SEQ ID NO: 28706 - DNA, 1018 bp, Homo sapiens
gtattgcagagtgggtagtgctacttatatgtcagcccacttgtcttgatgtctatgatccaaaccttttttcttcagtaacatttttacattgcatggtcattaggagagtttaggcaagagtcatgaattaattccttttccctacatgtattattagcagctgtatatgcaactctcaagtcataatcataatttgagtgcatttgagaagacatgccaggcagatttatatcaaacagatagtaattttggtatttcttacaaccagaattttattcagaatttttatgttgtccagggttaatggtggagcggggagaaagttttgggggaggctaaatgcttcctatggtacttaaaatgtatttgactatagtgaatataaatatttaagagaattatgggtggtatatagttatgtttcataagagggccctggtttcatttgataccttttagattctctttgttctgagtaattcacttggttctgagtaagccctgaaagattatgtaaaataagtataagaaaaaaacctgcatgccttgcttttatcagttttattttgcagatttgtacgtgtctaagtattgctttcaaaaacaaataatttagattgttactttagtaattagtagacataacaatgatgatgtaatttcttgagaatatggctctcaacttgcatgcacataagaatagatgattaaatttggcaagtcaggttgacttactttgccaaagagaagtgtatgtttgaatagtttgagtgaatttttgtcttgtagttatgtgtatgcatctctcttagtccgttttctgttgctataacagaatacctgagattgggcaatttagaaagaatagacgtttatttagctcttggttctggagactggaaaatccaagagtgtggtgccagcatctagtgagggccttcttgctgcattataacatgggaagggaatcacatggtgagagggcaggagtgtgccagcttaggtctttctttct

SEQ ID NO: 28707 - DNA, 1054 bp, Homo sapiens
ttgagatggggtctcgctctgtcgcttagactggagtgcagtggtgccatcatggcttgttgcagcctagctcctgggctcaagtgatcctctcacctcagcctcctgactagctgggactacaggtgcatgccaccacacccagctaattaaagaaaaactcttttttttagacatgaggtctttccatgttgcccaagctggtgtcaaattcctgggctcaagtgatcctccatactcagccttccaaagtgctgggattacgagtatgagttatgatgctcagacatctttaatttttaattcaggagtgttttgtagttttcagtaaacaggtctggcacatattttgttaaatatgtccctaaatatttcagatctattgatgccattaaaatgatattttaaagaagttcaggctccaaatatttattgttagtatatggaaatgcacccaatttttgttttgtttttttttttttttgagatggagtctcactctgttgcccagcctggagtgcaatggtacaatcttaggtcactgcaacctctgcctcccaggttcaagtgattctcgtgtctcagcctcccaagtacctgagattataggtgtgtgccaccacacccggctaattttgtatttttgtagaagtggggtttcaccatgttggccaggctggtcttgaactcctgacctcaagtgatccacccactttggcctcccaaagggctgggattacagacgtgagccactgtgcccagccaatttttgtatattgaccttgtatcccacaaccttgctaaactcacttattagttctatttttttttttaagattcctttggattttcatgtcctgtgcaacatgacccaataaaagacaaagaatatattcacctttcttgagaatgactggtgctgtggctgatttaaaagggccacatttatgtgactataaagcattcagctgttggttccacccaaatcatatttaattaacctgaaatcctagaagaagagaaatactaaattcttgaagattaaatgttagaa

SEQ ID NO: 28708 - DNA, 1050 bp, Homo sapiens
acctgcctcctacatgcattaaggaaaagtttagaaaattaaaattaaagttgaaagtgaatattcttttttctttttctttgagacagagtctcactcttacccaggctggagtgcagtggcacgatctcggctcactgcaacctccacctcccgggttcaagcgattctcctgcctcagcctcctgagtagctggaattataggcacacaccaccacgcccagctagtttttgtatttttagtagagacggggtttcaccatgttggtcaggctggtcttggactcctgaccttgtgatccgcctgcctcggctccccaaagtgctgggattacaggcgtgagccactgtgcccggctgaaagtgaatattcttctcagaaaacttactgagtttgcttttgtatgccctaggtaaacatttggtaagttgctctcttctctgaacaaaaatgaatcctacgtagagtagttcactgaagagtgattgaatgatggcaccactgatccctcttcctgtttttaatttccgtaaataagaaaatacaccttttaaaagaaacatcaaacagtagtttcataaattaaaaaatgatggttaatttgggggtggggggatagccagactctgcctaggattgtctagattacttttcataggcaaccttgatgcatttcaggatttaagtttttctgtagctttttagttaataaaatgctttaaaggtcaaaggtctataattttgaaggttttgctctgtgtattttttccttctgtgatgttggggttaggtgtagtgtctcagattggccaaatgagtttttcttggtagacggctttaaaaattttttttaattttaatttaataggtacatagtaggtgtatacatttatgggatgcatgagatgctttgatacaggcgtgctgtgcataataatcacatcatataaaatggggtacctatcttctcaagcatttatcctttatattacaaacaaattatattattttagttatttgagcatgtacagttaaattattattaact

SEQ ID NO: 28709 - DNA, 1010 bp, Homo sapiens
gatgccctcccatcacagggcacactcacacccgtactcacacttgctcagatcaggaccatgtagacgcatcggttcacctaatgtgcacagcttggggatgtggggggaaaacggagaaacagagaaaacccgtgcagacatggggagagcgtacggacccacagacagtggccccggctgggaagtgatttctttttcccctcatcaacatcataacaaaatgactttgagtgaaacaacattattcaaggacctgctgttttgaattcctgcaaactctctctctcttttttttttctttttaaatggtcgcactttgttgcccaggctggagtgcagtggcacgatcatggctgactgcagcctcaacctcctgggttcaagggatcctcccagctcagcctcccaagtagttgggactacagccgcaccacccacgcctggctaatttttgtattttttgtagagacagggtttcactatgttgtccaggctggtctgaaactcctaggctcaagcaatcctcccatcttggtcttccaaagtgttgggattacaggtgtgagcctttatacccagcctcctgcaaacgctcttaaaatgatgaataacgctgctctcttcctaggtattgttttccagttatggctaataggcaaaatggaagtttccagcatgacccatttgcctccctgaactcactagcaattaggttttcagcataactgtctttctaggtctttttttttttttttttttttttttgcgatggagtttcactcttgttgcccaggttggagtgcaatggagctatctcagctcaccgcaacttccgcctcctgggttcaagcgattctcctgcctcaacttcccgagtagctgggattacaggctcatgcaaccacgcctggctaattttgtatttttagtagagacagggtttctccatgttggtcaggctggtcttgaactcccgacctcaggtgatctgcccgccttggcttccc

SEQ ID NO: 28710 - DNA, 1033 bp, Homo sapiens
gggctgtttttgactattggctgggagcttttgctgatagtgagcagaaagtttagtttagttcagggctttcttgaataccctggttaaccaaaagacttgtgagggaggaacaaggcagctgtcagggttaaatgagcttgctggttaactgaggcttagtcagaaaattctcgttttgttctttactagtaatgatctttctcaaattcatcggtctgctttcttgccttagagcaccccttggttaatataattgagtctttatttaaggtaggaagttgaaaccatcagggtagtgattctagacgtcagtgaccactgcgatgaaatactgcagttgattgccaaggtagttggtgttgaaaacatcttcaggttcccaattcctttcttatgttttgtcactcttccaagtgctgaaaagaaaaacttcaaataagagaatattgaagctacttagatttgtggcatactaatacataggtagggggaaaatggaaagaggatgaaaggaaaatgctagtttctttttcttgcgtaggagatcctttggctcatcttctttttccttttagctttttgtttgtttaagcaaacggtagcggataaactatttcagaattccttgtcattgactccaaatcttttaatccttaggggaaaaggttttcattagagttagatgaacattcacttgccctaaaggatttgatgctctaatgagaaaactacgcagatgtagatattttgtccagaagagttcccaagataagtgtaatcgattttgttttattatagggatctttttattgagatagagaattgtttccttttttgttttgttttcattttgtaatgccttgtctttttccagttctcctggaagctaagtttcttgaattttctggccaaacatttttttccagagtatatatttgtttctttactattctaaagccgactcacttgttcttaagataatactcaagcagagatgcttaaaattaaggaatttggacattaggacaga

SEQ ID NO: 28711 - DNA, 1028 bp, Homo sapiens
gacttcttgttctctcctcttctctgtttttaaagggcagcatggtgtttttccagtgtctggggaatgtccctttatcttttaattccttaaaaaggtggagacttcagttacttttaaatgagagagttatatttagtgtttcgtaagcactgttgtcaggtagagatgagaatgctgaattcaaaacaactctgatattagtaaaatgtaatatccagtaatttgttattaatgactgtaatttagtggtaggagcctcaagggaaaaataaagtatgtggttattttagagaagaaaaatctcaacctgtcttttcccacctcctccctctcctgctttttctcagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtgtaagtaactttagaaaatgtttttattggccaggcatagtggctcatgcctgtaatcccagcactttggaaggccgaggcaggaggatcgcttggagcccaggagttcgagaccagcctgagcagcatagacccctatctccaaaaaaacaaacaaacaaaaaaattagctgggtgtggtggtgcatgcctgtggtcccggctacttgggaggctgagatgggaggatcacttgagctgggaggttgaggccacagtgagccatgatcacgccactgcattcccatgtgggtgacaaagtgagaccctgtttttatcatagtgggacactataagttattagcttaaggactgttgagcactcttactggtatgacataaaggctatgcttggtttcagtttaattcagtccacaggtttgattttactgtaataatatacaattcatgcatgtgtcaagatttttttggggggctgcagggtacattttcagtgcttattaaatttcttaaac

SEQ ID NO: 28712 - DNA, 1065 bp, Homo sapiens
ggagctgggatcctcactatgagagaagaaagataaaaatatggagtgaaggaaggcaaagaagagctccatgaattggaatgagagattccacagattacttattaattacaaagataaaaaaggaacctttatagtggagaaacttggaaacttggtggataacacaacttttcgtttttttggagacagagtctcgctctgttgcccaggctggagtgcagtggtgtgatctcggctcactgcaacctctgcctcccaggttcagacaattcttctgcctcagcctcctgagtagctgggattacaggcacgcaccaccacacctggctaatttttgtatttttagtagagacagggtttcaccatgctagccatgctggtctcgaactcctggcctcaagtgatctgcccacctcagcctcacaaagtgctgggattacaggagtgagccactgcgcctgtcctgcttttcattttgacttgagttatttctaagatctgtctgctgagagagctggggagcagggccacccaagtagcaatgagcattcctcatgcccatatcttgttttctaaataccattgtccattaaaaggagtcagagctcctaggagaaatggctcattgtgggaaggggagggaaggtcaacgatgagtcaggagcggcttgttcaaaacacaaggaggtgctcaaagaatgatagagacaggtcagaaggacacaggggtcagcttgatggggctccagtggccaaacctggaacaatttgaatatcaaaattaataatggcaataatgaattatcacgttgaataaaagagaatccatgagtccagagtcatactaaaaagcaaataaacttaccaacaaatacataaacagaggtagaagaggagaatgccagctaatgattgctgaaggaacaacagagttggaaaagttggctagtctgaaggtagcaagttatctcaattgattgttcatggtcagttacagattgaactctttgttttattcttttcccccttctcactactgcatttgactaatcatacagaaaa

SEQ ID NO: 28713 - DNA, 1003 bp, Homo sapiens
acataagtaatgaaaatggaatgttaccagatggttgatttttaaatatttttattgttttaataagtatcacttattttagaagtaatgtctattcattgtagagaattttaaaactatagagaataacaaaaaattcaaatcacccataatccatcacccaaagataattactcttaatagtcttgtataagtccttataagcgtatgtgtgtgttatagatgtatatttaacaaaaaaactgggatcacactgtaaatataattttgtgttcctcattttaaaaataatatgatattgtgaacagttaacagctatattataattgcatcaggtggatgcactaacatttattttacaaagtctctattattagacttttgagatggttctaaattttcatttttataaatgtcctaacagcaaatattcttgaacaaaaatctttatccttatctctgatttgtccttaggaaagagttttagaaggataacgggatataaaatttctgaaactcttatggattgccaaattgccaggaaggtagcctcaattttacattcccaccaacaaagcatgactgttcacttgtccacatcacgtattgattgtttatttaataagcattttatgttttaatttttcaagaaaatgacagtagatcttccatgatcattttgagaattaatgaaatgagttcagagaaattacaaagtatggtttggatagctgacaggctacggtttcacaggaatttacttagcaaacttatattaagagcttcctggcagcctaggaggctgaaatcacttatttgtatgacacgacttaaactttcaaactcatttaggaaattcccttcacaggccaggtacggtgggtggctcaggtctataatcccagtgatttgggaagctgaggtgggaggattgcttgagcccaggagttcaaggctgcagtgagctatgatggcaccagcctgggtgacaccacgagaccct

SEQ ID NO: 28714 - DNA, 1059 bp, Homo sapiens
ccttcttttttaatgtggctaccagaaaattccaaattatatatgtggcttccactcgcagcttgcattatgtttctgttggacagtagtatgccaatatctgatcctttcagtaactgggatccagccagaggtaaagattcctagaaaaattgtctctgtctagaccaagcccattcaacccacagcccaccggccaggatggctttgaatgtgacccaacacaaattcataaaccttaaaacatgagattttgtttctgtgatttttttttagctcatcagctatcattagtgttaatatattttatgtgtgacccaagacaattcttcttcttccaacgtggcccagggaagccaaaagagtggacacccctgctctagaccatcatcagtccttcctggccagcgtcaggtgtgcagagtaaaggtttgtaggcttctcatcaagcgtcaaagaaactagttttcttcaaatttccatgaaataaaataaatgtcttgggttttaaaaattgtacaattgggaacatctttgaatgtttttttttttaagagacagcatctcattcttgtcacccagactggagtgcactggtgtaatcattgctcactggagcctcaagcaatcctcctgcctctgcctcccacgtaactgagactacaggtgtgcaccagcctgcccagctaatttttaaaacattttttagagatggggtcttgctgtgttacacaggctgttcttgaactcctggcctcaagtgatcctcctgcctttgcctcccaaagccctgggattacgggcctgagccactgtgcctggccaggacttttctttttaactgtgtgtgtgtcaggttgtcttgaacaccatggcgactccctcagactttttcatgtcttattccttggtaagaaggagctttctagctctgagactaggcaattaggatggttctctgaggcattctctgtacacagagtgtcagtcaggtgccatatgtagagagtcgttgaataattcagccggctaatgtccaagacgtcagtacttcgctcc

SEQ ID NO: 28715 - DNA, 1053 bp, Homo sapiens
atgagatacctggggaggagagagggatgtatcagttcagttcccatgtgtctcaagcacctatgtgtctcatgttgtaaatgaatcattattgtgccagagtcttaaaaagcagagccaagtcactgttcatctccagacccagcgcagagctgccgaagacagcaggatggtggcctccagggggtcggggtgctgtgtccttcagaacgttattagtaattggaaaggacatttccaagtgtgtgctgatggactgaactgatttttgtttacagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcaggtgagagcttcctagtcctacgcgactgacttcacaagttttcttctgacaaacggtgtggtctttctctcaacgttagtagacgggcccaagaatttaatactgtgtttattgctgagacctcgcatgtatattcgacgttaatttctcatttccctgataaatgcatttgatgtatggccgttatttctgatgggagcctcaaggcactcgtgctgtaacttcttttccctctgtttcttctgggctcttttcaggccacctcacattgtaagggatgcttttattgtctggtaacagatatgccctaacttctttctggcactagcattaacttgtctgttttatacttacaagtatctctttgtttaacacccaaaggctactactttgacataggctggtgttctttactgaacaaaccttgtcaatgaggggaagtggattatgacttcctgtctacctctgctggttaagggacgtctttgacagtctgctgttgttgtctcaggagcagtggagtccacgcggggtgagatagcctttcctttatgcagcagaaagaaagatacttttgtgatagcagcctcgcagcacttcccttgctggatgagacacaactctt

SEQ ID NO: 28716 - DNA, 1038 bp, Homo sapiens
aaccccatctctacaaaaaatacaaaaattagctgggtgtggtggtgtgtgcctatagtcccagccactcaggaggctgaggcaggaggatcactggagcctgggaggtggaggttgcagtgagctatgatcacactactgtactccagcctgggtgacaataagaccctgtcttaaaagtatggaagtatggtttgaataatacatttttaaatcccagccatcaaagatgggaaagccatgtacattatactacttcctagattctagttctcttagtctcccagctagtgtcgattacattctacattgtcaggacttatattttgcattctcttctttcattataatcatcacttatctcagtcttcttcttacaattaaatggagttaatcctcacagttggttcttttgacatagtttttctagccatctcttggatagctatagtttactatttagtacattcctcaagaaggacttttatatagtattgcttgggatatgtttttttttttagtttggttgggtttttttatttttgcacatttaaaactttcagttacactggaatgacagattaggtgagtataaattctagggtcacacttcactgccttgagcattgttgtatcattctgcttgcattttgaattccattttgctatggagaaatatggtttcttttcctcttatgagtgactcgatcttttttcctgactccaaaaggatattttcttttttgaatgagaacacttttgctacagagtattttcattgagtgctcctaattcctttgcccttgactgtttttgaattatcacagtaaatatttgttctgcttcattatttcagttttcttatttggaacttaattaggcatagctgtgtgtttgttacctgtctccaattttatctctttgtggttctttttgaattctttcttaaattttcatttaatttatttggattttgtcatttctgccctgcatatatccttagacccttttaaatttattttctgtggtggtttgatt

SEQ ID NO: 28717 - DNA, 1035 bp, Homo sapiens
ccgcagcctcccaagtagctgggattacaggtgcccgccaccatgcctggctattttttgtatttttagtagagatggggtttcatcatgctggccaggctggtcttgaacttgtgaccttaggtgattcccctgccccagcctcccaaagtgctgggattacaggcgtgagccaccgcacccagcctgagctctttctttctttacttacttgttttagagatggggtcttgcactgttacgcaggctggagcacagtggcacaatcatagctcactgcagccttaaactcctggtttcaggtgatcctcccatcctagcctcccaaagtgggttgggattacagtgcgagccaccccacctaaccgtgctcttgctttctaacaagggccctttaggctgttagcctcatttgctgctagactcatctcttgtcctctactctgaagtttgcctgcatcctggcttggatttgaatgctgcactatcgtgattcatacatgatttcactctgggatttcaatctgctggctctttggttgttcatatataagtgtgggctggctctacagagcattttctttggcggactccctgtgttccacggtcattactttggcctgtaattatgccaattccaggctcctttgtaattggagccctcctaaatgtttggtttatagtctggagtctttacatgcacttatgccagtagttccaaacgaatgtcaactttgtaaacctacaagttggaatgttatttcttgaatagtccttatccgaaatgcttgggactagaggtgttttggattttggaattttttcagatttggagtatttgtagatatttaatggttgagcatccctaatccaaaaatccagaatccgaaatgctccagtgagggtcttctttgaatgtcatgtcagtgcccagaaagctttggactttggaacgtttcagatttcagattttcagactagggatgctccatcctattgaaatctgaaatcaggtagtctctattaacataattt

SEQ ID NO: 28718 - DNA, 1023 bp, Homo sapiens
gggctcccttgcttcctgctgggtggtggaggaagggaggaggaagggttctgtagcagcttcttatgggccagcatggatatggcttccttgctttcaccccattccatcaagaggagcctgccctcatctgccagggaggctgggagatgaagtctggcctgtacccaggaagtagagggcagagtttgaggacgcaagggagcggagaggttctctctcgactctgcagacctgggcttccaaagcccctccttcactcattcagcaagggcttagcgagaggatgaggagcgcggcccgcccttggggagctcccgttctcagcccacacctggttagggcccctggagcccgggccttgttgggcagacacaggtctccccgctaccttgcacacctgtgggaacagaagaatctatggaaggtggtacctggtgggggcaggggtaggaggagctgaggaaggaaccagctcatgccaagaggtagagattggacttttgaccagacttgggcccgatatgagccaagacagcccccaagagccccctgaagcctcagttgggggaaggccacgagtggggttgtgcctcagtggacagggtgggctatgagacagtgcgcggctggagcgggcgcccgaggaggcatttattagtggcttccctcctccatcctgtttctcatccaagtggttttgtgcatacacaccccatggctgttgggtcactagattgggattgatggcctggactcaaattagtagttccatattcataggctctgagaaaaaccttttctttttgttatgttgtatttactcacgtgctgtagacggcaccagttcaacgcagatggaaccccaaggctcagagcttgctgtacttgcttcggcctccgcagcaccttggtgccaggattctgaaggaaaaccacaccatcaacagcactcgcccctggggctgggtccccgtgggcggccccaccttcatcctcttcgtttcttcaccacccatctct

SEQ ID NO: 28719 - DNA, 1835 bp, Homo sapiens
gtatctctacaaaaaataaaaaaatgaagccaggcatggtggtgcttgcctgtagtcctggctactcaggagcctgagatgggaggattgcttgagcccaggattttgaggctgcagtgagccacgatcctcccactgatcgtgctccagcttgggtaacaaagcaagaccccaactcagagaaaagctttaaagaaaatgtttttagcttcaggaacttaaaactcaaggagctgtttctagtgtgttgaggtatccgggtttatgttaatgtttttgagttaatagactcctttgagaacacaaaactctaaagacagtaataattatcaacatgtttaagtacttaagttttaaggtccttgcatgtattaattctcttggtggattaaagtaaaaacagtgtagagtgcagctaggacaatgtacatttacaaatacacacatagacctttatatttttagggtgttcacaggttgtgatgagaacattcaggaaacccagttaagatcccttcctctgtaaggtacccctagtggttgtagaacatagtaagtacatgatggcaagtaactatggactcatttatataaagttctgctggcctaaagtttttcagaagagtattaccccgtgagcatgtggtagaaagtctgtcaacaaacctgccttcttgatccctagctctaggattgtcttactcagggtgtgtggccttttacttcttgggggcctcagtttctttttctgtataatggtggtattaggtagacggtcttgaatggctctttcagctctcaaattctacagtaacttgagcttactttttattgaatagaaaatatagcttgcagagccaaacactaacttatgtgaattgttttttacagcatttctgtcatcatttgttatgaattcaggagtctgggaggaagttggttgtgctaaactctggaatgaatggtgtagaacaacagacactacacatctgtcctccacagaggctttttgtgtgttttatcatctaaaatccaatccctcggtaggtgggacttgtatgtttgaaaagcagttatttaagtatcacttacatgttatttactggtagtatactttagtatggcaaatctttcagttgctctgtcagtgtgcactttttctgatactaatcaccagtagtggtttgactgttaaattttaaagagaaataagtaggtcaatagtggagccaggaaaataagtattacctaagtgttgtcattcacatgttacatatatggtgatagtttgtggtgtgtataaaacttacttgacaaaaagcgtggaacttgacttttcaggtttttctctgtcagtgcagttgctatgttgcagaagatcaacagtatcagtggctggaaaaggtaagagagaaatgaaaacctgtgaatggttagtctacaggagttttcattttttaagggttcgatgtcttttaacttaaacttatgcagtcagatatttatttctttaaaatattgtgggaatttcttttggaatataaagaataaaagaacttgcttatttaacgtgaccaaccagttgtgttttatacttctgtgtcctcccgtcctcaatgctgaggtacagaagtataaaacacagttggtcctcagcattgaggatggtaggtcacagaagtataaaacacaattggattcctcccgcccatctttctttgtttacatcactttagatcttattaaaaggtaaaagggttcttagaaatctatcaaatccagactcttctacttatagaagaggacatttagaaccacagtgattgaagcttacc

SEQ ID NO: 28720 - DNA, 2070 bp, Homo sapiens
ggtgcagctagttgataatagtatattctcatcctactataaagtgcaaatttcaccttaattttgcatattttaaaatttttgtttaccctttgtagcatatttacattttagcatttgctaacattgatttaatgtgttaaagattcattttggatatagggttgacttgttggagatactagttcataattttaaaattcccaagagaagtgtctttgaagtggtaaacacagtgcactttaagccacttctcttcccacagagtccagctgaaggaggtaagggcatgctgcatgagagtaatgccgtgatgagtgtcttactctggtaaaatgccatttacaatgcctggagactgaacactgaacaaaacatagtgcccttagaatttcactggaaaaacatgtgaatcacataagttagttggcaaaaggaactgatgtgtatgtggtggggttgctttgaataaagtatttcctaacctattctggggagaacgctcaactgatcttagagaagtgtgaaatcagtttcatagacttagggaaaaatctgaagtgcttgcactgtgagggcagaggcctgcctcattagtctagctgtatgaacatgtcagtccacagaagcagtttttacctgtactcatctgcccttcagtcagctttgtgacagaagggcaaacatcttcacagaagaaaaagttcagaaggttggcattggtggtttcattgctacagaataatagtgttacttgatagtatctgactaaaagagctctcattttctagtacttagtagtaaaaagaatgtggtggagtcctccagatgtctagtgtgggtggaggatatcaactggttatttcagtgatctacagccttaccttttgaatgctaaatgtctggaaacttcaggcagggtcctacaaaacaaactgccatcaagattggtgtgtaccatgaaggcagttttagatagtttgactgttcatggctgcaagaaagacctaaaattcaagggcccgtgaacttcagatacgtaaaaggaatatcacttctgttctagaagagtactaattagacttgtttgtgaaatttgaaaatttggctttgagacactggtaacaaacatatctgagccctcctaagtttggtcagcacggagtagtagctctggcatcatgtggctgtgtagagctccagtgtgatttcaagccccctctaaaaactgccttagtctgcatgaagtagttaactctccaaagtgctttttgtctggcaaatcccttcacaattttcacctctcgtctaaaagcttccttaaaggaagccttccttgatcccttaggctaggttaggtttccagtctgtgttctcatagcactctgcactttttggttccttaaagcaactctgtgttattttttagaattttaatctgaatctcgtgtgtcacatacctaggtcagaaaatactggaacaatgaagttaagatttagtaattcaaattatgtaaaatgctcatatatatgtttttagattagcagctttatgatgccgatgctgaaggaacttttcaccccattcttacaagtctgctactgttttaagtgacatccttatagttgtagataagcaaatgtaaggttatatcaatgtgaagaagcccttagtatcacattttaaaatttatcatttagcaatatgacttttaaatttattgtttccgaatgagtgttgttgaggaatgttagcagtagtaaaatcttgtgttacaagatttttgcatttacatgaactttcactcatttttcagaatttgttcctagagacagagaacccaatacaaaagtgagaacatgtatgcataatcagaaggatgcagtgcagatgcctagtgaaactctgaaagcaaaaatggtacctgagaaagttccccgcagatgtgctactgttgctgcaaataaaataaagataatgagtaatctaaaagaaacgatctcaggaccagaaaatgtctggattaggaagagtagcagaaaactgccccatcgaaatgcttctgctgc

SEQ ID NO: 28721 - DNA, 1551 bp, Homo sapiens
tatctgattaaatcatttctcagtttattaatccttggaaacaatgatatagcagttactcacagcttgtaaattacaacagaaaggttcctttcaaatagtagagctgcacctaaagaggaaattgggtttataagaaaatggaggcaaagaacttaagttttaagaaaaagcacttcaaaacagaagggcaaatggaaaaggggaatataaaacaaaccaataaaaataccatctgagggtgttactgtccaaaagtaaagaataagatgcatcactaagccctttgcactcgttatgacctcgtaagtaaaaattatcacttagaataaggggtgcacactacattccctctgtcttctagacttttttttttgtagaagaatcagaaaacaatttactaacctccctgtttgatattaaaaataggaagaattttaatattttctgttagtacaagttgaacttgattgtgccaactgaaaccccagaggtttgtatatcagtagaatgcaagaacattgttaaaggtgcttacgatcttttttgttttcctttccactccattgtatcaattttttgagtaacttttaaatggctagaaaatggtctttttgctttgcccttttaaagctgaaataaccagctccattcttttcatgaatagtaagttgatatatttatttatcaggtatcttgcagttgtcaccaaatactgtagttttcttatgttgtatggaaattatagttcaattattttaatgtgatagagtgcaacaagtcattgtagaacttttcacctgttaatgttgaagttatacctctgaatttctgctgtggatatcaaggaaataataaagcagaaaccccaagaaatttgcaacttaacagtttgagactgtctcttatcctagtatttgggaagagaaggaataaatttgtcaaaactaggtgagaaaatagagcattgtgggaaaaactgagtccaactagattagcaaatgttaattcctagctcaaactgtgaatagtaaggattgaaaagtaaagtatgtaatgctaagggctgtgttgtcttttcttacgattttaagttttaaaggctgttaaattacagagatgttgcccaaggatacatggggattctcaaaagtaagagatttttacctttttcataatctgccaagctggttcctaatatattgttaaattggtagaaaaatatctttaaattggtgtctgctcaagaattgcttttctagatttgatggagggagggggagagtcacatcatttggattctaccaatctgcaggctctatctttggcaacatgtaaataattagactatacatctgtttctcaagtatggcaagaccaatagtttgaatttaattatcaatgctatggtatactttctggtcatattttagttatgtcagttttaaggtaagttttttcatttattaaagcccttaaatgagattttagactgccaaagagaagaggcagtccaattgacctaactgaaatgagatgaccagtatatag

SEQ ID NO: 28722 - DNA, 1055 bp, Homo sapiens
tgaagtggcagacaaggcgaagcatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcattgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaaggaaaattaataaatcattaatagttaaaatgtttacattgagcactagaacatgtttggccttttttttctacgttatgcaaaatgcccagggatttaatgcacaggtgtactttaatgtttagggtcagtttgtagtattcttgagaaaaagataaagggttataatttgaatgtgaactgatccaga

SEQ ID NO: 28723 - DNA, 1014 bp, Homo sapiens
gcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttccattgtaagggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttag

SEQ ID NO: 28724 - DNA, 1035 bp, Homo sapiens
ctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatg

SEQ ID NO: 28725 - DNA, 1565 bp, Homo sapiens
agatcttaccatatttgtcctttgtgtccagcttatttatttcacttagtgtaatgccttaaaggcttatgcatgttgtagcatgtatcagaactttattccattttatggctgaataatattaaagtgtgtggttataccatatcttattcattcatctatcgatggccagctcggctgtttctatttcttgaccattacgagtaatgctgcagcaaattttggaatacacgtatctctcagaaaccctgctcaattcccttgggtatagacctaagagtagaattgctgggtcatgggataattcatgtttaccttttccaggaaccactacactgttttccatattggctgcacctttttacattcccgctggcagtgtataaaagccacagtttgttcacatccttgccaacacttgttgtttttggagttttgtttgtgtgtgtgtgtgtgtgtgtgtgtgtgtgtgttttcttttttttcttttttttttttgagcctgtctcactctgttgcccaggctggagagcagtggtgagatcttggctcactgcaacctccaactcctgagcaatttgcctgcttcagcctcccgggtagctgggactacaggcttgcgccaccatgcccggctaattattgtatttttagtagagatggggtttcaccatattggccaagctagtcttgaacccttgacctcaagtgatctgcctgcctcggcctcccaaagtactgggattataggcatgagccactgtgcctggcagaataaaatttatatatatgaaatactgaaaataactgtcaaagatcatttcagattaagtataacaaatttcacattcatttgtgagcatatatatatgtatatgagaagcatgtaagaaattcgtatatctcacatactttttaaaaaagttttctggtattggagtgtcttcgccatccactgccatgcacaagaattatatttaagttttgagcattagacttttgcacttattttcaggaaaagtcgtggaggaggatagagtagttctgtacatacatagctgtatccaaaagtatttaagatttgatgttatttaattgtaaacattgttaaaacaaatctttcatatgcattaacgttctaggttatactttctgctactggatgcaaggtatttttgtttcatttttagaattaggtggcattgaaaacagattgcagacagagatgggtatataaaagtgcttttgttcccttgccccaaagaaagacagcgcttttgtagcctaaatagcagccttaaaaccattcaacttcccatctaactttgggagaagggtatattttggggtttgtacatacagatgttagaataggcaaaaacagttgagattcactgacatatagacacaagtcctgaatatagatgcttgacttcaaactactttcttatcatctgagaggtatgtatttgatacttcttacttccagatgtcattaagggaagggggttggaaacagaagaagtgggtgacagccattacctataagcagtgatataatacat

SEQ ID NO: 28726 - DNA, 1036 bp, Homo sapiens
atcaatagaaagtgaacaaatttgatacacagagtaagagtctctgtgttttgtatgtataaggatcttaagtggattggaaacatagatcgagactgtaagaatattaaaagtaaaaaggaaaatctgattgtgagactgctgacagcataagaacatttggatttgaagaaggaacacatgagctatcagattaagaccacaaataatgttacagagccagtggaggctctttgcttgatgtgttagaagctaatattatgacacagggtttttctttttcttttttttttttttctagcctactcaagtgaagtggtgacactgggtttttgagaataagctttatattgaaagttgactcctaaggagacaggagtgaatttcaaatctgactccggtgctggctttaaagcagtatttttattttttatttttttttaaagaaaaggttcagggcatggattctgagattagcaggtgattaatggaaggaaaggagaggtctggaaagtctttgggcatgtatagttatttctttatgttatctgatgggttgcgtgtgcaaatttgggggaagttagtgtgaagcatgctggaaattcaggctctgatgtcagcaggctcattctttgcagactccacttggccatactggttttaaccagtttcagccagttcttcttatctcataagcagagggagttttagtgttttatagtaggttgggtttctttctttctttttttttttttgtcattttgtaaacttaagaatttttgttaattgacttctttaactctttggggcatgcagtttcagtagaaggttactaaagttttgttaacatgttacacattgggtaacttttcaaaacttgatgaggcctgtaatccctggaatttgggaggccaaggtaggcagatcacttgaggtcaggagttcgagaccagcctggtcaacatggtgagcccccttctctactagagataaaaaaattagcccgtgttggcgcttgcctgtaatcccacctata

SEQ ID NO: 28727 - DNA, 1439 bp, Homo sapiens
aggtctatacccttaatgcaaaataccttttctcatgtaaggcaacatagtcataggttatgaggattatgatgtggacatctttggtggggccattattctgcctatcatattatcagatgtgcttcatattctgcgaaaacaaatattataaacctgggaggtgagaggtcatggaatagcctttcactagataatgtgctcttgttagagtatgcttttcatagctaactttgtaatatttctgaaattggttaagttatatgaaaataacttacgtttcatgcatagtttaaaaatttcatttctggaaaaatgtgttgagagcaacatatatgacattattgtatttttatagaagacagtagatcagttacatttttaccacagtcttacaccaatagtgtgatttttcttaagactgtgaatgtatttttaggtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagtaagtttccattgtttaaatgtttggggcttttcttgttttgcagtgaggaaactggggtagagttattaaactttaaagagaaagatacccaggctttatgttaacttttttgctcctatcactaagttagtggtagaagtattgtttttacatagttttcttcaatttatagacacccttgtgagctcatttaagaatttagacttagataatcagtattacataacagtgggatggatctacttagatttctatctaagtaggcccagcactaggagaactgtgaattggataaacgtgtctgtttgcactctttaaaaagggaaattgaaagatgactttataaaaaaagttggattataacagcacagagtgactgtaggatgcttggagtacatacagcaggaaataaaaccatcccatgtgtcactaacaataaatagacattaacattttggtatatttctatcttttctttgtttttatacctctttttaaacattactaatgaattttaagagtcctctaaccttttcctctcttccatcatttcacattttttagagatctgatgcatttacatttctaaaagcaagaaatgaatctatgaattaaatattgtgtttaaaacctaggactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaaggtaattttttatgtggtttattgaaaaaaactgcctgatctgtgtagataattttccaatgtaat

SEQ ID NO: 28728 - DNA, 1013 bp, Homo sapiens
gcacaatctcggctcactgcaacctccacctccgggttcaagctattctcctgcctcagtctccttagtagctgggattacaggtgtgccccaccacagctggctaagttttgtatttttagtagagatggggttttgccacgttggccaggctggtctcaaactcctgacctcaggcgatccacccacctcggcctctgaaagtgctaggattacaggcgtcagccaccctgcctgcttctccttattttttcaagaaataccagtctgtttcatttgcgctcccttaaaatttaagaaaattagccatttgtcatgtgggattatttatccattttgacttgactttttaaaaattttaatttaaaaattttaactgtatgtaagcttaaaattttgaatattgtcaggttcaatttgtgttttcagaggcctcagggttaagtttgcctccttgaagaaatagactgaaaactgcaatactggcactcttatttttaatttttaatttgttagggtaggtagattgtgtttttacctgaatttaagcaatttgttaatctcaatgagtaattttaaaagagttgcacatttgaactctatttttgactgtggagataacctagttttataagctatgaaaattgaattttaataccgtatatatttattttttgtgtttttttcttcctctcattgttttttatggtattcatagttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttggtaagttttttattttttaggatgaaaagtttttttttcaatttttttcataaaggtatttaaaaatactagcataattgaggtttctgttcttttctacactttgtattggttatcttttaatttagcctgtaatgtt

SEQ ID NO: 28729 - DNA, 1071 bp, Homo sapiens
ctgtggctgtagtggaattcaagggcttcatgccttgtctttcagttattgttcactttgggtgcaggccacataggatttctggttttgttcttaaacctgttattttaataatatatccttcttaaaaaaatttactgttaatatttaaaattgtactgctgcagtgaggttaattttcacattttgtatttttataatggatacctattatccacattttgtttttatgaaaggctaaccagagatttgttgttttttaacaggtgggataatactgaaattgaaaaacttagcccatgggacatggaaccaattcctgataatggtatatatatttgttaaataatgaaaacattttatttttataatatgtacatttgccagtgcacatggaacaaacatatttgtattctatgatcaatatattcaaattattacagtaactgaactttactgaaagaagacaacagcatcgtgtttatctgttttgttaattcttgaccttagattccagcttgattttggctgtaccttaatagcttgctgtcgtttctcatgtaaccctgcattaaacttaactcctggctgggcgccatggctcacgcctgtaatctcagcactttgggaggccaaagcagatggatcacctgagatcaggagttcgagaccagcctggccaacatggtgaaaccctgtgtctactaaaaatacaaaaaattaggcgggcatggtggcgtgtgcctgtaatcccagctacttgggaggctgaggcaggagaattgtttgaacccgggaggcagaggtttcactgagccaagattgcggctactgcactccagcctaggcgacagcgagactccatctcagaaaaacaaaacaaaaaatttacatccttcatgtagcctctacttttcctacctcattcttaatcttttacccttggtcttccttcaaggaaaagattgaacttgacttccatctgtcttctgctttacctcaagttgtcttattatggattttctactgaaatagacaactatttaaagccagcctgtcctccagtgctag

SEQ ID NO: 28730 - DNA, 1051 bp, Homo sapiens
cacttgaaatatggatggtttgattgaatgtcttaatatgtgacttggcagagtatgaggcataaacatttttttttaaagaaatgaatgtgttgtgaatgtacacactgcattttgaagagtagttatgaagaaaaaatatgtcagatctctattttgttttgataacatattgaaataatattttggatatatttaaaatatgctatgaagtttactgttttaccttttaaaatatagctggttgaaaattaaaaattacattcgtagatctcatgtttcttttggacagtgctgcttttagactatataacctgctatgtagagagtttaacaattttttaaatttttgtctagatatcatgatatgccagatgttattgactttcttgtattgcgtcaattttatgatgaagcaagacagaggaattggcagtcttgtaagtctatccttactaagttttatatacccttaaaaattaatctgttttattggtctacctttttggctgtgggactcttaattatagtatatacaaacatgtaaattccagaagagatataagtgacctataaatatattttgcttacggcttggtacttactgattatgcagactttcttggtaggggccgggggacggtgggcatggcacgcattttctccctaggtcacccaggctggagtgcaatggtgtgatctcagctcactgcaacctctgcctccaaagttcaagcgattctcttgcctcagcctcctgagtagctaggattacaggtgtgcgccactacgcccggctaatttttgtatttttagtagagacagagtttcaccatgttggtcaggctggactcgaactcctgacctcatgatccactcacctctgcctcccaaactgctgggattagaggtgtgagccaccgtgcccagccctattatgtagacttttttagacgagcaacttttcttctgttcttttggttcatgacgtttggaaaagattattttcactccttgactataggctagggtagacttacttccttttaga

SEQ ID NO: 28731 - DNA, 1574 bp, Homo sapiens
tttgtgatttcgtttgtttttagctcaagaaagaattccacattttagcaagtggcaaagatgttggtttgttaacagttattcagattgctggtggggtgtgtgaagtggtccaggctttctaggggatattttgttaatagtagttgaaactgaaaaatatttggaacttttaattctgtgattttactcttctggtaatttggaaaacaagcagaaatgcttgtaaatatatgagtattgtagttcactcactgttgacagaaacaaagctggaaaaaaaaaattcagatattccacaatagtgaatgaaccaaatcatggtgcattcacacagtcacttactatgtacagcccatcttgtacttgaaggttgaaaaatatttgttgaatgaatgatggatacattttcacagtgtattactaataggaaaaatggggtgtgaagtggtatttctggttatggtagcaaaattttgaaaacatttgcagccaatcaaaagaacaacatcaaaatgtcaatggtgatgatctgtggggtagtagtacacgtgtttttttattttttatatttttattctacagattttgatacttttaaaaacttagaaaatgaagaaaatgctagttattttaacaaatatagctgtttttaacacttatattcaacttaatggctctgcttgtataagttaggctttatatacattggcggttttatttatgtctgtttaacttaggactgtgtacctaagtacagtccatcctcattattcttggattctgtatttgtgaactgcgtacttgctttatttgtaatcccccaaacagtactctcagagccttttggtcatttctggacatgctcagggtggtgaaaaatttgacttgcctgacgagcatgtttctagttgaggttgaacaaggtgttgctctgcctttttttttttttaagctctcgcactgcaaacaagtgtccttttcatggtctattcagtgccacatgttttccatttttgtgctttttctggtgactttgctgtttaaaatggcccctaagcgtagtgctgacatgctctctagtgttcttaagtgctagaaggctgagatgtgccttatggagaaggtatgttagataagcttcattcaggtatcagttaaatgtttgcaaatcaacaacatattaaataaggtacctttaaacggaaacacgcataaaaccaagttacgtatgcactggtttactacagtgttgtgaccagaattttgcaggaacctatccctatatattctctatagcactgatttagtattttatttcagtgttctaggtgactatagaacataactgctgtgaataatgaaaactatgcttagcactttgtttggtacattataataataacatttgttcagtgaataagtggatgaatgatctgttgtattcctagtatcagagaagcagacactggggggaaggttgactatggcaaatccatttgatggatactccatccaggtagggactttcacttgtttaccgtcctgtccctactgcctagaagaggtcatag

SEQ ID NO: 28732 - DNA, 1105 bp, Homo sapiens
atcaaaagcacaatcatgaaagaaaaaatataaaaaatttggactacactgaaatgaaaactgctttgggaaagacactattaaaagaatgaaaagataagccacaaaccaggataaaatattagtaaaacttatatctgataaatgacttatattcacaatatacaaagaactcttaaaaccaagcaataagaaggcagcctaatttaaaaatgggcagaagatctaacagacacctcaccaaagaagataaacagatgacaaataaccatatgaaaagctaccaaaatatgtcacagggaattgaaaactagaacaacaattagatacatctattagaatagctaaagtccaaaatggaaaacatttacattgactttttattaactttactcagaatggcctgttgtatcactttctttgctaatggtggtagtgttaaatcttacggatgttctctttttgtcttatgctttgataagaaagggatgtagtgaagaagtttgctttttaagtttatctgattatatatttactgattactgttcatttttcttagatgatttaatcttactggggaggattgtgtacagcttttttctggacatgtgttgtttaacttcagggatcaagatttttttccccccttcacaaattaggagacttcctgtgatcagagtgaaggttctggttcttcagaagaggatgaatggagaagtgacagaaaaagtgagagttacagcgaaagttcaaggtatctgtttttattgttgtggtcttttaagcattttagtcatagtcttggatggaatcatacttgaattttattcaagaggcaagaatttgcaactgtggaacagtttttaatacacttaaaaggagaccaaaactagatccaacagctgttcctataggagtatttcaggagtttttttttttttttttttgactttaagcagttgacccagcactgttgaacatgcatactgaaaatataaatttaatcttggttgcacttaaaaagactagtatctaaagtatgtgtggtaaaaccacagtatattcattattattgcatgtgttgaatttttgttagttttgagat

SEQ ID NO: 28733 - DNA, 1039 bp, Homo sapiens
tgctgcttcaccttacacttttatgttatggacatgccttctttccctaaacctcatgaaccaacctctgcaagtttccatcttttcttctgcagctttgtcacctctcagccttcatagaattaaagagagttagggccttgctctgggttaagctttggcttaagggaatgttattgctggtttgaccctctatccagacaccaaaactttctctatattagccgtatggctattttgctttcttaccatttgtgtgttcactggaatagcattttatatttcttggaagaacttttcctttgcattcacaacttggctacttggtgcaagaggcctagcttttagcctgtgttggctttcaccatgctttccttactaagcttaatcatttctacattgcgagttaaagtaagatatgtgtgactctttcatttttgaatacttagaagctattgtatggttattagtaggtctaattgcaatattgtatctcagggaatagactggagcagtcagaacacacatggtattcattaagtgtgctatcttatatgagtattgttcctagtgcccccaaaacaattagaatagtaacatcaaagatcattaatcacaaatcacagtaacagatacaataaaaatgaaaaagtttgaaatatggtaattactaaaatgtgacatagagacaagaatgagctcatgctgtttaaaaatggcaccaataaatttactgggttcagggttgtcacaaaacttcaatttgtaaaaaacacaactgtgaagcacaataaagtaaagcacgataaaaagtatgcctgtgtatacatattatatgcagacacatgtatttttttgtctgtatatctgtcattgttatgcacgacttcacattattctgattttaatgatacccgtttgtacttcccttctgtacagagaaacctggctcctgttatttatttagatttttaaatcttttttttttttttttttttttttttttttttttttttttttactttggagatggaatctt

SEQ ID NO: 28734 - DNA, 1020 bp, Homo sapiens
atttcttttgggtcacgctaggagatggtatgctgggtcgtatggcaagttttatgttttaactttttgaggaccctccagactccttcagattggctctaccattttatattcccaccagaaatatgagagttccagtttctctacatcctcaccaatgattgttattattccattttatttatgctatcttaatgggcgtgaagtggtatctcttggtttcagtttgcatttccctaatgaccagtaatgttgaacatgtttgatgcttcttcagatcttttgcttatttttcactttttttggggggtctttttattgttgtaagaattctttatatgttctggatacagtcctttatgacttgtagatatattacttgtagaatttttctcccattctgtgggttgtcttttcacttctttggtggtgtcttttgaggatgaaagttttaaatattgatgacattcattttattttttccttagtagcttcttttactgttgtgtctaagtctttgtttaatatctttgattgatttttaataatcatatgtaagctatttgtcttcattttgatttgtttgagggagaaaccaacttttttggtaaagagtatttaataggccgggcacggtggctcatgcctgtaatcccaggactttgcgaggccaaggtgggcagatgactcctgaggtcaggacttcaagaccagcttggccaacatggtgaaaccctgtctctactaaaaagacaaaatttagtttgacgtggtggtaggtgcatgtgatcccagctatttgggaggctgaggcaggagaatagcttgaacccgggaggtggatgttgcagtgagccgagactgcgccacggcactccagcctgagcatcagagcgagactcttgtttcaaaaaaaaaaaaaaaccaaaaaaaaaagtatttaatactacagtgttaaaatttcctgactgagtaatgttttgaggaatgaagtattagatatgactgaaaagttcattt

SEQ ID NO: 28735 - DNA, 1321 bp, Homo sapiens
taaggtgacatccttttcagattattgttattttccctcattcgtggtaaaccagttaacttacagcatagtttggaaaatgcccatctaatgtgcattttctcatgttttctaaggaccttaaaagtaaaactactaagcttgagttaaaactgtatggcaaaaatgctaccttctttttaagcctttttttctttttgctttaaatccttctggaaacttgacggaatgcccattttgttgatattgtccttatttaggtgttgattttcattcgcatgtttttctgtgtttcagtcggattcagtggttttggtatcacagtctagacaaaggacatgtaggcgtaaatatccaaattatggtagaagaaatcgtagctggcgtgagttatcttctggaaatgagtcttcaagctctgtaagacatgtgagtggaaaactttaaaatgttataagataatcttaaatgaatttggcttaattctttactttgaatgaatataccccaaatttatatgaaaacacagcattctgcagagattaatatgaaatttcacattttgaatgttaacaaaaacttttaatggctaagatagtcacatactgtatacttgtgcaatccagtggttttacatgttgagcatcccaactcagaattttgaaatgcaccaaaatctgaaactttctgtatataaacatgatgttctagtgtgcatttcagattttggatttttggatttggcatgctcaacctgtaagtgcaaatgcaaattttccaaaatctggaaaaatacgaaatctgaaacaattctattccccagcgttctggataaggggtatataacctgtagtatattgacagagttgggccatcgtcacctctattaaattttaatacatttcatcatccctaaaagaaaccctattcccatttacagtcacttgccagtccctccctctcccccagcccctcacaatcactgatacattttctttttctgcatttgcctgttctggacattttatatgaatgggccctttttttttttttgagacggagtctcgttgtcttgcctggctgcagtgcagtggcgcgatctcggctcactgcaacctctgcctcccgggttcaagcgattcttctgcctcagcctcccgagtagctggggctacaggtgagtggtggcccagctaatttttgtatttttagtagagaaggggttttcaccatgttggctaggatggtctggatctcttgaccttgtgatccacctgcctcggcctcccagagtgctgggattacaggcgtgagccaccac

SEQ ID NO: 28736 - DNA, 1067 bp, Homo sapiens
caagatcacgccactgcactccagcctgggcaacaaaagtgagactccgtctcagaaaaactctgtacttgaagtaagaattatgggtagtagctatgttaaaaacatatctaagagagtaatttgagattagtcggagaggcttgtgtaattaccaccatcaattgcactgttctccgaggactcttggggcagagggagagctaaagtcttgttgaaggcttaaaaaaggtcttacctcccttttttcccctttcttaagacatagagaagaaattaaatctcagggatttttctccacattggaaatgacccatagttgctctgttccagttagagactctggggaataagattttagtgaaatatatcgagtatggtgaggggcattagtgtgaaacagcgtaataaagttttacagaaatatgtttccatgcttccacttgcaggaatttcagaggctgctttcaggtttttgtggtatttagtcctctacaggaagacttttgttggctttgaatcttttctctgacttcttggtgaatatgtagagtatctttttaaactggttatttttcaaaaatgggaaattctgaccattgttaatgtattttaatttgtaccctaacgaaatttttttttgttttctgcttttatatgattatatattaaataattgaatttgtaggtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggtaataaatagtgataaatgttttacctgaatatggctgcattgaaattaaagagtaaacgaagtctttgtcaggtacatgtaatgtgagaaacttaagtaaacaatgtatttttacaacttaattagtagtctgaaggtagctttatgaggtgtgagataatgtagtaacaaatgggtctttgaatttcaag

SEQ ID NO: 28737 - DNA, 1025 bp, Homo sapiens
atcaattttatttttttggaatagtgattgatgtatatgcttaatgaaacatttgtttttatttttattttacagagtctcactctgtcacccaggcttgagtgcagtggagtacagtggtgcagtcttggctcactgcaacccctgcctccccggttcaaacgattctcgtgtctcagcttcctgagtagctgggactacagacgcacactgccacgcccggctaattttttgtatttttagtagagacagggtttcaccatgttgcccagggtggtcttgaactcctgtgctcaggcagtccacctgcttccacctcataaagtgctaggattacaggtatgagccaccatgcctggctgaaactttttttttttttttcagaagggatatattgtcacaggttatccacattaaaaaagtttacatagcaaatcacttgcatagaattggtcctaacttttttccttttgtgtttcctagattgaaggacaaggacatggagctgtgtttgactgtaagttttcacaggatggacagcattttgcctgtacagattctcatgggcaccttctgatatttggttttggatgcagcaaaccatatgaaaaggtcatttttaatactttgttgtagcatgcaagtaatagttatcagctgtgttttggaaataagtagttatgagctatgttttggaaacagtttagctgagtgatttgatttccttgtttttctagttttaattaactgtttaatatttgtttcctttaaaatgtgtgaaccttaaaatgtcatcctgtgaacttcatttttctagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagc

SEQ ID NO: 28738 - DNA, 1092 bp, Homo sapiens
agcatacaggaagagatttcattttaacagttcaggacagctaactacctttgacgaatacattcttttttttttttttttttttttgttgactgggctcaagtgatgctcccccctcaccctcctgagtagctgggagtagctgggactacaggtgtgtgtcaccacacctggctaagtttttttgtgtgtgttttttgagtagagatggggttttgccatgttgcctgaactggtcacactcctaggctcgagcagtcctcctgccttggcctcccaaagtgctgggattatgtgtgtgagccaccacacctagcctacattctttttaaattttttgtttttagttgacctataatacttgtagaaagacaaagaatacagtgtgatgtttcagtgcatatatgcattgtataaggatcaaatgagggtaattatatccatcactaagcatttatcatttatttgttgtggtaatattcaaaatcttctcttctagctgtcttgaaatgtctatcacattgttatttgctgtactcaccttactgtgtaatggaacaccagaacttattcttcctgtctgattgtaacttaatacccattgaaacaacttctcatggtcccccccttcccccatactccccagccataggtaaccactgttctattctctgcttctgtgaaatcaacttttaaaattcaagggtgaaattacacagtgtttgcctttctgtgccttgctatttcacttaacataatggcctttaggttcatccatattaccacaaacgacggaagaatattctgtttataatgttccattttgtgtgtgtgtatacacggacacacggcattttctttgttcattcatctgtagatgggtgtttaggttgattcatgtcttgactattgtgaatggcactgcagtaaacatgggagtgcaattatctcttcaatatactgatttcatttccctttggatatacacccaaaagcatagggaacaaaagcaaaaacagacaaatgggattacatcaaactacaaagcttctgcacagcaaaggaaacaaacaatatagatcgaagagacaa

SEQ ID NO: 28739 - DNA, 1039 bp, Homo sapiens
cagacctatctagctaagctgctgttgaattcttggaccatagagactatgagataatgaatatttattgttgtccagtgcagctaaaaattttggggtaagttgtttcatagcagtatataattctcttctgaagttgtgctgaaggggaaatttacacccaattcatgtattagaaagaagctgaaattcagtgatcacaagtgtatttctcaagaagttaggagaagaacaaacaagaagaaagaaattatgaagataagtacagaaattaaggatagaaaaaatgtgcataacggtagtgaggatcaacaaagccagaagttctttgaaagactaaaaatactggtaaaaaacacattgttcagggaacaaaaaagaaacgtgacaaataaccattatcagatttgaaaaaggggtatcactacatatccttcagataataaaaagaggatattttaagcagctttataaaggaaaattgaaggttaatacagagaaaaacaagacacaaaaagaaaatctgaattgacttgtaactatgaaatgcattgtatctgtagttaaacattttctctacctacttattatttaggtaaaaaatgtttggcgctaatctcccaaggaagcaatcagacaaatccaaattgagaaacagtctgtgaaacaaatctcttattcctcaaaagtttggtttcaagaaagatagaaaggtggagagcttttcaataaggaacctcaggaaaagggacaaacgttagtgtaatgtgtgagccttgatttgggttctagatttaggagagaaaaaagctgtaaaggatgcttgagaaatttggaaaatttgaatatggattatataataatgttttatcaatagtaagttttcgaagtattgataatcatagttatgtaggagaatgtcattgttaggagatacacactaaggattttagggttgaagtgatgatgtcagcaaggtagatttggatggttcatgtcagtgtgatatctacatcaggaagcaagtgttgcaaactat

SEQ ID NO: 28740 - DNA, 1065 bp, Homo sapiens
gctgttcttgaattcctaggatcaagcagtccttcttcctccacctcccaaagtgctggaattataagcctgagccaccgtgccttgctgagatagtgttttattttggaagtttaagcaagatttttggtttgtgtacttacttttagttaagtatattgttctctggaagattttatagtttgaaaattaattcaaattcttgctaggtttcacagttaacattttatagtttgatatgaatgtgttgacaatatagcagcaaataagaaaatttatactttgagagagtgcctgttttaaaatcatcttggaattctttgaaagtggagttctagtcttccctgaaatgattcttcttgtaacgggggctcacatgcgtttatcacctactgaatatatctgaacaatctaattgggtagtagtacattttttttttttttttttgagacggagtcttgctctgttgcccaggctggagtgcagtggcgcaatctcagctcactgcaatctctgcctcatgggttcaagtggttcttctgcgcctcagcctcccgagtagctggggctacaggcacgtgccaccacgcccggctaattttttgtatttttagtagagatggggtttcactgtgttagccaggattgtctcgatctcctgacctcgtgatccacctgccttggcctcccaaagtgctgggattacaggtgtgagccacctcgcccaacctcagtgggtgattttaacagcatctgaacacaactgatgaaactgaagagagaattagtgaagtggaattgaggccagaagaaaatagatagaatggagtacaatgagtaatcattgcagccctagggaaaaattagaggactaataagaagactgattgctagcttctttttttttttttttgagatggagtctcactctgtcacccaggctggagtgcagtggcgcgatctcggctcactgcaagctctggctcccgggttcacgccattctcctgcctcagcctcccaagtagctgggactacaggcggctgccaccacgtccggctaatt

SEQ ID NO: 28741 - DNA, 1048 bp, Homo sapiens
taaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaactgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcgtattctctgtttgttttgtactggtaccccaggaggatgccttgtaactgctctttggtcatgatagtggtaatgaatccattcatgtaaaatgcaatatgtctgttagtttggggca

SEQ ID NO: 28742 - DNA, 1031 bp, Homo sapiens
gccgtcctgctctaggctttccatgtcagaagagatcattctccaccctgttgtcctatctctagccttaggagggccactacagtgcatttcttccagggctgccctggctttagtgtttgggccctatgcagttggtgaaggcctatgggaaaaaattgtggtaggtgtgcagactcactgtaactgaggcgccttaggattctaatcagtcatgccggccacaagtagccattaagtttgttagaggtttgagtggttttttcttattcttttctgaggtcagttcttcctgcctctctgctaggggtgtaagcagctatgagtcccttttctttaactttattttttttagatggagtttcactcttgtcgcccaggctgtggagtgctatagcatgatcttggttcactgcaacctccgcctcccaggttcaagtgatttcatacctcagcctcctaagtagctgggattacaggcgcctaccaccacacccagctaatttttgtgtttttttttttttagtagagatgggatgtcaccatttccgccaggctggtctcgagctcttgacctctagtgatccacctgcctcggcctcccaaagtgttgggattacaagcgtgagccaccgtgcccagcctgagtcccttttctgttcccagaaaagcttgtactttgtgggattagttaatgtagatttttctttgtttcttcagctgtgatgggtttatacattttttaaagtttatccagcctattctcattgtcgagatgagagcaatatcttttatctcttacgttggagtaaataaatgattatttttcatttaaaattataacagacatatatttgtctatagtaatccataggtatatccacttatggctcctggcacctaataggctgtcagtacttactgaaagaattaatgttttttactgcctagtatgttgttgagaaccagttatccatgatttagatactaaatgatgtcttataggatctttgatatcttaacatctctct

SEQ ID NO: 28743 - DNA, 1050 bp, Homo sapiens
cacacctggctaagttttttttttttcccctagagaaaaagactcgctatgttgtccaggctggtctcaaatgctcctcccaaagttggaattacaggtgtgagccaccacaccttccctgatttttgttttgtttttttttgagatggagtctcactctgtcgccaggctggagtgcagtggtgtgatctcggctcactgcaacctctgcctcccgggttcaagcgatttgcctgcttcagcctcccaagtagctgggactacaggcgcacaccactatgcccagctaattttcgtagttttagtagagacggctgttcaccatgtgggccaggatggtctccatctcttgaccttgtgacctgcccgcctcggcctcccaaagtgctgggattataggtgtgactcaccgcatcctgccccttccctgattatcttaaatctctttttatcttgaatagtcttgtttctatgccattgatttactggagaccaaatcatttatcctgtagaatgttttacattctgtatttgtcttattgttccttatgatggtaacttgttcctttttcttagtggttttcatcttcagatgagaatcatctggggagctttataaaatctggttgcccagagtatgccccaaaccagttaaatcagaatctttgtggtgggactggacatcagtattttaaaaagctttttagatgattctagtattagtgtttgtaaagccacaatttatcttaaacttgtgaccatgctgttattccaacctgtatttgggggcaagagtatttttggtacttttgcttttttttttttttttttttgagacaaggtgtcattctgttgcccaggctggagtgcagtggtataatcttggctgactgcaacctctgcctcacaggttcatgcagttctcctgcctcagcctcctgagtagctgggattacagacatgtaccactatgcctggctactttttgtgtttttagtagagacggggtttcaccatgttggcccggctagtctcgaactcctgaccttc

SEQ ID NO: 28744 - DNA, 1050 bp, Homo sapiens
ttgactctgggagtttgaggctgcattgaactatcctcctgccactgcattccagcctgggagatggagcaaggcctagtttcttttttttaaaaaaaaaatttatataaattttttggcttttgttggtagaattgcttaaaaccctacttactattgtttaaaatcacttaaattctgtgataatatggctgtgatttggctatgacatatggcatctatcattgcctccctgatttggtctgtctggtgggtgtcctttctttttttaccttcctctctgccctccagtcccccaggactgagtgatgatgagcctcatgtgtagagaattattcttttgttaatggtatatgtatcgtttctaaactttcaaagtcttttaaaaataccttattaagaagtattccaggccagctgcggtgctaacacctgtaatcccagcactttggcaggacgcttgaggccaggagttctagacctgcctaaagtgaggttgaggatgtagtgagccctgatcaagccactgtgctccagcctaggtgagcgagaccctgtctcgaaacgcaacaacaaaaaagaagtatttcagatgtacacaaatgagaataatgtaatgcaccgctgtatatcatcaaatttgaataataataatttttttttttgagacagtctgttttgaggagcagcctcggctcactgcaacctctgcctcctgggttcaagtgatcctcctgcctcagcctcctcagtagctgggattacaggcacctggctaatttttgtatttttagtagagatggggtttcaccctgttggccaggctggtctcgaactcctgacttcaggtgatctgcctgcctctgtgtcccaaagtgctgggattacaggcacctggctaatttttatatttttagtggagaaggggtttcaccatgttggccaggctggtcttgaactcctaacttcaggtgatctgcccgcctctgtgtcccaaagtgctgggattacaggcgtgagccactgcgcctggccaacaaatttgaattt

SEQ ID NO: 28745 - DNA, 1163 bp, Homo sapiens
gattggcctcgctgctcttgccccgcccgggtctgtccccccacttgttccctaggaatagaatcattggtctctgaaggtggagaaatgttcttgtgttgagctttttattttttgttttgtcagcagcgtcataaaaatcttgcagctgtatgaatatgccactgtagtgcttgtgctcctttctactgtacaatatttgttgaacgcagtagttgattgatgagtttcacactgatcttgtagataacacaataaagtgctttaaataggcacttttcttttgagctcggttaatcttgcattacagtctcatttcttttgtgaacttggttaatgtttctatataacttgcttttatctatagttacagcagttgcagggattcgtttgtttttactggagacatttttcaggaatatatttttgccgtttcgttattaggataaaggaattcattaattgccaggccatattcagcatcttgtataaggaaaacaattgagaaagaaaagagcttctgagtgatcttttaccacagttggaagacctgtaacacttgagtggtagagtatggtggcaagtgaaaagaagaaaaaaaagtggtagaagattactggttttgaattagacaacagaagagaccagaggatgtgttatttccatgaacagttaacacttgaagcctggtgcaagtaataaataattttaatatttgctttcttagattttgaagtaaacactttaacagtggatgttttcaagggaatgagttctaaaaattctgatggcaatgtgttgagtttgacattttgagatagtttatttttgtaaacgttgaggaaacatttaaaggatgccctcttttagttttcttcacggataatatagccttatcggtgaagcggaaaagcattactggttatgacgctgttgtcgtgctacctgagagaaaataacttgaaacaaatgtagtgctgtaactactggaaaagttacttttaaaatacatttataggggctgggtgcagtggctcatggctgcaatctcagcacattaggaggccgaggtgggaggatcacttgaggccaggagttcagaccaactcttgtctccacaaagaataagtaacagaaaattaggcggctgtggtggtgcgtgc

SEQ ID NO: 28746 - DNA, 1035 bp, Homo sapiens
gaggcttgacatgcaagtactattaaaatctccttagcatacattgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggaggtcagaagtgtgtgtgtgtgtgtgtgtgtgtgtgtgattgctttgactctgaacagtagatactaaattgtacattttttgtagcagataacagtattcattataatattgaacaaagttttgtacggtatcccaaagtgattggacaaatggttttctatgatttatgttattggaaagtaaatatgtaaatggcttatttaagagcaagaaattttaatatgctcaatttcagatataattcaatctttgttttgtttttatattctggatgttgcttttaaatatatttttgaaaatttattccccttacttgcatttttcctggcatttttttcccactttcatttctaatgaaaatgtttttgtttgtatttttcttaaaggtctaaataataacatagatcaagtaaataaaaagactagtgtcattaatctttattcttagagacagtgtctgttagccaggctgaatctttattgttttaagctgtgaggaaaagatgtctttttttttttattaatgaagcagtgggagtagagaaggaacaaagaagtctgtaa

SEQ ID NO: 28747 - DNA, 2452 bp, Homo sapiens
aatgcggggcttccattttgattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccgtgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtatt

SEQ ID NO: 28748 - DNA, 1035 bp, Homo sapiens
aaagtaacgtctcaggctcaacactgcactgcagtgggtgtccttgtaggggcttctttatttgccttgagaattggccacagcacttacctccagcttcttgcctataaatacttctcaaccaagtaggtgtttttttctcccaaatcatgatccatgttgaccttgcaaggagacaaagtcctgctttaaatactttcaggtgtggttggacctagacatctctcactatctttgaaccagttggtcaccttgctccatttaggtgtatctgaggtgccgcgtctctctacagtctcacaaccaccaaccttcagcatgttatgtatttatctgcctgtcattcccacctgactttgagcttctcaagggcaaggattggctcttatccatcctgtctcctctgcacgtagcacagtgcttgctacatatctgatactcaactaataatgtacattaagaaatgagatgaatatatttttgaaaaatgtgcttgcatatctacagttagttgagtctctacagtaggaatgatgctgataatttattttttaacttcgacaaacactgtgactcttacatcctgattggtaaaggctgaatgaaagttaaggaaactaaggcttattgagatacaatgtggcaggcatttgccaggatctgaacacacgccatcacatttaaaccacaccctaactctgtttgcatttttgtctgacattatggttgaggatataagtctagggaaattatttgctcaagttattatatgttataataaggagaaaatgaacattttgtttttagtgcttattcacatgaagcactgttctaagactttaaatatgtattatcttatttaattctcccctacacctttaagatagagagtgtcattgtatccattttaagaatgaggatacttagacacagggaatgtaagtaaatatgcagatcagatagggagcaggtggccagccagcatgaaaacctagtgacttggtatcaaaggttacagtcttaactgtgaccacc

SEQ ID NO: 28749 - DNA, 1074 bp, Homo sapiens
gcaatctcggctcactgcaacctccacctcccagtttcatgcaattctcttgcctcagcctcccaagtagctgggactacaggcacacaccacccaccacacctggctaatttttgtatttttaatagagacggtgcggggggggagtttcactatgttgaccaggctggtctcgaactcctggcctcgtgatccacccacctcagcctcccaaactgctgggattacaggcatgagccactgtgccaggcctctttgttcatgttagtgtatggagacttttttatttgttcaggctagtctgttcgccttttcttcctttgaagaaattatctgttctccttataagttttacagtgttcaaactttggatcatgtctttttctctctttgatctctttctaaatatccctttatttaaaactgtgcatggattttctcctaaaatcatgtggtgaggaaaatgaacttttacatttcttcaggaaagtaaacctggtcaaagactacagttgggagaaattttagacactcacgtatgtgactagactgtggatgtgaatggtgtctcgttaagcttgtctcaggctttcatatggcaaagtagtatttttaagttctttttaggtcctgcctttacctcaggatgcattttcttataatctgattacaatattttttaatggagactattttctcttgtacaagttatatgacaaaagtacatttggcttgtcttctgtttgtttgagttgattgtgttctgattaggaatgctaagtcacctatgcaaaagcaactgagaactaacttaaaaacatgaattattggggaaatgtttgtacacccatgttcatagcagcattttttgcaatcgccaaaagataggaacagcccaaatatccatcacccaatgaatgagtaatgcaaatgtggtacataacattccctggaggatttgtcagtcttgaaaagaaagagaactctgacatatgccacaacaatcttgagggtattacgctaagtgaaataagcgtgtcacaaaaagacaaatactatatgattccacttata

SEQ ID NO: 28750 - DNA, 1051 bp, Homo sapiens
acagcatgttttattctggtgttgatttgcttggatgttccacagacagtccaagctttttgtaggtcagagaaacatccttaacctggggcaaactttgacacccagcagatgccttcaatcctctttatctatcatagtgtctgtttttctgtggtctcttttactacttcaggtttgctattaatgattatttgaactcatttcctcagtatacaattgggggaggagtggagaagattaatgtcatagtgtcattttttccctgtattttgtgggtctgacctcgaattctgatccttatactctcttaagtttatacatggatagaatgttgtatcagaatgtacttataatggttgcctttactaagagtatattaattatgggttgagcttataattaattgacttcatgattgtaaaagtgaagggcctggtattacaccgaactgcttcttagcacaaagtaggaactcaatatatatgagtggaatggatgaataaaagtgagtataaataaaccatgactgctaagatgaaccactgttcaattgtaaacaatgcaagataacccaatcgttttgacattatgagggacgtgcatcttttcttgagaaatggggtgagacattaagtcaggggcctgatatgaggaagtggtagattcatttgtaccagctgtttagtgacaatgagaagagattacagaagtccagtgtgtctagactaggccacatgtgatttttatcttaaatctgatagtggcatgccagttaggacacatcattcggcaagatgtaattgatatctcaggtctgggaaaaaaccttaaattgttttgtgctcttctgagtggctagtatgcaagcccgcacatttaagattgacatcacttttgagggtgtttctgcccctgagtagggacctgccacatggtggcaaatgtgtttctgtgaaatactttcccagcctgtatttcatggactagtcctaggtggtctttgcaaaatagaaaaaagctgtgtccatgttcaatgattcaatgtatt

SEQ ID NO: 28751 - DNA, 1059 bp, Homo sapiens
ggaaagaaatttgaactatttaattactgattttgattcatacaagccttgactcttttagtattaaaatgaagaaacaggaaacagttttaagtctggttttacataaaatttacacttttttcacactgaaaataaaacagtaaaagccagcttatagttctttctaaatatcccaactttctcattattggatgcttctgcaaaacagcagtatggtgataccactcccagtgttgaccttgatgacctgagggtcccaaagtggcttcagcattatcatggagtcaccacaatgatcaggtagaagctggtgttaggaccagcgtgaatgggtcacaggggctgaggggggctgttgggaggtagcccatgccgtatactgaagagccatccatgccacttcaggtgggtgattgcagtggactctcttaccattgattaatcttcctaatattgagtaaagcattgattcttctcataagcatgaactgctggatgatgggaacatttctgtgattgtatcataagagaaagacaagtagaaagataattagaactgctgcaattctatgtatattttaatttaatttatttttttaaatacaaaagacagctatatttcctatataataaggaaacttattactttaaggaaatatactttctcacgagagaaactcaagattcaattcttttcacagttagccccgctgtggtgtgatttgatcttgggttccatagagatacagaaaatccaagtcccagtctgcttaattgccatgtttattttttaatctcggctgtagagcatttttaataactgatatgtagcttgcagggtagaaataacaatgctttggaatattacctgtgagactttaggaatgagctgaagacacccaacaatgacaacaatggcctctaccagcaaaacgggaaccatgactactttatcactcctgccggatctagttcttgtcagttcctgcaaaggctagtcacttgtctatttcgttggctagtgaaaaggaaatgcacaagaaatgtggaatgctg

SEQ ID NO: 28752 - DNA, 1085 bp, Homo sapiens
gttatattgctttcaacactacaaatttaaagcagttataggagcccagaggtttccaaatggcttccttaaaaattagaagatgattttaaattccaagaggaaaaacaaaactagcattattgtatacttaccctcacaaccgtcctaggagctggtacaattttaagagaggttaagtaacttgcccaaggtcacactgtggggatgtgagccgcgtaccttggctcagtgtctggtctttgccactgtccctatatggatttacttaccttattggagttgtaactagcagacccttctatgtctcagaagacaggagagggaacatcggaagaaatgactgatttctaagcatgtgagaggcaggtgactccgcactatcgtgaccagaatttcccctgttctttttgcagtgatgcctgttcttcaaaagcagtggtttctttacgctgtataggtaagttcatctggagtcccccttttgatacttctaactaggaaaagctctctactttcagaacagtactccctgtgtctctgggggcgtgggagggaagaaggtggggtcacgggttggaatgtgcccagcggcgtctcgctctttccaaggagctcctggtttagatttccatggcctgtagacaccttcagccttgggtccaagggacaccccctgagatcaggcacgctcaagaagctgacaaagccctacactttatgccacccatgagctggaggcccggcaggtctctttctccagaaagcaaaggggggtggcgttagtgagccctggcagccacctaacgtggacttggagcatctgcggggctgtggtccagcaccaccgtgtggccaccaggtgctcatcagccagtgggacccgggaggagggacaagaccagagaacaacagtgctcttgcctcttctctcctgaattttggacggtggcttagacttgggtgtccccatctctgtgtttagagtgcttacagtttccaaactgtttgcaaatgtggaagccaccgtccctctcctctgggatggcccagtgctgtcgtggggccgtggtcctgagctcagc

SEQ ID NO: 28753 - DNA, 1032 bp, Homo sapiens
gcctggaactgctttctcagggaggctgctgtcgaaggcacgctgggtgctggccaggaagtgacaggacatctctgtgtggtgcccctgggacatcttagggccctgtgtaccctgacaggccgcaggaaagattgcttttgtgtggcgtccttcttaatcaggcatgttagtcaccatcaagaagcccaaaaacaaaccgaaaaatacctttacgtgacatacttattttttctgtgaaatagctactggtgtgcgtagagtgcagcagggagtgtgtgtcggggttctgagagtcagcgcctttgttcctgaagacgaagtgtggaagctttgcatggactgaccactgggcttctgggcagtcctcagtagacagttattcaatgcaggaaaactgtaatccagaatcctgcaattagatcctaagttgccattccagtgctgccattcgcctctgagatgggctccctcagtgctcagggctcgattcaaactggaaatatcacagcaactgtctacttcatgaagcagttaaatgtaaatagtatacaaagtaatagtatcaaattaatgcttgatattattcaacattacatatactaaataccaatattaagatactagttggaatcaatttcaacttaaaaatgaaataacttggtttaaaatctcaggctgcatttatatgtccagttagcccaaaacagacgcttttcaaagggtcacacgcgggtcacgttctgctgtgtctttcttttagaggcagcaaaaccccggcaggctgctttcttagtcttgacagctggaccttgaagttgaagggccatgtgcttgggggcagctgtgagccctcagctcttggagatgcagagtcgggtgctgatgagagtgtttgtaactcttgaagcatttgctggtcagagtggatgccacagtagctcgctgttgaggacacggggtgaggggcagcttgggtgggaagatgaggaaaggcggaggggaaatgcagccggccaggagtccgagaca

SEQ ID NO: 28754 - DNA, 1045 bp, Homo sapiens
tgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctg

SEQ ID NO: 28755 - DNA, 1043 bp, Homo sapiens
tgactgaaaccttgtcacatggcgcatgactgcttagctctgccctgggggctacgtgcagtgagtgacccatcctcctaatcctatgaggctggggtactagccctgtctttggacggaggaaacagcacagagaggttaaggaactgaccccaggtcacagtggagtagatgaagaaatcaggattggtccatggcacccggctccagtgttgctgctcaccgtgcaatggcctcctcccagatttgggggcagtgtgtgtgtgcgcgcgtgtgcatacctgtgtgtgtgtgcatgcgtgttcaaagaaagccctagtgaaggttatgtgcgtgatctgcccaaatctagcattcctgctgaaaaagcgggtcacagtgcctgtcctgctaagccggggtcagggcatcactttgcccatcaagcggggctgctgaattttaaatctttctcatccatgttatgggtctttttgacatagatcctcctcataaaacctgaagaaactctatgaaattcctggtatttgatgtcttttgacctgcaaaacagcaatttcatattgccgaagctgacactacccaggggagcaaatgttatttaatgttgccatgaagattctttgctcaagggggcgaaatagatattgactctcctgacccccctcccaaatgacctgattctcatacgagcattgtttccttgttttataaatgcagtgtaatccaaaatattagtagctcggtagcttaagattcttaacttattggaaggttctggtctgtcctgtttgtcagtatgattgaggctttgtaaaatgcccctggttgtccctaatcccaggtccacaatgggctgtgtgggagtgtcccggcgctgcgctgcccccataaaacaccagcaacccagtgccttcacgtcagaaatgtgcctcccgcagtgctggaggccacacgcccacggtcagggtgtcagcagggctggtcccttctgggcaccctgagggagaatctgtcccgggactctccccaacctctggtgg

SEQ ID NO: 28756 - DNA, 1059 bp, Homo sapiens
tttctgcctcttacttctcttcatctcatgctcattccctttaacttaagaggatcgctatgccaaccagaattaattgcctgcacagtaagttatttttgtcttatttttctcaattacacgtagacgtcctaggagtgcagcctgtagctcagcagccagccgacctgcctgcctcgtgttccctcccaactccgcctttaccctcctaggttgctagttccgcgtgttcctcctgacagtgctgtggctgaggttgtacagggcctatcaggtgagggcgctcgctctggtacctgatgtggccaggcgacctcgctgtgacacccacaggaagaagctggttccttttgtcgtcctccagagctaaaaagtagtcgcttctatcaacggaccatctgtggttccagttgaaatccgatgctgttcttgggaagccaaagacaattgttttttttttctggtcattgtttttctttctgctgggttttaagacagaaccttcaattcgctatttatgtctgttagactctgtagagacaaataggaatacatttggaaatatttatgacattagagctataatttagattaattatgtttaaattctttcacgtatttgtttatacttcagccttcttgtgatttgttttttaaaccttgttagaaccagggaaagacttttcttcttctccctgtctcccatttaaaatcttggttacttgcctccaatttcacataaccactccccaaattatcttcaggaatcttgaaggttgtgggtgaggtctaaatctcgcttcttgctgttggcgtagagaaggtagcctggagtcaagtagtcaggcttcatgcaatcaacatggccccggctattgttgaccgtagtgtgaacttcactatcagcaaagggcaacacattctgcgggctcaaagtcaagcagatgatctgcttgatccagaccatcagttactggatcagtcacagtcctccagagaagcagaacccataggttacatatttaaggaactgactcatgagattgacaggtctgaaat

SEQ ID NO: 28757 - DNA, 1070 bp, Homo sapiens
acaagaaagcaacaattagaggtaaagtcactaaaacactaaaatgaacgtgggcctgtatgtgtgtgtgtgtacacatcagtagtttcaatatttgttaggtttttaaagatacaaatattttcttagattgtaaaactctccccataaacataccaaaattgggaagcccttgcccagcctatccagcaataaaatcaagccatttggttacctcctaaagtgagaaagttgttatttctcccagttaactagttttatatcctagttgttagcaagaatcctgaggcgacttccttgattttggagtcccgagaaaactgggatgcccgtgagataagagtcctgagagagaagcctaacgcaggtcggggacctgcacagcatgggggtgctgtttacctggagagaagtcaacttctgatcccattcctgggtccccactccttctggcctcactcaaatttcgttccagcccagcctgatggaatccatgaaatttcgaactttacaaaaacaatgcaaagaacagccacataacctttactcaaactcacgtatccttaacatttgcccagtttcctctactatttgtgctcatgcttggtctctctctccctccccttactcattttcttttacacacacacacacacacaacttgagggtaaattgtatgcatcttggccctttatcctcaattctttagtgtgtattttcccaggaatggagatactctctgctgtgtccacggtacagttgtcagctccctgaatttacattgctgcaattccttagcttatgcccatcttccagtttttgtcactggacgaccccgtgatgtccttcagagcagtgacctttccactccggcacagggccggacattgcctgcctgtcttattgctttagcatcctctgtcctgcagcgtttccacagcctttctttgtcttttatggcatcgacatttttcaaacattctgaaacgtgagcacttccccgtgggctggatgcacgggaggagcgtgttccggctgctgggcgtgtgggcctttccgtcctcacggaa

SEQ ID NO: 28758 - DNA, 1029 bp, Homo sapiens
gaaatgaggtttaattggctgatggttctgctgtccaggaagtatagcaggttctgcttctgcggaggcctcaggaaacttacaatcctggtggaaggtgaaggtcatcttctatgacccagagcaggagggggagaaagaggcgggaggtgctacacacttttaaacaaccagatctcatgagaactcactcactgtacagcaccaaggggagatggtgctaggccattcatgagaactccccgcaccgtgatccagtcacctcccaccgggcccatctggtaacactggagattaaaattcgacatgagatttgggcagggacacagatccacatcatgtcacctcctttatctttcctgctgtagttaacaggtagtgtggggagatgctttgagcctgtacagagcccgttgctccttaaactcttcctcactgatttcgcaaccattggtgtatcttgtgtgcagtgatggcgcaggtgcagttctcttgatggtgactttctgtttcctcttccttactgtctttattatttggaactctcccgcaagacagaactgtcatttctcctccaatgagatatttatctgattgtttagctcaatatggactcatggatatggattttattctgtgggttataatcccatactatcactatttattatattgttgtatcagtctgttttcacactgctctaaaggacttccctgagagtgggtaattgataaaggaaagacatttaatgactcacagttccacatggctggggaagcctcaggaaacttacaatcatgatggtagggaaagccgtcaccttcttcataaggcggcaggagagggaagaaggaaggaggaacttccaaacacttagaaaagcatcagatcttgtgagaactcactatatgagaacagtatgggagagactgccccatgatccagttacctccctccctctgcaggtgaggattacaggtccctctcttgacacatggtggttacaaacagagccaaaccgaatcagt

SEQ ID NO: 28759 - DNA, 1050 bp, Homo sapiens
catggtggcagggaagagagaacttgtgcaggggaactcctcgttatgaaaccatcagctctcctgagatttattcactatcacaagaagagcataagaaagacctgcccccatgatccagttacttcccactgggtgcctcccagatgtggggaattgtgagagctacaattcaaaatgagattttgctggggacacagccaaactgtatcattccaccctgggcccctcccaaatctcatgtcttcacatttcaaaaccaatcatgcgttcccaacagtcccccaaagtcttaactaatttcagcattaactcaaaagtccacagaccaaagtctcttctgagacaaagcaaatcccttccgcctatgagcctgcaaagtcaaaaacaagttagttacttcccagatacagtgggggtacaggcattgggtaactacagccgttccaaatgggagaaattggccaaaacagaggcttacaggccccggtgcaagtccagaattcagcaggacagtcaaatctcaaagctccaaaatgatctcccttgactccatgtctcacatccaggtcaagctgatataagaggtgggctcccatggtcttaggcagctctgcccctgtggctttgcagggtatagcccccactcctggctgcttttatgggctggcattgagtgtctgtgagttttgcaggcacgcagtgccagctgtcgacgtatctaccattctggagtctggaagatggtagccctcttctcacatctccactaggcagtgccccagtggggactctatgtgggggcttcaaccccacatttcccttctgcattgccctagcagaagtttctccatggggccctgcccctcatggaggggacacagccctgcagcagacttcttcctggatatacaggtgttctcatacatcctctgaaatctaggcggaggttcccaaacctcagttctttacttctgcacacctgcaggcttaacaccacatggaagccgccaaggcttggagcttgcaccatctgaagccatggcccaa

SEQ ID NO: 28760 - DNA, 1041 bp, Homo sapiens
acattcttgatggatggagcattttatatttttaggtaattgttaaactcaaatatactgactgtcattaaaacacaaaaattcaatatgttaattgtctgtctgcagccagactaggaaagggtacattgttttcaaaacttaataattgaattaaaatgtaaaaaaaacaagggccttaatgtgaaggtgagggatctgcatctcctagctacccctgtctcctatctagacatctagagtctctagatcctggggtactggggagaatggacaatgttgctttcctgtgcaagatcctcagatgacatattttagcccccagggcgctcatgcctccatcttcctccagcctcatgggcatttcctcccctatgtgtacctttacctttcaccaggcaaagccacctgtggttcccttggattcctcctgctctgtcttgtctctgtagtgttgcatgtactgcagcccagccagctgatgtgaatcttgccctgctacttattatctgtctgacattgagcatgttacttaaccctctgtgcctcggttttctcatctgtagaatggagataataatagtacctaactcctagggttgatgtcaatattgagttaatacattaaaagtgttttcttttgtgtgtgtggcagaataagcacccaaattatagctgttattgagtacctagttactgttctactgaaaggaatggaaaataaatactcgtccctcgaaatgtccttcatccttcctatctcttcccagcattccctataaaactttcttcgtagaacgcccttcctggcctccatctcacctggctctgatgcctgtcatctatactgcgtctctacctctgcaaacatcctgtctgctgctcagcatactggactaggctgatgaattgacctgttctcttcctgcacaagaccttaagctccatgaggcagggccatacttgttaaattgatatcttccatgtctagaagggttctagcacacactagacagatgctagccataagtctataattgt

SEQ ID NO: 28761 - DNA, 1075 bp, Homo sapiens
atttgcattgaattaatttatgttaagatatgaggccgggcgcggtggctcatatcttacaggtggctggcctgtaatcccagcactttgggagaccgaggtgggcagatcgcctgaggtcaggagttcgagaccggcctgaccaatatggtgaaaccccatttctactaaaaatacaaaaattagccagtcctggtggctggcgcctgtagtcccagctactcaggaggctgagacaggagaattgcttgaacccaggaggcggaggttgcagtgagccaagatcatgccactgcactccagcctgggtgacagagtgagactcttcaaaaaaaaaaaaaaaagatgtgagatatgagtcccccacccccttagcatttattacctgaggaatttgaagtgatggtatgaaataatcttctggaatccagttctgaagggttttgtagccattccagggaattggaagttgaggccagggcaagcccttggaaggttttaagccccagcaaggccagatgagcatttctgaaaagcgtctatagtagaaatgtaaagaatggaacctttagtattagaggttgactatcccttatctgaaatgcttgggaccagaagtgtttcagatttcagattgtttgggattttgaaatattctcattatacccagtggttcagcgtccctaatccaaaagtccaaaatgctctaatgagcctttcctttgtgcatcatgtcgttgctcagaaagtagttttgggtttttggactagagatattcagcttgtattataattgtcaaaggagtgatgagtcccaagccttccttaggactattcactcatagttaatagtgaatagttcccactattcactcttccaccctcctacaccctggccaaattaattgcttcctggaatcagtattcccgtagcattcttcacatcctttgttaattattgtctgtcctaacatggaaatgtgagctacaggagaacaagaagcaggccagttactcatctccccatcaccagcacctcttgtgatgtgtggtgggtagcaggcccacgcaagca

SEQ ID NO: 28762 - DNA, 1085 bp, Homo sapiens
agcttacattacggtcctcataccttgtttaagaagacaagaaagtgggttaatccattttagaaagatttctcatggaaaattatcttttaaagctttcctcgtgtacttggagtaaatgatgatctctaaggactagtagtcattaagtttaaatttaagcacccctaaatattgatgttaaaaagaaagtcaaaatttgaagtgctggtttacttaaaagtaactttttgtttatttttcctttttaacactttattgaaagtataatgtgcttcattctgttgaaatagaagttgaagaagatataacccctgccctcgaggaacttacactgttgaatattagatgtgtacactctgaaggaaaaattgtaaataacaaaattggggttaagttaagaaggtctctcgatggaaatgagataattaaagggacaattttttcttttcttttctttttttcttttttttttttttttttttttgacagagtttcactcttgttgccccaggctggagtacaatggcgtgatcttggctcactgcaacctccgcctccctggttttgcaacctccgcctccctggttcaagcgattctcctgcctcagcctcctgagtagccgggattacaggcttccgccacatcgcccagctaattttttttttttttttttttttttttgtagagacggggtttcatcctgttgaccaggatggccttgagatctcctgacctcgtgatccaccccacttggtctcccaaagtgctgggattacaggcatgagccactgcgcccagccgaagggacagttttagttgtccgcaaagccaatggaagtagagagagcagattataagctatgtaagagctaggtttgaccaggtcacagtgataggctataagggaaagagaagaaattttagggtctggcaacacaccaaagtaaatcgggaatatgtgaggacaaacagatgtgggagcagggacgagagttgtggagtttaagtaccatgctggacctgaggatatactgtgatggaaccgttcagtaggtacctgagaggctggagcctcaagagt

SEQ ID NO: 28763 - DNA, 1050 bp, Homo sapiens
agcttgcccaaactgaagttccagtcactgggatgggcaatttctctctggctagggctagtctaagtgctccctccatgggtgggcgctggctgagttcagcccagttttgctttctgttgtgacaaagcagcagcactgagttcaatgcaaagtcccacaatcactgcaccttccctcccacaagcacacagatgattgctctgtgccatgcgacagctgccagcgggcagcagagggatggtgtcagcaattaaagagtgcctttcctaccctctgtggtgcctctttcagtaatacgaagttaaaactgtgattgctcacctcatttttttattattattattattatttttttttcttgagatggagtcccacactatcacccaggccagagtgctgtggcttgatcttggctctctgtaacctctactttctgggttcaaatgattctcctgcctcagcctcccaaatagctgggattacaggcgcctgccaccacgtccggctagtttttgtatttttagtagagatggggttttgccatgttggccaggttggtgttgaattcctgatgtcaggtgatccacccacctcagcttcccaaagtgctgggattataggcatgagccaccgtgcccagcctgatttttagttcttatgcaggtgcttttttgtgtagatcattgttaaatttgggaggacaattggtggaggattccatttggccatcttgctccacctcttttcccctgtgttgttttttgacatgtcccatcattctttgagcactgccttgtttctataaaaaaagatttcaggcttattttgtacctttcctgcccaagctctacaatcagccatttctccagggagccctgattttatatattggagaatggtatttagaaaccaagatctgagctctaggtgtattcattactgttgaggtctaaggccttctcagtggacagagcaaggaaacaagcatattaatacacacatttctatgcggatctatttctgtacttatattgaagaccatgagtg

SEQ ID NO: 28764 - DNA, 1059 bp, Homo sapiens
atattaatgtctttgtctaggtttagaaagttctcattattatctctttgaataagcttctacccctatctctttttctacctcctctttaaggcaataactcttagatttgccccttagaggctattttttaggtcttgtcagcatgtttcattatttttattcttttttcatctcccctgactgtgtgttttcaaatagcctatcttcaagctcactgatgttttcttctgtttgatcaattctgctattaagagactctaatatgttcttcattatgtcaattgcatgtatcaatttcagaatttctgcttgactctcttgaattatttcaatctatttgttaaatttatctgatagaattctgaattctgtctctgtgttatcttgaatttctgtgaatttcctcaaaatagctcttttgaattctctgtctgaaagatctcgtatctctgtttctccaggattggtccctgctgccttatttagttcatttgatgaggtcatgttgtcctgaatggttgtgatgcttgtggatgttcattgatgtctgggcattgaagagttaggtatttattttagtctttacagtctgggtttatttgtacccatccttcttggggaggctttctaggtatttgaagggacttaggtgttttgatctaagctgtatctgcactgggcggggtggggggcacctgaagccctgtaacagtgtggttgttgcagactcatagaggtattgccttcgtggtcttggataagatccagaagaattctctggcttaccaggcagagattttgttctcttcctttactttctcccaaacaaatggagtctgtctgtctgtgctgagctgcctggagctgagggtagggtgacacaagcaccctcgtggctaccaccactgggactgtgctgggtcagacctgtaaccagcacaacactgaatctcacccaaggcctgccgtaattactaccttgctactgcctatgtttactcaaggccatagggctctacaatcagcaggtggtgaagccggccaggcttatattct

SEQ ID NO: 28765 - DNA, 1032 bp, Homo sapiens
ggctgagacaggagaattgctggaacccaggaggcagaggttgccatgagccaagatcgcatcaccgcacttcagcctgggcgacagagcgagactctgtctcaaaaaaaaaaaaaaaccaaaaaacacaaagtcaaaccttacaatggactagactgttgtctccttgagagaagacacggctttctttgtccttggctccctgaaccttgtgcggtcccgtccacacaagaggtgcttaatatatgtggaaggaatgaatgaatgtacatcgaatgaatgaatgagcacactttggatgacttgtaggcccatcacatgggtttggctgcagagggtggctgaagccagtctttatgactgcatttgttgtaaccttcctgtactgtggtgaggggttagcattcactcactcattcactcattgtaagaatatcacaaagggtttgttttttttctcaaccaattgagttgtcaccatgataacccaccaccaaatatgttagtgtgaactacctacgaacagggatgttttcctacgtaaccacatctagacatagaaatcgggaaatcagcactgatgtatcatgattatctgatccacaggtcctgttcgagtttcctcaatggccccagcgacgtcctttacagcacaagagtcccttccaggatcccttgttgcatttagtggtcatgtctctgcatttagtgtttgcatttagtggtctgttgcatttagtggtccgagctgttccttggaacagcttttccatctttccttgactttcaggactttgcccttggatgatcacaggccaggtgtcttgtggagcccccgcccctcactgcgggttgggctgacgattcccccacgatgaggctcaggtgatgcctcttgggcaggaagatggtgaaagcgacgcagagctctcactgcatcctgccagggcacacagctttaatgtggcccattggtggtgatgttaaccttgaccatcagattaacatggcatctgcactaaaggaatcaga

SEQ ID NO: 28766 - DNA, 1117 bp, Homo sapiens
agagggaggccaaggaaagcccttggtgttgggttggctccaaggtatctgtgtaaacccatggtttttaccatgtatatatgcaggtagatacaggaataaatgcagaagcctgcctatgcttgggctattaagtatgcatgtcttttctaggtctttaagctcaaagggtctagaaacgatgatatcccagccacagtgagctcaccttgcactcagatcttcgttttctagcactattctccagcgtatgaaactggcaatccttggagaactggtttgttccaggactggggcagacgaaatcctagctaagcctggagtactttgtagacccaggaaatgaggatgtgtttgaaaaagatggggaattgttgaaagaacccaggggccagcctgagggagatcccaggggccaaacctggaatgagtcaatggccatagcattggtttataacagcataaaataaatgtccccaaatccatactgatatcaacagataactggatacggccaggtggctcatgtctgtaatcccagcactttgggaggtcgaggtgggccactgcactccagcctgggcgacaagagcaaaactcctgtcttgaaaaaaaaaattcttagtagaagcaggagacttccagtcatgggcccacttggactcctcagctacgatggctgcattcccagtgtcgcccacacccctgcctccctggccgcctccagcagggctctgggtcaagcgagaagagaggtccacttgtgcgaggaaggtccgtctttctgtctacaggcctgaagatggacctgggagagcacgacctcgccacaacatcaccatcctgatcagaggcgagaggggacaaggtcataggtgtggaggtgggcaggtggtgtggagtggagcctacagaggggatgggggtgtgtcctggagtgcacagggtgaaggacccccgcccctaccccaccaccttgggtgcttaaccagaaaagtggaacagcagaacaccaaagggtatgtgtgcacacatgcacgcacgcacacacacatacacacgcactgctgaaggccaagacaggcatggactggttgaccctaggaggtagggtata

SEQ ID NO: 28767 - DNA, 1925 bp, Homo sapiens
gactgcctcgcaactgggtctgttctgtgagatgtcgccaccctgtttgccatctgggaggatctcactccttcaatttaatctgctctcttccgttatttttttagtttctatgtattttacttttaggacattccttggactttgttctacctctttaattgatgaagaaaatttggtcattgtatctggtttttttttttgagacagagtctcgctctgttgcccaggctggagtgcggtggcacaatctcggctcactgcaacctccacctcactgcaacctccgcctcccgggttcaagcgattctcctacctcagcctcccgagtagctggattacaggctcctgccaccacgcctggctaatttttgtatttttagtagagatggggttttgccatgtttgccaggctggtctccaactcctgacctcaggtgatcctctcgcctcgcactcccaaagtgctgggattataggtgtcagccactgcacccaatctattgtatttaattctaagcactttcttccagacggtctcactctgtcacccaggctgaagtgcagtggtgtgatctcagctcacagcagcctcaacctcccaggctcaagcagtcctcccaccttggcctcccagagtgctgggattacaggcacgagccattatgcccagcccgtctttcttcattttgattacagtgtgcgtactgtacatccgagaagtgcatgtgaaatgctggaactgggatttcagcaactgaatgcacgtgtgtgactacccacgagaagcaggacacttagcacctgctgagaagcccccacgcccatgttcccttctaggcactgcacaggcatgctggccggcctgacctcagtttccctcttgctgtggccgcttctgctccactctctgtgaggctcatccaccttgttgcctgtggttgtggattgttcattctcagtgctctgtatgccaagtactccattgtgtgaaaatcccacagcacgttcattctattatcaatgggcatttgggtagtttccacagtttggctgttaggaatagtgcagtgatgaacatgctggcacctgtcttctgttttttttttatttttagagacagggtcttgctctgttacccaggctggagtgcagtggtgtgaccttggctcgctgggcctcctgggctcaagcgatcctcccacctcagtctcctgagtagctgggactgcaggtgtgtgcctgcgtgctggctaatttttgtagtttttgtagagatggtgtcttgctctgctgcccaggctggtctcgaacttctggcctcaagcagtcctcctgccttagtttcccaaagcactgggattacaggtgtgagccactgcccccggccagcacccgtcttctggaacatttgtaagcatttctgttgggtgtgtacttgcgcgtggaattgctggctctcagttatgcacatttcttagaagatcctgccagtccttcatcccagaccccgaccccagcgtggaaaacgcagtgcatcctcaacgcctagtgtttgcggctgtggcggctcatgatcgacttggaaggcccacagtgtgtggtgtggagttttgcagggagccagtgacactgcccaccttcgatccagacctaaccttgatcctgttctctgaggccaccttaccaaaaccttgacttacccgtcttagatcacttaccctgggggaaatgtgccgcaagctcacgagggcactcagccagcctacaaaggttaccatggcagagaactgaggcctcctgccagcagccagcagcagctgaccagccgcgagggcccctccgggaaggagagctttctgtgtttcttcctgtaccccatatatgttgacgtgatacgttttactttctgatttcccttgtga

SEQ ID NO: 28768 - DNA, 1147 bp, Homo sapiens
aggactctgggagtcacgaggtaactccctgctgcagggggcccgctgtggtggccgagtcccatgttcctgccccacctggcacctgtccttgttcccccatcacaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaaccgaatataccaggcaaaactccttggtgcctgcgctgtgtgtg

SEQ ID NO: 28769 - DNA, 1892 bp, Homo sapiens
tcctccgacctggggcattttcttacatgattaccttctgttctctacccctgcctcttgctcactttttctaaagcttgtgttagttgaaccactttaatgctctgattcttattttttttgagacagagtcttgctctgtctcccagtctggagtgcagtggcgtgatctcggttcactgcagcctctgcctcccgggctcaagcaatcctcccacctcaggcctcccgagtagctagtattacaggcacacaccaccatgccccgctaattttttatacttttgtagtgatggggttttgccagcttggccaggctggtctcaaacttttgacctcaagcgatccacccacttccgcccactgggattataggcgagagccaccatgctgggccataattctctgtttttttttctttcctgttcaatctcgtatttctactcctttaggaatagtcttacttcttgggagattgcctcaactttactttccagccttctgtggagacttgagttttattaggattattttgaatctttagttctttcttgccctcggcacgttcttttttgcagccacccattctcggatagtgcacgtgtctcttatctcactgagatgagcgtggacttttctttcttcaatttcttcctggccttgtgtttgattgccttctctggagtgtgttgtctgcctttctcattggaggttttcctcggatgtctggcgatgccatctgcctgtgtgtgatgggagtcagcaccagccggcctcagaggctgggtgtgtgcacccagggtggggcccgaggggcttcagagcaggtgtctgtgggcagcagccccttgcctgtggactccgtagaacgtgtgggtcagtcggtctcttctgggtggtcagtgtcccggccttcactcttgcccaggtctgtcccctggggctctgggaggtgagtgcgaaggggctaggtgactctcttctcagtgagtatttggcatccccgagacaggggcccctcggctccgtttccccagagccttctgctggcctggagtttggggctgaggatgcatcagggaggtcccgtttctctttgtaaagacatttgacagctcccctcaccaccttggtcttcaggctgcctggcccggtttggtctttggcaggtcctggcacctctcgggcttctctgtggctggtgcatttgttccctggcctccagcccccaggtttccttgctgtctctccgcggctgccttctcttcttgcctgttgtctttgtcttagtgggttcatggttattaaacatctttttcttgtcttcgtagagaggtttgggggtgagtgaaatgcctgtagatgtgtgtgttggtctccatgtttatctgccacatttgtagaaaggtgtgtgtgtgtgcgtgtgtatgtgcatgcgtgtgtgtgtgcattcatacatccactcttacctcggcacccagaggatatgcatctactgttagctgtttggggtatttacttttcatctttttcatttagtcatttaaaaatacttacaaatagtgcacagacactctctcattagatttaatgagtattgatttatttctctccactgaattagtgctgtaatgaattttttttaagccaggtatggtggctcatgcctgtagtcccagctactcggaggctgaggcgggaggattgcctgggcctgggagtcagaggctgcagtgagccaggagcaagcctgtgaatagccactgcagtgcagtgggcagtgtggaatagaccccatttcaattaaacaacaaaaaaataacaacagataaaaccaagaaaaaaaagagaaacgcttttttccattgatgatggttttagagcgtggagcc

SEQ ID NO: 28770 - DNA, 1122 bp, Homo sapiens
tctgcagctctgctgcacagctgtgagggaggaggagggatgctgcttccagcctggggtgtggcccaaaggtcctgcctgcccttttctgtcttttagtccctctgcccctgagagaaacataggggcctcattgaggacagcgttcctgaagcttccatctcaatttccagccgcagtgggccgggcgccctgtacttgtctgcctggtgttggctgcgtattgggcagtgtgtgctgccacagccctgggggtggggaagcagggctggctgctgttctgtagtgaggccctgtggctaactgcgtgtgtgggaagctgtgctacaactcatatctatgtaaaatagaacatatgggtccctgccttgtggagaggacataaatacgggacgattccagtagaaatgatgtggaaatgagagccccaggaagtagtgtagccctgagccctggcgaaggagagggagcgaactgtgactttggttcttgctgaagcagtgtgcaaacgtgctgcatccggaactctggtgcatccatgactctgggtcggggttggattcatggatgtgctgatgtggatgtggactggggggagcgcaggcctctcacacgctggataaccgagcttcctcccgaggagggtagggtgctgcctcactgctgccctgggctgggtcctgccctgagggtggccaggcccctccatccctctgcagggcatggggcacggctctctgtctgaggctcctggttcgacgcagcagaacgagcagcaggggtcagtgtgggtcaggggagcggcaaggctggggggccctggagactggtgcctgcctttgtccttgacagtggcccccagcacactcagcgtttatggagagggccgttgtctccctcaatgcatgatgaagactctggggttaaggaaccattcccccatttcttgatgacagttttcaaacacacaggaaagttgaggattttgtcacgcatttatccaccacctagatcccaccatcaggagcaattttctattcttttctttttttttttttttttttttttgagacggagtctcgctctgtcgccccaggctggagtgcggtggcgggatctcgg

SEQ ID NO: 28771 - DNA, 1020 bp, Homo sapiens
ttttttttttggtggagcggagtgtctctttgtcacccaggctggagtgcagtggcacggtcttggctcactgcaacctccacctcctgggttcaagcgattctcctgcctcagcctcctgagtagctgggattataggaatgagccaccacgcctgactaatttttatatttttagtagagatggggttttgccatgttggccaggctggtcttgaactcctgacctcaggtgatctgcccaccttggcttcccaaagctctaggattagaggcgtgagccactgcgcccggcctgctcttggttttgaaagtgatgtcagcagtataacttcgtgtaggaaatgtttgccttaggtggtgtggaagatggaccatgtgatttgatgcagtccaggcagcagattacaaaatcccgcctcgatggtgtggcttggggtttctcctgaccttggtgtagggcacgccttgctgcctcccctttctctagttgaactgcaggacagtgggtacagttgtgaagttactgccactttcaacatctcttggcaaattcctcaataatctttttaaaattcctttagaattgtgggtttgtgaacttttcagcatcgggtggagtgaaattgttaccctttctctcagtgagaaattggaggggattattgtggcaggaggagtaggtttgggggatgcgagtggggcagggagaggggcatagggtgagttttatcaggagctgctttcaaggagaggactagggtgagtggaaccatgctgagctggcaggcagcaccctgtggctggtccgcaaacatgggggctgctccccacacctggaggctttttatgcctcttagatctcagactcttagatctgatgcacccgctccccagaaaaccgcccacgcttagcacatccacctccattcagttttagaggttccatgtactcctagcctctctgcatttcactgaggccctgcaccgctgcaggatgcccctgagctgggcgagaccc

SEQ ID NO: 28772 - DNA, 1031 bp, Homo sapiens
tgcctgcagagggtaggggaggctgggtctggccgtgtgtgccgtaggcctggctggtggtgggggtgagcgggcagggagctcactcgtgtcttgaagacgctgactctttcaagtctggacagtgctgcggctgtgaagttctgaggttgccagaaagatggagacgtgggtggaatgtcaccttacttcaatgtgagcttgctgtccagaggtagtgtctcactttgaacttgggagagaggggatgtccagtctgcctgcccgctgtgtcctggttcctaacagtggagcttcttcaccctgatggaagcgcggaggcccagggctcctccaggggttctgactcctccagagggacggggcctctgctcctggcatcgtgcatggcccagaggagggaggaatctagaattctctccactcaatgtggttgcctgtggcagttggcttcttggaggaggtcatttgaggttgagagctccatgagttgggactcgtggtggatgcagataccgctgcaggctgggcgggtggggggcctcttcatccttggttgtaggtgctttgccaagagggagatgtcttgctgtgttgactcgtcttttgaaggttgtgtgctggtgtgattctctttatggaagcacctggtaaaactctgggaggctggcatggtggctcatgcctgtaatcccagcattttgaggggccaaggtgagaggatcccttgaggccagcagttcgaggccagtctggcctcaacatagtgagatctcgtatctacaaagaaaaaaaaaagcacaagtccaagagtgggcagtgcatctagtttaagtacccctaatctgaaattcacaatcctccaaaatccgaaattttgtgagcatagggaagatgctcaaaggaaatgctcactggaatgtttcggattttggatttttaggttagggatgctgagccagtaagtatttgcaaatattccaaaacctgaacaaatctgaagtgcaaagcacttttcgtcccgagcattt

SEQ ID NO: 28773 - DNA, 1027 bp, Homo sapiens
tcccgaacctgggaggcggaggttgcagtgagccgagatcatgccgttgcactccagcctgggtgagaagagcaaaaccccgtctcaaaaaaaaaaagccaaattctaggtggcatcaaaagcaatgaatgcctgctctgtcctctcttccagtcaggttaaaaagaaagccctgaaacgctgcatcatttctactctatgtgtttttgtgtatacgggttttactatatatgtttttatgtatatgtgatttacaatatgtttttgtgtctttgtgtatcaggtaggtaatagatgcacatggtttaaaaacttaaaacacaacaaaattaaaccaaagagtatgcgtcagtctcccttcttacccaccttctggctcctttcccataggcagtgatggtttcccagtaggaaaatgacttttaaatgcatgtccctacatgtctgagttataactgataataaatggctgcttccacctgactgctgtggatcgcgtcatctttatcttgaaaggcctgtgaacggcatcctcttgctaagatagccacatgagtaagtcatttaggacctagaatagagaagatgggaagtgttttcaggattcagggtgaatgcctcaaggtggccttgaggtgtcctgctctgagcccctccacagggatctctgcaggtggcaggggctttctagtaggttggccttgactttgggtttcttggacaacctgtgggaaggagggatggacaggttttcacctctcagtgttgaaagaagatagtagttgtcctagtctgcttgggctgcccaacaagataccacagactaggggccttaaataacaattttctcacagttgtaggggctggaaaaccaagatcaaggggctggcaggacagggctggttcctctgaggcctctctccttggcttgctgatggcgtcttctccctatgtcctcacagagtcgtccttttgtgtctatgtcctcatttcctgttcctgaaaggacactggtcagatggggtca

SEQ ID NO: 28774 - DNA, 1030 bp, Homo sapiens
aattataaaagtattaatttggggaactaataaatgtccatgaaatcttcacaatccacattcttctgccatggcttcagctggtccctccgtttggggtccctgacttctcgcaacaccaaagtgctgagattataggtctgagctaccatacctggcctgttattagtattgttaatgtgagtttatccctgcctctagccttgggttagtccttgcccatgaggaagagggccatgtgtcattgagggttcttccagcttagctctctgggttctggcatgtatgctgggagattttctgtttagttaggcttcatgctgataaaattagagctgttttgaacttccccatgtccctttaatatgtctgtattttggctacgtgatccccttaacagtttctacctcctcccatgttagaaattaccacgctggccaacaaggaatgcagccttatttccttaggtgaagcttaaccgtcttcctcctctcttcctcagggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggtatgagatgctaacgctggattcttaagatgtcgaatgcacaccttatccttgcatgcctgtagcaatagtgaccataacatggtgataagggtgataagtggttgacacggagccgcagttcagtgccagacaccactttcagtgccacatgtgtgttggctgatctgatcctcacggcagttctgggagggtgcaggggtgctgttctgtcccacgctgggtggtgaacagttagatagcagactccgatcagtgggctcggaagacagagccgggccctgctgctggtccctccacctacagtgttggtgcccctgttttccagggcagtcctctgtccttgtgattagcaggaacaaggctgtgagcctgccctggagagtg

SEQ ID NO: 28775 - DNA, 1030 bp, Homo sapiens
tttggggacttaaggaggtcattcgcgctcagaggctgtcccgggcaccatgcggcgtctgccggggtctttctcctgcccagcctcatttgcctgtgcatgcacttggttatccaacaagagctagaacattctgggagaagcccacggtggctccttgccgggctggtcagactccgtggttgtcctgagacacccaccctctgctgccctgagggtggcccaggaaagtttgtgtgaccttccacacggatcccctgggacatgcaggtgtggctcttgacactggaaaggctgagggttctgcccaaacctaggagtgaattcgacttctttcccatctcacacacacacccgagacgtcacccgaatccacgtatttcccacgttcggctgccactgcctcccgggtgggctttgcaggacccaccatcgcatcccctctcactccacagaaaactcgtggggccatgttccccctgccactgaccacgcttcccttgcagatccgcctcacggacacgctgggcaggctctcgcacatcctggagatggaccacttcgccctggtggtgcacgagcagatccagtgtgagtggggccctgctctgtgcgtggggttctcactggggtcaggccaccaagcctggcctctgccatgggcagcagctgggccccccatcccctgcggggtgttaggggagtgggtggtgccgaccttcagtgacacccagtctttatgcctgggcctcccacatgccctgggctggtgggctgtacctgtgattcctgcagggacccctcatcaggccacactgggtagggccctttgtccagcatgcagaggctcaggagtccaggccccttgcctccggggaggccagcagtcttggggattctcagggacaagcccagaaacatctagaagggtttcaagtcctgaccctggcattcggagggctgctctgaatggaagcctcatgtgggtctcacaggagccactgatgggctgtcctcagagccccgctcc

SEQ ID NO: 28776 - DNA, 1055 bp, Homo sapiens
accctgactccctctgctgcttcccccaaactccagattgggaccgagtgctgcccaggtggccccctaggacttgctgtgactgttttgcccagaggcccctcggacagtaacgccacagacctcgctggtcaccgggcagccaggctgagactggcgctgctctgcacctggtctccggaggcggtaccagggcgggtgtctacagacccccatgccctgtcccctgcacctgcagggtttcctccatggcctgcaagctgcagcggctacacagctcccgagagctcagctgcccttggagggccaggcctggctggtgggtgcccccagttgggttccccagtgtggggtgattcacatctggtgcccagggtcaagatgccctgtgcagggctcctgcccacccccgtcagtgcaagaacaccatctccccacatacttggccagcctgccatgtgtacctgtgcgtgtgagtgtgtgaggggcagagagcgagcatgagaggacgtgtttatctgagtgcctgagcgatggctgtgtgcatgctcacacacgcttgttggccatgggggcgggaagtccagcccccaggcttccccctggggcttccagccagcacttgggggtctctgctgcaccagtgaggtccaggagaggggctgggcaggcagtgcgtgccactcagcaggggcgggggcccggtggggccctgcggggactcggtgactcccccatcccgcaggaccaagttcctgagcgacaggtggatgctgcagaagggctttctgaaggaggaggacctcacggagaagaagccctggtaagaccgctcggccggagacccgctgcctgtgctggccctgcccagtgtgacaggcaggagagcactcccccgtggcctgtgctggccctgcccagtgtgacaggcaggagagcggtccccgtggcctgtgctggccctgcccagtgtgacaggcaggagagcggtccctgtggcctcctgctgaggtgctgccggcgggggtgcgagagcgtttgtccttatcctgatc

SEQ ID NO: 28777 - DNA, 1298 bp, Homo sapiens
gttagcgtcatgcctgctaaggagcagtggacgggtcctagcacgtgctgtgagccacccgctgtccagggagcggttacctctgtcttgccagcttcgtggggacagatagttcagctcatcatttatgagacagagaatgggaatttggagggtctgtggctggcctcgtcctgggtgcgcagggggtcacctgaggtgtggtctgaggcctccggggaagggcatttctttgcaggacgcagtttccaggctcaagaacgtggagggaattcctaagggtcgctcttcaccaagagcgcagagccctggtagacctcagcatcgtcacagagaaagctgtgggtgcagaggccttggggacaaggcggggacggaatttcgtatttcagatgaccaaggccaagtgagttcggagggaggcaggaagggtgccgcggagaaccccgcgacagggccagatggagggggtggagttcgagtgggaaggagagggaaccagtaacatggcttgggactttttcatcctgagatgctctaatgtcccagccgggggacctgtgagagctggggcaggcgctgggggaaggaagtcaggggtcggtgcgttgggaaccgatcgccgattcacaggaggggcctcgtgggagcctggccctcctctgcccccctctagggaaggagatctcggagctgcagcagagcagcccccttcacagagacccccaaggcagcagggccggctctgtgctcatttgtcagacaatagggacccttaactcgtacgcagcacgcgtggctggctcactgtgctccgtacaggatgacgtctaaacttggtggttgcccttgaagtaggttttggaatgcccgttttacagacagacacaccgagggtcaggttggtcacgtggcttgccggaggccaccagctctgatttctgcttcggagctggcccccaggcgctagtgagaatgatctaactgagggtttcacagtatgggacccagaggggtccgagaatgcaggcctgtagagggccagaccccgagagtcctccccaccacacacagcgcctcgtcctggttctaggggcaacacctgtctggtggttgctttcagaaattttgaggtgctgcaggctggtcccaggtccctcaaatcacatttcatgcagcccagtctctcgctcttaaaaactaaatatttttaagagctggagagggagagaggacttgcagtaaggaaggaagtgcaagtgaaggccttggccttgtgcgggaaccgcgcagggagc

SEQ ID NO: 28778 - DNA, 1085 bp, Homo sapiens
ttcatgcatttgaagcccatttccagagagctgcggcgggagctgtatggccgccgtcgcaagaagtgagtattcctgtgcccgttgttaagctcagtggcttctttctcccctcacaaccctcccccttccaaaaaaaaaattttggcataggtgtcgtttctgttttttaaaaggcagtgcttagaacatagtacatatttttaaatatccaaatgtcctctttggagaagaatattcacctgcacacaggtaacttcattatccaacttctcaagtagagatcagatcttagtaatcaagcaagagggcggttagctgggcagccgcggacatgaggctcgtggtgaaagtgggcatgcagtttattctcccagatattacgaagaagaagaatagatgttgtaacctcctttagatcagggatggcttccctgggacacattggaagaagaattgtcttgggtcacaaataaaatacactaatgatagctgataactttttttttaattgcaaaaaaaatctcataatgttttaagcaagttgatgaatttgtgttgggctgcaggttggacaagcttttgctttacatatttcacatgtccactggggtttcttttggttttgcttgttggttttagggcatttcattatgtcttgggatcgctggcatcctcccttcgggacactggcagaatcaggcccagcggtcacatctctctgatcctacatttaaatgtacgacaggtcacagagcagagaaaatcaagacgtcagaatcgaaccgattgagttctgagtctggagaggttctcatccctcttctgttaaacatggactagtaaatagatgggtggcgattgttttattgtcagcattcaagaagcataagagaaaaacaggcctgctctccccagcccaaaaacctgatggacacagtagctatgagcgcctgaagcgtggggtcagtgagggttgaagatggtatgtgtccagctcattttgattatgatttcctgtgaccatttgagttggttctagaagaagacagaagatgcaaggtattacacctgttcacttctaa

SEQ ID NO: 28779 - DNA, 2013 bp, Homo sapiens
gagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatggggtgagtgaggagtggccagtgacgtgactgagc

SEQ ID NO: 28780 - DNA, 1024 bp, Homo sapiens
cagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcc

SEQ ID NO: 28781 - DNA, 1034 bp, Homo sapiens
ttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtcc

SEQ ID NO: 28782 - DNA, 1667 bp, Homo sapiens
tgaagtctaaatgtgcagcctctgagctgttgagtagctattatgcgtggtccctgggagctgccaggctctgcctttgagctcacatctgtctgtatacgttttcctgtaagcatttaagaaaatctaccactttgtgtaagtgagctgggagaaggaaacatgggttttttccggttgaagcccatggacgaccccacagcacacagtgtttttagaagggaagaggatgatggcttttccctccattatgctaattaccaagtggttagtataatagcagtctgtcttttgatagctctgaacatgagtttctttttacaaatttcaaaatcttggagaactagctttacattttctgtgtattgcaattgttttttctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatg

SEQ ID NO: 28783 - DNA, 1523 bp, Homo sapiens
aaatgtcctcttcacacatggtagaatctcctgtgttgtttggatgaggaggctatatttctagcaaaattttaagccaaaatctaccagttatagtcactccagaaacatttagtgggggtcaactataggtcagtttctggagacttaaacatgggtaaaatttggatattatccttaaggaactcacggtatgatcttggcgaatgaatagaccagctctatcggaacaagagactcttctgagtttagggtgaagaactaacacatgtaggatcggggcatcattaatttctccttttcatatttgcatgtggcatgacttctgtcttgtaaaagtctatctccctatatttctgctataagcaaccacatttcaatctattgggctatactataaaggtcatggttttaattcagaaaagttgattatttaatctaggttacttgtgttttcttttcagggagacgtggggttttagcttccagggaacaggatcaactcctgaaaaatgaagctgatggttcatattaactttaattattatttaagctaagaataaaatatagatctctaccaattaaaaaatgtttagcttattatatgtttgaagttatagatgttttctagattcagggatatcctaatagcttgtctgtagtttaattgtgtggaataattggatattaattgttgaggcccagggcttgcccattctgaggtagtttttaaataagctttctttatttttagatgacttcctaaagatatgctattgtctaatcaagttaaataatctcaagacctgtaagtttgcaaatatatataatcactttcctctcctgataaatttggactttcccatctttattgctacctgataataaatcagtggctagtcagtcttcatggtccattagatttcactgaggttgaggcccttcaatcttaactctggattgactgtttaaaacataatggcacttggttaaaaaaaaattgaattttgaacaaagtctgtctggtaagatgtcctaattcatcagagatcggcttccctccctgacattgctggcacacaggcatgattgctggttccattggatatggatctggattgtcagcgtatttgaacagtattaagggagggttttgcagtagagacagaaggtgacgtaaggtggttcctaaggtgggttcggtcagtcccctaatagtttgttttcagtgtattgagaccaggagaattgatttacttcagacctattttttgaaactccctgttggtctggtgtcatgcgtttagagagactctgaacttcgttttctgttttccttagataatgatagcacttcatgagcaccatatgtgaagcacacatacgttctgtctgactctcagaacagtgccacattggcattgtcatcatttacagatgacatctgagagctagggtgacttgcccaagcccaagcagctggtagcagagttgggatcttaaccctcaccacaccggtgttt

SEQ ID NO: 28784 - DNA, 1052 bp, Homo sapiens
ctggcgttcgctcaagctcatggctggcgtttaggagggcaccgcgagcacctactgagctgggatgaggtcggaggctgcccctgcccagtgagatgaatgccccggggccatgtgggctcttggccgggtggtgccaggatgtgcctggatttcagagtaggtggtcaggggtggccacctgctgggagtctggaccgtggagccggggcgactgggcttcagcttcagtggctgcacaacatccaaaagcagggggcccttgaggacccagccctgctctccgggcagtgggcacttggccccagcgccccccctttctcggtgcgaggccgagcatctcccaagtctggtgcccacccggctgccttggcctctgcccactccaagccagctcttactccgccacaggcccggcccctctcacttccagcctgggccccactgtcacttcccatcatctccctcctgggtgacagccttgggaagggtctctggcctagactctgatcccaggacacggcccttcctgctccttggtggccttcctgggcctccaagtccgcgaccatacccatgacctgctgcccgctgctggtgggcctcagatttcccggaaagagggaagaggctcagaccagcccatagcagctttccaggtgaggccgtgatcatgagcagtccagggtccgctgcctggtgggggcgggaccgcaggctgggcagggacagcaggcaggggtccctccccccacacagccccccctcctgtgcggggctctggggtcctgccttacaggggtcctgtgtcacctcagtggggagcaggagatgggcccggggctcggggctgccatctccactgcatggtctggggctgagctgtcgtggagcaactcgggccacatgtttgtaatttggggacaattctgtcttcctgtaattttattgtatttagtaaatgcggtttaattttcttcctgtatagacttctcaaataactacaaatcaaaaaagagcttgcagtcccttcaggggcaaccgtggcctcc

SEQ ID NO: 28785 - DNA, 1053 bp, Homo sapiens
gtgtcattgctctcctgggtcccaagcttgcgtgtccccgcgggccagggcagggctgcatgccacagaagtcaccgtttcatagaagggaagactaggaagtcagctgcacccaggtcaagtgggtctgtgcgagtggacgtccctcctcttgctgtctgcgtgggtcacattgaccagagtttgttaagcccgggccagaggaggctcactccctaggctgggaatgagtttggtgtggcttcacacacaccgcactcacacacacaccctctactccacacggtgataagtgagtggctggagcaagccgcaaggagcttttgagcgcacaccagagctgcttctgctacctccaggcctctgatggctgcggctgcagacacagccagcctcgcagcatgtaagagtgggcaaggatgacacacgggcacagagagaccaggctgggcttcaggaagcaggtctgcgtgggatggaagtgcttagaaagtcatttctggaaggccgacaccagtcggcactccctgagcgaaaggacttgggaacacgtggatgcacttcttgtatctccaaggaaatgctccctgaggatttgcgacgtggaaatgcaacgggctgtggagtgctgcgcaccccgcacctcgagcagtggtttagctcagctcggggtttgtggcttcagggggtcatagtccacaggagtgccagggggttgggcgggtgggacagaggaggcgagaagtggttgcggacactctgcatgagcaggacacgcacacaccacacacacacataccccacacacatatacacaccacacaccccatatacacacaagtacacacacgaacataccacacaccccatatacacacaagtacacacatgaacacaccacacacacacacaatacggctctgcaaggaaacgtgtgaggggtgtggtgtgtgtgcactgtgtgtgaggtgtgtggtgtgtgtgaaatgtatgtgtgaggtatacagtatgtgtgtgaggtagtgtgcgatgtgtgtgtagtgtatgtggttg

SEQ ID NO: 28786 - DNA, 1072 bp, Homo sapiens
tatctttgagttctgaaatttctatttagttcttttttgtagtttccatttacctactgagaatttctgtccttccatctgcttcactcgtggtttcttttaccatgtggagcacagttgtgacaggtgctgtccagtcttgacctaattccagcacctagagcatctgttgactctctctctcttgagaattttgtggctctttgtatgtcaagtaatttttttttttttccgagacggagtcttgctctgtcgcccaggctggagggcagtggcaggatctcagctcactgcaacctccgcctcccaggttcaagcgattctcctgcctcaacctcccgagtagctgggattacaggcactcgccaccacacctggctaatttttgtatttttagtagagacagggtttcaccatgttggccaggctggtcttgaactcctgacctcatcatctgcctgccttggcctcccaaagtgctgggattacaggcgtgagccaccacgctcggcccgtcaagtaattttgaattgtattgtggacatcttgaatactatgtagtgtagattcttgttaaaatctgctggaaaatgttgatttctgttcattgttttggcggcagtcaattcagtcagagccagatctcaagttttgtcttctctcctgggggctgtggtctccatctcattgtgctctcaaggcttttcctgggtggctgtgggtgcgtcccgaagccagtgttgtctctgtagggtgctctctgcccctccccaagtaccatgaagtgagagagcagcgagcgggccaggcgccactcctggaggacagccacgatgctcacctggacctgggccccacacacctctcatggtacaaagctgggggcctgcaggctttctgctgcccgcctctccctgggggttccagcccataccccaggatggttgtagggtatggccgagtccatcatttgctcctggtattggggggaagtgccatggtggcctctggcagccatccttgtggcctgcctgcccttgccacccttgatgtgtatatgtttcaatatagt

SEQ ID NO: 28787 - DNA, 1044 bp, Homo sapiens
ctctactaaaaatacaacaattagccaggtgtggtggctcacacctataatcccagctattccgaaggctgagccaggagaatcgcttgaacctgggatgcagaggttgcggtgagctgagatgacgccactacactccagcctaggcgacagagcaagaccctatctcaaaaaacaaaacaaaataaaagttctctgcttattttgcacctaatttctgtttagttagtagagttttaagaagtagatttaggtttgcagaaaaactgagcaggaagtacagagaattcccgcacccgcctcccccacactgtccacagcttccttccctgttatgagcacagccatgccatgggacatgggtcacagctgatgagccagtatccatacattgttactacctacgtccatcttttacaacagggatcactctgtgtgttgtacattctgggcttggggcaaatatataatgacatgtataatgacatcattataacatcatacggaatagtttcactgccctaaaaatcctccacactctgccaattcatccctccctcctcccaacccctggcagccactgacctttttcccgtctccatggttttgcctgttcccgagagttgtatagctggagttgtatagttgtgtggcctttcccaggctggctgttttcacttagctgcatgcgttcaagcctccacagtgtatttgctggcctctgtggttttgatgagaaatcctgggtcatttgaattcctgctccctctgtgtgtgtaagctatcatttttctctggctacattcaagatttttctctttgtttttatgttttagcagtttttaatgtgtgtaggcatggttttatttgagtctagtctgtttgggatttgctgagctcattaaaactgtaaattgatatgttcccccaaatttgggaagttttctgcttttatttcttcaaatatttttctgcaccattttcttctctcctctgggcctctaaggacgtgaatgttagaccttttgatatcattccacaggt

SEQ ID NO: 28788 - DNA, 1049 bp, Homo sapiens
gccatccacctggtgttgcagacatcaagtgcagcgtgttcacgctttggaacactgcgcagcttgctgaagaaaaccataagatatttttctttattaaattggcaaagaaagaataacgtgtgcccccagcattgtgattgtatagctcttaagaagtaaagactcagggcctcttgcaggcaacctggtcacggccacaccttgccagcatcccttgcctgcagttgtatttctaggaatctgttgctcaatcctgtttgaaaccacatctggctacaactggacctgtgtgtccatgtgtttctctcaccctctggtctgcatgtgtccccacgctgtcctggacttcctctgccattggggccctccgcccacccagcccagcacagggaattccagaggccgtgtgtctgttctctgttctgcatcccagcggcaagcctggggctggagcagagggcgcccctgagcatctgtgagcgtgcacaggaggccaggatgcccaagctgtccctgagtagaactccctgagcgctgggacagctggagcccaagtgtccccccatgtcccacctcccagcacagctggggcctctgccacctgccaggagtcagtgcaactgctagaggagatgaacatggtggacgtggccatgctgggggtgtggaggaggtgagctgggggaggcatgagtgggtgagtgaggtgagtgagtgggtgagtgagtgaggtgcttggggcccttggggttttagagaccccccatgtgtgttttctagcagggttccccactgcaccctcctttcctggttgcttttcctggtgggtgtctaggctgtggcacgtgttcctcccaggaacttttagcccagccttggggctgtgttgaattcgctgggttgttcggccccagaagcaaaagtcagacaaaaaatacacccaagtgggcaggcgtgaccggagcagaggctgaggcttgtgcgggcacgtgctgccttagggctgcttggtgtggtcacaccgcagactctgtccgtgcgctgcc

SEQ ID NO: 28789 - DNA, 1086 bp, Homo sapiens
caggtgatgggcactatatttattcccatcacctggcaggatttgcaggatcattgctcagaattaaatatggatccagatttttacattacccatccccttttgttccttctgagctgcagttggagatggctggttggttcacaggaataagcagggttagtctaaaatgtaggcaaaacgcaaaaacaacgaatgagtctagagtttaatgacaaacgtatgataagttttgaaacataatgtctctctccagtcctcatttttaaaaacaaatcatgataggactgagttgtttgcaaaacagactttagtcttatacttggcctgattatttgcataaagagcagcaagcataattattttaacgtgggccttttagatttacatgggctttgatggaactctgtttcacaaggaatgtcagataggcctttctaaagctgagattgtaccctcaaatacttgtaagctgggtaaacaactctcttcttgaggtcccaatagcatggagttcctggacctgttagaaagtgacatgctttactcaccacaggttaggaaccctgtatggggactgtgtagaccagttatgaggccagttttcccaagggtcttttgttggctctgcaaatcgagcttgactccttaaaggtgagcatacccttctagtcaaagccttggtaaaacaaccagtttctccaattgtgtcttgttgcaaaagaaaatggattcttattgcactgatgcaaacaactatattgtcataagttaagaatacttacaactagtttccaaatcccggagaagccaggcagagagagagacaaatatgttccaaattgtgttcacagtagtataccttacttagttattaaaggccataaatagctcaaaatgtttccttgactctaaaaacaaaaggatcagcaattttccaagcaaaagtaaaaaatattacttcagttttctattagttcagtcctttcagttaactcttgttttacttgctatttgtgaacatttcagctcttcatgagtctggtacatttttcctttattctaatgtcacaatctccaaaatta

SEQ ID NO: 28790 - DNA, 1066 bp, Homo sapiens
gattatcttttcctcgagaattgtaatttttaaattcactatatgttgagtaattttatgtgaatattttgaatgttatgtttccagactctggtggtggcggcagagctctcgggagcttttctgtgcggcgtggaccttttctgtgtgtgtgcagctttggggagccaagaacattctttggtccatgcctgagtgagaggccttgcccagccctcttcccaggagctccagggccccttccccaccgtctctggctggaatctggaatgctctgagaatgtctcccctgctccgtgcagctcagcacagctggagctgcctcagaacaaggcagtgatgagcgtggagagaaaagcaatgtaactgttcgtggaagacgccctggactctccccttctccagaagagaactgttgctcttggtccccttggcgcttgagaactggtgggtccacctgaattggtccgagtttggttttaccatttgttgggtggagtctgagaaatgtcacaagggcctcccaagtctctgtacctgagtgggactccgtgtccaccctccgtctctcctgtggctcctgccagggcttgcctttaggcatggccagcgtctagggtagacctacttgagggtgtcttcctcacttctcagttgtggcctttctagtttctcggctggatgcccaggggatctcagagggattcgggggctctttccatgctggcctggccagagctctgtgtccccagcaccctccacttcttgtttcctcccccctcagcccaaggcagcttctctgtaggttgccacgtgctccctccgggcaaatgcagcagcacccagctgaggccttggggccccatgaattttaggccccgcctctgtgccctcctgcttccgtctccagctcctaggctcaggggccctgccaggctctgcctggagtcaagcctctgtgcctgggtagaaattgccctgggaagggagctgtggcatctgcagtgtgtccttccccctggatcacagccttcacccacccgcgcctgtagactggtgcctgtgc

SEQ ID NO: 28791 - DNA, 1027 bp, Homo sapiens
gttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaata

SEQ ID NO: 28792 - DNA, 3539 bp, Homo sapiens
ggaggaagttttacacatgggtgtgtgctcagaaggggttatgctaatctttgtcatagtgttatttgtaatggtgaaaattttgacttaacctgggtttttaacacaagaataaattaagttatatattgtattagtctgttgtcacgctgctaataaagacatattcaagtctgggtaatttataaaggaaagagatttaatggactcacagttccacatggctggggagacctcacaatcatggcagaaggcaaaggagaagcaaaggcacatcttagtggcggcaggcaagagagtgtgtgcaggggaactgccctttacggaaccatcagatctcgtgagacttgtacactatcacgagaacagcacgggaaagatgtgcctccatgattcagtacttcccactgggtccctcccatgacatgtgggaattatgggagctacaattcaagatgagatttgggtggggacacacccaaactatatcatatatgttagaatgtgatgtagattttttaaatgatctaaaagaagaatcaatgatacaaagtagtatttgtgttatattgactgggaaaagcagtagcactgttataatttcctcttgaaaaagaaattcacatgtaaatgtatatataactggaaaagtaagcacaaaaatgttaaaagtgattcttttttcagattgaaattttttttcctttttgtaaatctttttttgccctaaaattaatatatattaattttaaaaggaggaaaaaaataaggtcatttaagtgaattgtactgtagcttatttgaaaatgtgtccagtagtaggaattggaatttctgaacagctgtagtttttattttttccttttacattcttccttttacatctttgccataggggttttcaggactacccccccacccccggccacttcactggtggaaatgccgtctgccaatagacttgctgtcctaaccctcgtttaggacttctcatttactgcagatattggtacacataggtagtgggcggctgcctgagagagaccatttggtacttcttttcttatctcaaagctgcttcagtcttgtgtgcacaggggatgctcagaagcgtgccttctttcagggagactggccatgcgcctgagttagatgataacatggaggttcatcacacgctgtctacttgagtgtgtttttggaattctccataataaaaagttaaaaaatacaattgataggtaagagtaattgaagtagtttcaaattggttagctataaaatgcaactatgaagaggattgtaggtaattaaaatactaagattgtattgaggagaaatatattattcagaacaatacctgtgacatggcattagtgacaaatatgaccaataaactgattaccttatgtgactatgtactacaggtggtctgattattatttttaatgttctggtaattatttttaatgctcagataatataaatttttgccttactgtaattggattattttgattttttaaaaattatctttgagaactataggtctaccaatatcataaaaactagtcaataaatactttaaaaacaattcaacacacgtactgaaagttgctggtatacagtggtgagcaaataatagcagaccttcaggagcttatattccaaggacagggatggacattgataggagaatcacacaaacaaaatgcaaagtcacatcaggaagttctgggcagcaccttgcagaggtggtggttggatggaccatctgtagggagtgaagcaggagttacctgagtgattcggggaggaggggcccttcacatgtgcaaaggcccagcgcaggaagtgacgggagaggaaggccggggccaaactacctcaggccttttggtcaatactgaaggttttgatgttttctcctgggagtggcggaactccattgaaagactccaagggagtggcatgaccagaatgatctctgacggctcgctctgggtacagtgcaaaggacaggtgggaggaagccaggcaggccctcggctgtagtggtctagggtagagacaccggcaacttgggaactaaatgtgggcactaaagataaagagatgtgtgtggatccacgagaggtttaggacatggcactgctgggacttggtgaaggaggggctgtggcagggacacaggtgcttttgatgcttctgtggatgcagtgtcaccctatgggaccaactcctggagaaggcaacacagaagtgggaaacttcctgattttgtggatgtggatcttaggtggacagcctgatgtccagggcaagtatgcatctagtttcttccactctccttgaatgagaagttgtggttcagttcctggatagtagagcgttcaccactgaacgttcaccactgaaacaatggatgagtggaaacacataggaccaggtatgaaagacaagactgtttgaaggtaagtgatcgccattcacatttgtgaattttcatgaaattcagagcttattaactcaggtgagttaaataaatgtattttaaaattgctatttctattattataactttaatggctttataattttacagttgagtctatctagatggattactgcatatctgagtatatatggagccatctgagaattcctcccaattttatgtaaaagaggactgattaaatgctgtgaattgaaaatttatttctctttatcagaccttgtgtatctttttaatgatgatatttggtggaaagggatttgatttagacacattgacctacattccaggttgtactgatgataatttacttattattagagtaagctaccaagagaaatcctggtgcctttctttttgtagatatttacataattccagttgcctttatcatagccatgtgaacatatattttacacagaccggttcagggatttaatgatagaattagaaatagctaaggaactagctctgaaaagtattgtaaataatcctaatcacattagatattttgataaaatatttgccagataacctttcatttagtctttttgtatatattgcttgaaaaaaattcatatgaaagtggattagactacgacagctgattagaactggctgggtcagcctggagcctgtcagtgagtgagcaggccccaccgggattcctgcagacatgaagcgtgacactcagggccccaggctatgccccagctgtgcaaacagcttggttgctgtgtctgcagtctttgttctcattatctgtggagcctgcccaagcgcggcgatgcctcgggcaccattcctgggctcacttggctgcctctgacccttgcagtctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcaggtaaggcccgagcctcctggcaggagctgccgtggacacccaggc

SEQ ID NO: 28793 - DNA, 1050 bp, Homo sapiens
ttagggtatggctgtagatgccttttggacaggtttaactatgaaaataattatatggagcaaaagctatatttgcccctactatgatttcataaaatggaaatgttcccccttttcttccgagcagttcttagcattggttatctacctgagtatcgcctggggtgcttagaacaccacaaaacagaaaggaaacacaggggatctctgggtttaaaccagagccagggccctgctctgggggtgagggtcaaatatgtcatcctggtggagaccaagtgctggaggaaagtgcaggaaggcacttccccaaatcacggcttcttacagcctcgtcctcttgctacgagggtattgggatcagtttctatttaactcctcactgcctggcacagccacaagcacaacctggcatagcagagccagtgtcctagggcttttaaagtgcccagtgtgggggctgtgtgtgcagcccaccttggtcctgctgtcctgggcattagtggggtgggaacatcggcaagaagcttttgctgaactgcagagcagggactgaaggaaggagacgcacccaagctcagatgccgggagccctcatgcccttcctgctgggtgccctctgtcgattctgtagcgtaagggaggtgcttatccttcccccagagtggagggtgcccatgaagcagtttgcccttcccgtctccagctcagctggctccagcttttggagggccatcgtcccttagtcatccacttcaggttttaaatactgatggatgagtttgcattctctgtgattttaattctttatcacatgtgcgttggagacttcttgtctatgtgctgtgacaaacttgataaagagaacagcagcaaaagcagtcggctttcccaacacctgcgtgcagctgaagtggcgagcgcaccagttcctggaacaccgcttgccggcgaagctcagggcacccacttgccctgggtgctccataaggcactctgacctgcctgctgcttctcttatctagaaagtaaaaagtgttagaaaggcaa

SEQ ID NO: 28794 - DNA, 1048 bp, Homo sapiens
taagaaactatcagactatcttcctagagtagctcaccattttgcattcccagcagcagtgtatgagcattccagtttctccacttccacaccaacactgctgttgtctgataacagctgttcttgtgggtgtaaagtggggtctccttacagatttgacttggatttccttgacgactaatgatgttgagcatctcttaatgggcttattggccgttcatgtatcttctttggtgaacttcagaacttttccccatttttatattcggttgttttcttgttgatggaacgttaagagtttttaaaatatattttgatacaagtccttcattagacataggatttttaaatattttcttccaatctgcaactctccattttgttttcttaatagagtcttttgaaactaaaaagttgttaattttgatgaagtgtgattttgcattttttttcttatatagagcatgcttttggtgttgtatataacccaaggttgcaaagattttctcttatgtttgcttgtagaagttttgtgttttttcacttttacatttaggcctttgatctattttgattgacttagtgtcatgtatggagttaggtgggagtctgtttcattcttttgtatgtggttatccagttgtctcagcaccatttgttgaaaagacagttctttccccattgcataattttggcacctttgtcaaaaatcagttgactataaatgcaaggatttatttttggactctgaattgcattccattgatctatgcctatccttaggccattactacactgtcttgattactggagcttcatggtaagttttaaaattgggaaatttaagtccgccaactttgttctttttcaagattgtttactaggccattgcatttccattacattttagggtcagcttgtcaatttctacaaaatgcctggtgggattttgattgagactacattgaatctttagataagtttgagggatattgccatcatatcagtactgagtgctctaatccatgaacatggactgtctctccat

SEQ ID NO: 28795 - DNA, 1076 bp, Homo sapiens
ttgctgaaataaacccgagataataaaataggtgtttataatttgtattgtatgtaatctcaccatagcattttcttcaacaaaagtgtcacaaagatccctatatgaagaagttattgccacattcattgcagtaataataataaaaaaggaaacatcactgttccacataatttatggagcatctatatagagtaatgccatgtagctgtaaaacagttcaggtggaattttcatcctggcatggaaagatgtacacaatataaatggaaaaggcggattctagaataataggtctggaaccgtctgtccgtccttccttcctctcctctcctccctcctctctctcttcctttctcccctcctttcttccctcccctcccctcccctccctttcttatggagacatggtctagctctgtcacccaggctgaagttcagtggcctggtcacagctcactgcagcctcaaactcccaggctcaaacaatcctcccacctcagccccacaagtagctgggaccacaggtgcacaccaccacgcccagctagtttttaaaatgctttgtagagatggggtcttgctctgtttcccaggctggtctcgaactcctggcctcaagcaatccttctgcctcagcctcccaaagtgctgggattacaggcaggatccaaggcacccagcctaaacagctttattgagataatttacatactgtaagttttacttgcattaagtataaaagttagtggttttagtaaatttctagagttttgtagtcatcaccacagtccagttttagaacatttccaaaaagattcttatgtctatgtgcagacagttcccattccaacccccaggcaatccctgctctttcctctgactatagatttgccttttctgacttttcctatgtgtggaatcatacactgtctaatcatctgtgcctggcttcttgtacttggcagaatgtatttgcagttcatccatgttataccatgtatcagcagctccttccttttccattccccagttgatggacatttgggcttcctactttttggctcttttgagca

SEQ ID NO: 28796 - DNA, 1951 bp, Homo sapiens
attttctcctatgatttcttctagatgttttatagtttcagctcttgtatttaggtttgggatccatatcaaagttttccatatggtatgagataaaggccaaggtttatttgtaaattatttgtaaatggcagtgcagttgtttcagcactgtgtttgctagggctgctctaccacacaggctgggcacggcttaaacaacagaaatgtatttcctcatagtcctggaggctggaagtccaagatcaaggatagggcagggctggtttcttctgaggctctgtcctctatgcctgtgtcctcatctcttcttaaaaggatattagtcagattggattaaggtccaccctaatgaccacattaattttaattacctcttaaaggccctagtcacacacttttctccaccttcttttttttcatgtaatatgtcctgaagtttgttctgtactagcatgtagaggtatttatagctgcaaagtaccccactggtatatgtatcataatttgactggtcctctgttgatagacactcaagttctttttaatttctttttgtttttacaaatagtcctgaaatgaatagcctgtgtatacattttttatcttcaccaatgttatctgtgggatggattcctagaaatggaattgctgggtcaaaggttatatttcactttgtgtggtagctatttgttaagccactattttaagtggcaaggaatggcctctgaaaatttccctgataccaagattcgtctctttttttgaacttgtttcttatcagtaaacatgaaactgtatattattttgtgtacgcgtgtatatgctttggaagcaaaaaacaaaatggaaaaaataagtgccctgaaccattccctccagcctctgaactcatttgctgcacttctttattgaccagtagaggccactgttgaataacaaagctggcgggaaggccagcgcacacccgggcaggtctctgtgctgagcctgcattgccaggagcaggtctggagctgcagtttttagaccaccctttcccctccctaagggagggtgtcacgcaggggagtgccaaaggggaactccagatgaagaataaagccagctctctttggtacgagctcttcttcatggtcccacgaaggtgatttgtaaagcttttgtgtgttctgctgccaggcctctacttagttgcccactgacattgtgtttctcccgcaccccacctgcttagcagtttacagtctatctgccgtaatctgttatttttttcttataattaggcggtttggcttgagacacaagaatgggactagattttagatgactgggtgtaggaagcctagcaaattaggttctgtggttatttctcctgatctactccacatgaagagacacaaagggagaacatcagggtgtggcttgtgaaatccaaggtcttagtcggcttggtacttgacctcattcacattcagttcccacccacccctgaaatgtttaatgcacttggcccttggggccagcacttgcctttggcctgccttgctggcccctccttgccactctgccttctctcactgctgggtgtcagcacacccttgtgacagcacttaggtctcttcaggacctctgtttcctggatcagggcttctcagcaggtgttagtggtattttgagtgaaataatttttccttgggtaggccttgttctacccaaggttgtgggttcattaaacggttaatcggtacattagtccgttcttatactgccataaagatactacctgagactgggtaattataaaggaaagaggtttagttgactcacagttctgcataactgacgaggcctcaggaaacttatagtcatggcagaaagggaaacagacctcttctcaaggcggtaggagagagaagagcaagccaaggaagaacttgccacacactta

SEQ ID NO: 28797 - DNA, 2158 bp, Homo sapiens
taagagtcagtccctgtggcaaacttaattgttgtcttattttcagaaactaccacagccactcctgccttcagcaactaccaccctgatcagtcagcagtcatcaatatccgggcaagactgcaccggcaaaaagattatgacctgctgaaggctcatatgattgttagcattttttagcaataaaaattaagcatattttggcaaataataattatttatttatttattttttgagacagggtcttgctctgtcacccaggttggagtgcagtggcacaaccacagctcattgcaagccttgacctgggctcaagctatcctttcacttaatccacctgagtagctgagactacaggcatgtgcccctacacctggctgatttttctgtcttcatcttgacctccctctatgttgtcagggtttggcgaaagtgactccattttgattctgacaatgttcatactcgaacagagggttggatgtgggggactattacttctgtgtcctcatgggaaacctggctggtgggtcagatgtgtgaacacctaccatttcttggtatcctggtttgtgtttgtgtctctgttttagttttattttagccctatttctagggttaggctagactgtgagcaggtattttctctttttttttttttttttttttttttttgagacggagttttgctctgtcgcccaggctggagtgcagtggcgcaatcttgactcactgcaggctccgcctcccgggttcatgccattctcctgcctcagcctcccgtgtagctgggactacaggcgcgcgccaccatgcccggctaatttttgtattgttagtagagacggggtttcaccgtgttagccaggatggtctcgatctcctgacctcgtgatccgccagcctcggcctcccaaagtgctgggattacaggcgtgagccaccacgcccggccttctcatttttattgagaagaaaatcattaaacccctgcataggaaattaagttcaggctgctgcttcaggccagtctttgcattgttgaacttgcattttctaaggatatttgcattagcaaagatatgttctcccttttattgtcctgacagaagcttcatctgttatttcaattatattgtcaattagtttgcagtaataagacctaaataatggttgatttccgaaggtttgtcacggaagtgtgttgtgtgtttttacatgttaacatgaaattttggactatgtgtagaaggtagaactctaaacatacctcactaagattcccatgcccttgttattcaagcactttctagtacttcggtggagggactttggagatgcaagtcaggttagtaatcagcagacctaaagagtgggagattattctggattaccgtgaaggatccaataataacataaggctcaaaagcagtcagtgaaggcaggatgggggtggtcagagagattcaacatatgacaagatctctaccttctgtggctggctgtgaagatggaagaaggagccatgacctaaggaaggcgggcagcctcaagaagctgagaatgatcccagaccaacagacccgtggaagtgaattctgtcagcaacctcaatgaacttggagtggcagccctggtgagactctgagcagagaactagctggcccatgctgtgtccagacttctgacgcttggaaactctgagatcatcaatgagtattgttttaaatcactaaatttgtggtaatttgttacagcagtgacagaagatgaatacagtgtgttattgaggggactttgtttttcctgtatcttaataatgtgataaaatttagtgggttttttttgtgtatcatttactggttttttttgtgtgtgtatcttaacatctagtttgtcctcataacgtattttaaggtagcacattccagtgtaaaggtggacttgacagaatcaatctctacatagaaggggtttagataaatttggttagatgttcatgcacactttattgtatttgggagtagtcatataactgcagaaattcagaggtggtgggaccttggctatgattctgttcaagccccctaattttacagattttatggaattgagcaacagacaagatgattttgcctaggttcataaacaggaaaa

SEQ ID NO: 28798 - DNA, 1043 bp, Homo sapiens
ctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtctcttggcttctactaaacactgcatttgaaggttggggcatactggtacaattcagtgtttgaattgaccattccaggca

SEQ ID NO: 28799 - DNA, 1058 bp, Homo sapiens
gaggcggaggcgggtggatcaagaggtcaggagattgagaccatcctggctaacatggtgaagccccgtctctattaaaaatacaaaaattaggtgggcgtggtggcatgcacttgtaatcccagctacttgggaggctgagacaggagaattgcttgaacccgggaggcggagtttgcagtgagccgagatcgtgccactgcactccagcctggcgacagagcgagactgtctcaaaaaaaaaagaaaatagtattatgtgctcagttagcagaagttgctagaaaatgtgctgccagtagctctgtgactcccagggagaggttgggaagccaggggtgatctgctgaccgggaaagcagccctggggaacctggaggacctccttcaaggtggtcagccccagcactgagctctatctcaccacgttacagaaggtgtggggaaaagggtgagtttgaaggcaacgtgtttgacttctctgctcagtatgttttgttcatgtgtcacccctgaaactcacctgtgaattcccctagaatctccagttttcccagcttaagaatccctgcttgcgtagacagccctctttttttgtgtgcgtatctttgtatatttgattttggaggcgtttttaaattaaggaaatcagctcttgtgagattcaagttgttttctagtttgcctttatttatttatttatttatttttgagacgggctggagtgcaatggcactatcttggctcactgcaagctccgcctcccaggttcacgccattctcctgcctcagcctcctgagtagctgggactacaggtgcccgccaccacgtccggctaatttcttgtattttttagtagagacggggtttcactgtgttagccaggatggtctcgatctcctgacctcatgatctgcccacctcagcctcccaaagtgctgggattacaggcgtgagccactgcgcccagccccgtagtttgccttttaaatcagtttgtggtgtgttttgtaacctagaactcattattatgtagttgaatttattaatcttttag

SEQ ID NO: 28800 - DNA, 1339 bp, Homo sapiens
gagcagctgccagaccttctttgcaaatggttgagccatttacacttccaccaacactgtgtgagagttctgttgctgtacatccttgccaacatttggtattgtcattctctttaattttagccattctggtaggtgtgtagtcatctgtcatttggagttttaatttgcctttgtctggtgactggtgatgagcacagagctcttttcagcgtgcactgtgtttgtgtgtgtgtgtgtgtgtgtgtgttatgggattggagtaggcagtctgtgtgtgtgtgtgtgtgtgtgttacgggattgggggagtacgcagtctgtgtgtgtgtatgtgtgttatgggattgggggagtaggcagtctgtgtgtgtgttacgggattgggggagtaggcagtctgcgtgtgtgttacgggattgggggagtaggcagtctgcgtgtgtgtgtgtgtgtgtgttatgggattgggggagtaggcactctgtgtgtgtgtgtgtgtgtgtgttatgggattggagtaggcagtctctgtgtgtgtgtgtgtgtgtgtgtgttatgggattggagtaggcagtctgtgtgtgtgtgtgtgtgttatgggattgggggagtaggcagtctgtgtgtgtgttacgggattgggggagtaggcagtctgcgtgtgtgtgtgtgtgttatgggattgggggagtaggctgtgtgtgtgtgtgtgtgtgtgttacaggattgggggagtaggcagtcagcttggttgcatgttggaagttactcatgcagtcgctcttgcttctgactggcttgagttccagagctgttggctgcgtggagtttgaccccttccttagtagcagcgctttgagtagtgggcagagtctcagggtgttctgtgtggttggagcaggctggtgtgccgggcctctcccttggtacaggttggtacagggagcatagcccagtctggagtgaggctaccaggggactaagaccttgctttgtcacatgagatctgtaggtgagtccaaagacacaagtgtgctgcgtggcagtgtcgctggcgttgctgtggcctcggatggaggctcttgggttcccaaaagagtgcctgctgatgagcagaaggtcccagcaggtttgtggttagtgattacacagccacagggcacacttcctctcacagagagatctgaaacacagccttctgtgttggcactcttctctcccagaagagcccttgtggataggagccgcatgtttatactctttgtgccctgcctgcagcggggttcctgaacactcgttccacatgtcttgaagaaggcttgttatcagcaggggct

SEQ ID NO: 28801 - DNA, 1044 bp, Homo sapiens
cagggctcacttaagagcagcgtgagcagcgcttgggaccgccgtccgggacgcccgcagccctttaggatggaggccaccgtgacctccgccaccgaagcaccgcgctcccctagtcccctcagccggtcgccgttccccgccgcgcaggcgcaggagccgcggcgagcccctcggtcacgcctcgcccctcggtcacgcctcgcccctcggtcacgcctcgcccctcggtcacgcctcgcccctcggtcacgcctcgcccctcggtcacgcctcgcccatccgcgccgcgcaggcgcactgagcctcagccgctctcctcgctaccaggctcctttcctctatcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctggtgagggcgccggggcgggcggggccgcgaagggggcggggcggctggtgggtccaggtcggggtcggggtcggggtttcggccagggcgctgggctcggcgggcggcctgggcccacggtcgcaggcagcgccccgacggaggctcctcgagggtcacgcccgtttggcggccgcgggagctgccgtcgcggctggggcgcgggcaggggaagagccgtctttgtctttgtctttgttttgtccagtcgctgcggccgctcctcgcgcgtggcctcgggttggccctcgcccggcaggcgggacgcttggcacctgcggcctcccttagcctcactgcgaccccaaacagcactcctcggg

SEQ ID NO: 28802 - DNA, 1105 bp, Homo sapiens
aacacagcgaaaccccgtctccaccaaaaccagtcaggcgtggtggcgcgtgcctgcaatcgcaggcactcggcaggctgaggcaggagaaccaggcagggaggttgcagtgagccgagatggcagcagcacagtccagctttggctccgcatgagagggagaccgtggaaagagagggagaccgtggggagagggagagggagaaggagagggagagggagcacgtttctttcctttcttcttgatccctggttctgttctgggtagacctggaactacccagatccatgaagatctgcatgatcttcaactgtaattcctgggagggtaaagctgagttgtgtgtctgcacctttggagccagttcctaacgaattaaccagaagccaagtacgcatgtctgtctgctaaagagtcacgtatctgtccttactggaggatcccggttcaaagggtctctccttctactttgcagaatatgaagagctaaaaaagctgttacccgagatggtgaggtttgaacccacgtgggaggagctggagctctacaaggacggaggcgttgcgattattgaccagtggatctgcgcacacgccaggtgcctgcccacgtcactgtcggccgagagcgggtcgggtggctttcaaaggttcttctgtcccaagtactcggtgtcagagcagatggtcgcctgtgttcacagtggtcatttccatactgtttgcctcctcgtctgagtctcctgtagcatctggttcagtgtttccctgggctgaagttaattgttcatcttgcccctttagttctcatgcacagaattcctccatagcaggctgttggcatagctggcctcgtctcagaacctcttcttgtgtcgcattttcccatcattcccggtttctgcccctgtctgccccctgccctgagagttgcccgtgccctggacttgggcatgtccttgttgctgtgttgttgagcatccgtgagcgtccccgaggccgggagcgtgggccctcgtgtgatcattctcgtggggctgccatgagcgtccccaaggctgggagcatgggccctcgtgtgatcgttcttgtggggctgccgtg

SEQ ID NO: 28803 - DNA, 1028 bp, Homo sapiens
tcagatctgggagctttttggatgagtctttagggtttcctaggtatacaattatatcatcagtgaacagtgacagtttgacttcctctttactgatttggatgccgtttatttctttctcttgtctgattgccctgactaggacttctagtactatgttgaatagaagtggtgagagtgggcatccttgtcttgctccagttctcagggtgaatgctttcaacttttcccccgtcagtataatgttggctttggatttgtcatagatgacttttattatcttgaggtatgtcccttctatgccacctttgctgagggttttaatcttaaagcaatgccggattttgtcaaatgcctcttctgcatctattgaaatgatcatatgatttttgtttttagtgctgtttaggtggtgtgtcacatttgttgacttggatatgttaaaccatccctgcatccctggtatgatacccatttgatcatgttgtgttatctttttgatatgttgttggattcggttagctagtattttgttaaggatttttgcatctatgttcatcagggatattggtctgttgatttatggaggattccctctttctctgtcttttggaatagtttcagtagaattgataccacttcttctttcagtgtctgatttcagctgtgaattcattgggtcctggactttttttgttggcaatttttaaattactgtctcaatctcactacttgttattggtctgttcagagtttatatttcttcctggtctatatctagaagggttgtgtatttccaggaatttatcctcttgattttccagtttgtgcgcataaaagtgttcatagtagccttggatgattattttgtgtttctatggtatcgactgtaatatctcccgttttgtttctaattgaccttatttggatcttctctcttcttcattaatctcactaatggtctatcaatgttgtttatcttttcagagaaccagcttattgtttcatttaacttttgtatttttttg

SEQ ID NO: 28804 - DNA, 1050 bp, Homo sapiens
tgcggatgtggagctggggcctcaggggtcttgggcgggactcactgggctctgcccacggatgtcctgagggcactgcagcctcctgaaccctctgcacctccgggaatgatcaggtccctccctggtgtcccagggacatctccagtccctcctgcccctggcagctgcgagaatcaggagagatgtggccaacgctggtgctgctccttctggtcatcgtagcacagcttccgctgccgagatggagacgggctccatgtgcaggctgctgggggttgctctgggcgcgaagccctggggatcagctcctggtcacctgctgtggctctcctcaccctgctctgccaggcgggacgttctggccctcatgggcacccttccgctgtctcagcaccatgggggggcagcaagcaccaccaagcaggggactcgggagcagacaccgcaggccacgcagaagcaggccacctgccaggttccgaggggttcttgggaaatggtgggaaccccccttcaggcctgtgccaggtggtggaggtcgggggggctgtggtgagcactgtggcacctgctcctggggctggcctctgaccgctgtgcagtgttcagggtcagcctctgagctggaggagggtgagcctgggagcaggcgtcggggtgtagggtgccagtgtcccagccaggccctccccacccgcctcacccggcctctctttccagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtg

SEQ ID NO: 28805 - DNA, 1975 bp, Homo sapiens
atcgccacgtgagttccagaagggtgggaagccgggggcgggcaggcgccaggatcaagccccgcgcttcgctgggtgctcccaccttcctgctgcgccccagcggctgtgccactgctggccccgccagccacctggagctgaccagggtccccacttgcctctccctgggacctcgggcgtcccttcctgtgccgtcttgctgctcccccaggccctccacgctcctctctgaagcctgctgggctcacagccttgccctgctcccaaccccaccctctaggccccgggctgctgagaccccatccaggcaggagcgggagcttgcacctgtgtgagttcatcctcagcttacactcacaccaggcactcacaccacacacacaccacacgctcacacatggacacacacacactcatgaacacaccacatgcgcacagatggacactcaccacacactcatgaacacataccacacgtgcacacatggacaaacacaccacactcacacatggatatatcgcacatgaacacaccacacacacggacacacaccatgttcacacatggatatatcacacatggacacccactacacatggacgcaccacacacacacggacacacaatgcacactcacatgaacacaccacacgctcacagatggatacaccacacagacacaccacacacgaacacacaccacatgctcacagatggacacccactacactcacatgaatgcatcacatacttacacatggacacacaccacacacacggacacccaccacactcacatgaacacactacatgcttacccatggacacacactacacacggacacacacacactcacagggacacaccacatgttcacagacacccaccacactcacatgaatgcaccatatgcttacacatggacacacaccacacagacacaccacacactcacatggacacaccacacactcacagatggatacaccacactcacatgaacacaccacatgcttacacatggacacagcacacatggacatgctacacgctcagatggacacacaccacacggacacacaacacatgctcacacatggacacacaccacacgttcacacatggacacaccacacgtttacacatggacacgttcacacatggacacacgctcacacatggagacacccacacattgacacactcccaccacatactcagaccacacacactgacacactcagacactgaccctgtgtgctcacagggtcctgctccctggacctgccccctctttcctgcccgctgggaggactttggccccagctcagtaccccttcctgggcttcccctccagggtggcctccgagccctatctccctccctccgtgggtcatccccctgggccttatgctggtcacgagcctgtttgagctgagagcaccctcctgacccttgcattgggccctctgtgtcagtggcctcacccctgcagcatcctgcctggatgtgcccggccctgtacttccccatcctccccacatgcaggcagcagtctcccggcatgggcagcccggcccacccttctctcccgcccctgccatactcggggccccttctgctcctgtgtggccgccttctccaggctccccgaggcccacactgggctcttgccgtccctggctcgtgaaggcccagcgtgatcttgcttgggcccccccactgacctgccagcactgtggaaagggccagggcctctgccattgtgctgtcccattgctgcagccagggggacaacgcctgaaaggttttagttataaagtcattgatgcccatcgcaaaaaaatccaacacggtgccgcagcgtgcaaagcagaaaactgctgtttgctacggggaatcccagcattttctgcttgtctgtgttgggttgatgccagacacagatgcagatggtcactcacagatgc

SEQ ID NO: 28806 - DNA, 1209 bp, Homo sapiens
aacccccatctctactaaaaatacaaaaattagccagacatggtggtacgcacctgtaatctcagctactcgggaggctgaggcaggagaactgcttgaacctgggaggtggaggttgcaatgagctaagatcgtgccactgcactccagcctgggcgacagagcaagactctgtcccaagaaagagataaaaatagagaagcttagatgaacaggcttgttaataacgattccttctgtggccactgccagctttccgcaggcgaacgctcccaggctgccgggacggtcgggagccagaggtccctgttcagagaggacgatgcagtgggacatgggacaggggcgtgttggggagaggggtcccaccaggcagtgttggggcaggaagccgtcagcagccatcacctcgggcgggctgtgtctgccgcagcggcagcattgctaacacctggtggggcgcacgcccgcctgtccgcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaa

SEQ ID NO: 28807 - DNA, 1026 bp, Homo sapiens
tcctggggcgaatgctgcttcctctgcagcctgccacgggctgcccacgttcccctcaccagctcgggtgggctgctgagcgccggccgtctggccgctgtgaggagcgtggtttcctttgctcacatttgctctgccgccatttctcccgccgtgggccagtgtttcctggcagccctgtggttgctgtcctcctcggacctggttcccttttctgcctcctggggaccccgtgcccttgggattggactggttgtgtgttacatacggtgtttctctggagtcattttgaatttggccaaatttccctccagggtttctgctttgagtgtcagctgagagcgctttccccggccgagtccgtgaggtgctcctgggtgcactgaggttgcctgggcccccgctggaactgtgctgtgtggtgggagctgcagcccccgccctcctccagggagaccccccggcccaggaccctgtgcacagcagtccctcctgacctgcggcccatgccccgtccccagccagcccctgttgggtgcccttctgtggcatccagtcctgctgccccacgcctggccctgccctcgcgtcctgcctgccttcgggccttgcccaccttcccgcctccctgttcagagaagccgccctgaggccgtctggacgtagatttgggcgcagctgcctgcactctgcccattcagcctggaccccaaccaagacctgtggagagcagggccgacgctgggctcaggcagcaggaggctgtcctcgtgtcagagtcgtggccgcctgacagatgccacctccctgctgggaccgttgtgagggcccctcccccagcagccttgtaagtgggacgcaggtcacagctctgggcagagcctccctgctgtctgcctgccaaggctgaggaagagggagtaggggccgttgaggaggtgcagggagaggagcgggagggctctgggtggctgccaagggggagctctgcgctcagaccctcaactaagaccaggaggtgcctga

SEQ ID NO: 28808 - DNA, 1031 bp, Homo sapiens
ctgggctgatggtgccatgactgatgcgggatggactacttgctttcctatgctcttgcttaattagccctttccaggctgactcacccacaagccagccaagccaacagccagggctccagttcagggactagccctcagctgactggtgaagcctttgtgtttatttctctgtgttcttttaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatgga

SEQ ID NO: 28809 - DNA, 1031 bp, Homo sapiens
tgttttttttttttgagacagagtctctgtctcccaggctggagtccagtggcacaatctcagctcaccgcaagctctgcctcccggattcacgccattctcctgcctcagcctcccgagtagctgggactacaggcgcctgtcatcatgcccagctaattttttgtatttttagtagagacggggtttcaccatgttagccagggtggtctcaatctcctgacctcgtgatctgcccacctcgatctcccaaagtgctgggattacaaggcgtgagccactgcgcccggcagcagtttctcagttttaatttggagttttgcatctgtgttcatgagtgagcctgaaattttcacttttccatatcttatttctctgggttcctagaatgagctagagagtgttcctcctttctgttctctggaagagtttgtgtgagattagaatgagtgtgtctgataatttagttgcattcatttataaaattcctaggcctagagttttttttctgggaaaagtttacattttgactcatttttttagtagttttaggactgtttaggttctctatttcttgattgagccagttttgataagttaatctttctaatttgtagatattttctctaagtttgcaaatgtaatacataaaactttcttgtcatttctcaccatatctgtagttctatctttttattgctaatattactaatttgtactttgactatttgtatttgttacctgttgccgagtaacaatattagtacaaacctagtggcttagaacaacacacattgattacttcaccgtttctgtgtgtcagaagtccaggcgcggcctcgcaggtcgtcctctgcctcagggtctctccgggcttcagtcagggtgttagccaggaccggggtctcgcctgagcttccagtgaggaaggatctgcctctgagcacacagggtcctcggcacgatcccattcctcagctggaagctgccgactaccgtctgctgcggggcctctctagatggcatcttca

SEQ ID NO: 28810 - DNA, 1107 bp, Homo sapiens
gcagtgttcccataaagccgctaactcctcgcaccttccctcaagtttccccagtactaacatcttgcattcaagtggtgcgtttgcaacattcataaattattatcgtccagagtccattgtttacattcagcttcctcttcatgttgttcattctgtggtttcacagatgtgtgatgcacgtgcccaccactgcagtgtcacacaggatctcactgccccggagtcctctgcgctgtccccgcctccagaaccccttagtagcaaacactgatatttttactgtctccatagttttgccttttcagactgacctatttcacttagtaagaagcatttaagattcctgagtctctttctatggctcaatagcacatttctttttagtgctgaataatattccattgtctggatgtaccacagtttattcattcacctactaaggtgaatgtcttgcttgcttccaagttttggcaactatgaataaagttgctatcaatgttagcgtgcacataagttttcagctcatttgggtaaatgccaagaagcatgattgcgggatcctatggtaagagtgtgtttagttctgtaagaagctgccaaactgtatcttaagtggctgcaccatttgcgtttccaccagcaatgatgagcgttttgttgctccacatcctcaccagcatttgctgttgtgttttgggttttagcctttctaagaggtgtgtagtggtatctccttgtttcaatttgcaattccctaatgacattatgttaaaatcttgtcatatagttatttgccatctgtgtatctttttcagtgatgtgtcctttaaagtctttggctcatttttaaattaaattttcttattgttgagttttagttcttcatatattttggctgccagtcctttatcagatatgtctttcgcaaatattttctgcctgtgtcttgtcttttcattctattaacagtatcttttgcagagccagttttcatttcaaggaagtccagcttatcaatgttctctttcatgtatcatgtttttggtgttgtatctaaaaagttactgccaagcccaagggtacctagattttttcctgtgttat

SEQ ID NO: 28811 - DNA, 1047 bp, Homo sapiens
attattattccctagagccacatggcttggggtccacctgcctgggtcagcccccatccctgccccttctggctgtctgacctggcctggtgacttctcttctctgctcatctctctccctgcctgagtgggcaacagtacagcctcacagagtggtgggattgtgtgagatgccacagggaagcacatgtcagttgttgtcactgtgtagaacaatgagtcccggatgtggcccgcaggggagcaatggtgacttaatcgcgggcttcctctgcatttctttggtgacttccaagctagaacattctttttttgtttatttgtttgaagcagggtctcactctgttacctaggctggagtgcagtagcaaaatcatggctcaccacagtctcaaacttccgggctcaagcaatcctcccacctcagcctcctgagtagctgggactacaggtgcataccatcacctgtggctaattttttaaatgttttgtattttttaaatgttgctcaggctggtcttgaactgctgggctcaagcaatcctcccacctcggcctccccaaatgctgggattacagagtgagccaccacacccagccatttttaaaattttcaccaggaagttttttctttcatttttaagcacagtaagtatttgtgtattatgttacagatattttcccctcaatttctttgttctttttatctctttagggagtatgaacataagtttttaacttttaaatggttaaatatattagtgtgatttttatattaagattttattttatttattttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcct

SEQ ID NO: 28812 - DNA, 1015 bp, Homo sapiens
ggttagtcaggtggctcgggtaacagcagcgttctctccctcgggccttcggttgaacacagatgccgcgctatccagctgcctgttctcagcacctgggaggatttcagtctgggttattatgaagcatctactgtgaacactcttgtacttatcttttgggggcacctgggtacccatttctcatggtcacgtacctaggagtggcattgctgtgttagagggtacgttatagggtatgtgatttttgtaggttcttctttatcctatcacgattacatttttttacttttgttcaacctggtgtagactcaccttggtcacaatgcactgtcctttttatatattgctagattcaatttgaagaatattttgttaggattttagcaactctggttacaagagacgctggtctataatttttttttctttataatgtttttgtcaggttttcctgttaagatgatgctggacttagaaaagcagttggaaaatgcttttaaaatactctttggaagaatttatgtaatattcataatatttctgccttaaatgtttgggaaaaattaccggaaatgccagttgggcctggagatttctttgaggaaagtttttaaattagaagttcaatttctttctttctttctttctttcttttttttttgagatgggttctagctctctcactcaggctggagtgcggtgtaatttctttaatagtttataggactgagcagattttccatttttgtatcagtctggggagtcttcccatttccactcagctttacactgattcatgcaaagttgttcagtgtcctcttagatggctctgagcccaacgctgacatcctcctcttccttctgagaatcttatactgatcttttgaaaaaaaaaaaatcttagtctttgattctgtttttaaagagactttatttttggtttcatcaatttctattgtttgttattttctttctttcttaatttttttgagatggagtcttgctctgttgc

SEQ ID NO: 28813 - DNA, 1193 bp, Homo sapiens
tgtcctggctctgggggccctgtagaccgcagtcctgtccgactgggctgagcctgcgcccctctgtgcgtgtcagaagcccagacagtgttgccctgtgtcttgtggtctaaggagggttacgccctgcggtgcctgtcttctgtcccccacctgattcagtgtggaaatgtggagtctccagaggtgtcctgggtgtcacatttgggatggatacacgtgggcccagcactgcccgccccagggctacccttggtgccaggtgcccccagccacgagcttttacccagctggccttgagctccccagaggctccccggacactgtccgtgttttgtgaaaaggttttcaaaacacatgtaaagtggaggtgagtagcaagccctagagcaggccctggcctccctgcccctccctgtcccctccctgcccctccctgcccagcgctccctcagcaccgactcatcagtgcacctcaagctgatgagggcgtctgtgttttgacaaaattgctctgaggttgtcacacccaacaaacttatgacggttcctgagtgtagtcctcacgttgtggctggtgtttgtgaatcaggattcaggccaggcctgcacaggccttcagttgttggtctttgagctcctgttagtccagccgtctctcgtggtctcttttctcctcctggaaggtttgttcctgaagggcttcacattgcagatctgactggttgcttcttatgttccctgagtttttgtaaactggccaggccctgaggctcgatcccattgtgtttctttggcgagaatgcttttctggtggtccctgccttgtccctccagtgcacgatgtctggatgcctctgccacacaccaccccctgcccagtccccatgtctgtctggtcagtgcccagctctgtctcactagggtttggtcaccggccctttgaactgagaccaggctgtgtacctgtgagcccagctcggggtgagatttgaggtggagccttcccagccctgtgcagaattcccatcacctccaggtgtactcagaaatggggatcattggccaggtgcggtggctcacgcctgtaatccctacactttgggaggccaaggtgggcggatcacaaggtcaggagatagagaccatcctggctaacatggtgaaaccccgatgctactaaaaaatacaaa

SEQ ID NO: 28814 - DNA, 1033 bp, Homo sapiens
tttatatattttattatactggaacagctcgtgccctcggtctcttgccttggcaccaaggtggcttgccacccacagcctctcgagtagctgggattacagccatgtgccaccatgcctggctaatttttgtatttttggtagagacaggttttcaccttgttggtcaggctggtctcgaactcctgacctcgtgatcccccaccccccacccccagcctcccaaagtgctgggattacaggcgtgagccactgcacctggctgagttggagcttttcttccctctttttggactttggaaaatgctcttggtccatgatgctatgtagacagctcccattgactgtggcctgtgcggcattgggcagcactctggtgaacactgaatcgggtctgacctcctagccccaccatttactggctgagcctcagtttccttgcctgtaaaatcaggaagatgctggctctgctcctctctgcacatttccccgtcctaacaacattataactgttaggaaagagacgggcttgttttgggatggctcattttatgtgaccctgtgcgctgtctctgagttcatctgcccttcttccagggtgtagggaccagccccacagggtcggtgggtctctccctgtgtgcggcgatgagagagtgtagaaataaagacgcaagacaaagagataaaagacagctgggcccgggggaccactgccaccaatgcacggagaccagtagtggccccgaatgtctggctgtgctgttatttattggatacaaagcaaaaggggcagggtaaagagtgtgagtcatctccagtgataggtaaggtcacgtgggtcacgtgtccactggacagggggcccttccctgcctggcagccgaggcagagagaggagacacagagaaagacaacttatgccattatttctgcatatcagagacttttagtactttcactaattgactactgctatctagaaggcagagccaggtgtacaggatggaacatgaaggcggactaggagcgt

SEQ ID NO: 28815 - DNA, 1063 bp, Homo sapiens
cttaagtccaggagcttgagtccagcctgggcaacataaagagatctcatctctacagtacataattagccaggcatggtgctacatgcctgttgtcccagctactcaggaggctgagctggtaggatcacttgagcccaggagtttgaggctgcagtaagctccgatcataccactgcgttccagcctgggtgaaaaatgactgacactggaaattgttcatgatagaatacaaaggcaaacagtctatatacagataccagctgaatgtacgagctaaatgaggctggaaggatatacaaaggataatttttttccctctgtaaaaataaatgactactcagatgaggtttctaacatgatccagatctagtaccttcccagagataggtcgtggtttattgacatcccaaaactgttcagtttcttttttattcaaatagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtcagtctcccagtttttcataatgaaaagttgtttcccctgtgtgacctcttcaatattctcctatattcatgacctcctcagattgtcacccaccagcatatgctctgaggcagtttagagcttacatttccatgtataaaaggcgattcattctctcagcaaacttgcagtccttgatgtgccagacatcagtgatgcagagataaagtaagacacagggcctctgcctgctaagcccacccagcttacatccaggagagtcaggtacttatgtacataattctcagagaatgtgcatgaggcgtgggcctgaattggtagcaagga

SEQ ID NO: 28816 - DNA, 1013 bp, Homo sapiens
aaaattttaaaaaagcaaaggcttaaaaagtttttaagtatatatagaagattaatgaacaatagttaacttcctaatgctcaaatatttttgaatttattacatattgtttcaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacaggtgagaagaacgtatacatttggcatttacataagaattaaagattgagagaatggctggggaaaaaagtaatatcacgatttatcctatgatgttttgatgaccgacaaattattagctcaaattagaccttttcttaaactttatccatatcattgttaaagagacccaactgattttgagtttctgcctacgaaataaatgaagaatagaattgaaatattcttaagaactgaataagacctgtaactgtgtgctgatgtgtaattaagggcattaaggtgatgacagcagcttctgttggagcacatattgtctgagctttggcattacccagacctctcttctgggattaatttttcctgaggaaaactaatgaatgaggaaggtaagctcccagaagtcaagagcctcacccaagagtgttcaagtagtgagtggtcaggttgcttttcaaagccagatccaactggctccaaagcctaaggtctttttaccttaccattcttccttcagtggttaaagatgcaaaaacagagtttcaatcacagatatgtgccactgaacaggtaaaaactgtgctcctggactggctttaggaagtccttcaatagaggagaaaagcaaattaaaatgatgtactgtttccattcatcagtttggcaaatactttaaaaatattcataccctttgaattaccaattctaacctaaagaattctgacctaccagatattccccaaaaatt

SEQ ID NO: 28817 - DNA, 1035 bp, Homo sapiens
tgtaagcttgtctggactttgagtgatgcatggaccctgggagcctatttaacccaagtgtggaagtcacataattgtgtgactttaatcaaaggtcttgcacttaaatcagtgaatttaagcacatgccacctgtcgctgtttaaatattatttgtacctgtttttgtttttttgtgtgtgttttttttttttttgagacagggttggccaggctggcctctttatctgtttttgtattgttttctcagaggcgctgagtgaagatggtcagatatgtgtgtatttttttaaaaacgatttgaaaaaatatgatgttcctttgtcgtgggaacaagccaggttgcagacgcagaaggagctacagctgagagagggacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaat

SEQ ID NO: 28818 - DNA, 1093 bp, Homo sapiens
gtatgcccagctgtgcccttggaggcctgtctggagtacagtcagtatttagtgcacggagagctttggctgcacttgctctggggcagatcagtcactgctgatgcgtcccatggtgcatctctcctgatgatcttgatgctgttgcaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtttgtgaaggaagtctcgtttatgaagcagcattgtttaataaatgggtggaggccctgggtctgaggatggtccagtagtgttggggtcaggaatcactgagacagcaacccctgtggtgactgtccactgcaggactgggtggggtcagcacagtgagatatgttagcaggtgtgctgacagcagaatgcaagtgaccttcatctatgtctgtcttaaaggtctgatgctacaggacttggtttcagctaagctgatttcagattacactgttaccgagatccctgataccattaatgatctacaaggttcaactaaggtaaggtttcatcatttttaatggtctgtcaagatattttgttttttccccttttgctgtatcttgaattgagtgtatattagcgtttgcattgtctttttcttaagagacagggttttattgtcacccagtatagtggcatgatgatagctccctgcaacctcaaactacagggctcatgcaatcttcccacttcagtctcccaagtatatgggactactgtggtgtgccactgcgcctggcagcagttgtatgttttatacagataactttctaaaaacataagcagaaatcaaaataaaagataaaatttgcccacagtcctgctatctgcaaattaaattgttcatgtaaaatttttta

SEQ ID NO: 28819 - DNA, 1059 bp, Homo sapiens
tgagaacagtgagggggagttgtcacacacttaaccagatctcgtgagagctcactatcatgagaacagccagggggattccacccccatgatacaatcacttcccaccaggcccctcctccaacattggggattacagttcaacatgagatttgggtagggacacaaatccaaaccatattacttggcaacagtcttagaccaaaagcatttaagagttgattgttatttcaagctgtgttaaggtacattgatagacctgcttcattttagactcttcagtaagatagtttatagtctgtttactatagttccatttttttccccttaaagaaacttttggcattttaaaaaagaaaaaattgacatgatcttattttctgtaaccacatagcatacagaagtcatatttttaaagcaactacagtctctgtgtttttttgagacagggtcttgctttgttgtcacccaggctagagggcagtggtgtgataacagctcaccgcagccttgacctcctgggctcaactgatcttctcacctcagcctcctgagtagctggaactacaggcgtgtgccaccatgcctggttaatgttttttttttaaagatggggtttcactatgttgcccaagctggtcttgaactcctgggctcaagcaatctgcatgcttcagtctaccaaagttttgggattacaggcgtgagccaccacacccggcttacagtttatttttaaaatagctttattgaaatgttattcacataccataaacttcacccatttaaagtgtacatttcagtgatttttagatatattcacagggttttgcaaccatcactgttaataattccagaacaccttttcacttagaaagcctgtattcttttttttttttttagatggagtctcactctgtcgcccaggctggcgtgtggtacactttgttcactgcaacctccacctctcaggttcaagcaattttcctgcctcagcctcccaagtagctgggattacaggcgcacaccaccacgcccagcttagttttgtatatattt

SEQ ID NO: 28820 - DNA, 1037 bp, Homo sapiens
ccctcagcctgcattcctggccatgctgggcttggcctttatttagaacccatgtaggtgccacctcttgcctggcctcagggctccctggcctcccagtgggtggggactggggaggcagcctggagggcctagcaggcacaccgctggggcctcatgtcatgtcttgtcctcctcctggtcatcactggatgttccctctgaaaactgtcttgtgggtttcatttagccccatcaggttctgcgccggcagtggggtggcagtcccagcctgttggaggcatgctgtgaggccagggctgggcctggctcctctgacccatggctgccttcacatagtgacctggccttctcctggagtcatggcttcttgtgtcccccctccgtagctgcccttgtcagcctcagtctccttgtctgagccctccaccctgccccctcagcccagacctctgccctctgcccttctgcgcaccccctggtgatagccctgtcacccctgtctgtcactgacagcccccatcatgcatctccaactgaggcctcttccctgagttccagacttggtttccagttggcagttcaacctctaaacctgatttttccccaccctgccccttcctgctcataggatgccgtcctgtcctcctgcgcttagggcacaaacctgggcttgcatctctctcagacccagcaccgagggcatggcagttctctccacctcactggaatgttgctgcagcacctgtctgccagcttccaccctgggccccaatcgtgtcctcagcaccacaacagagggatcctccaacagctcagccaggtggcgttgcctctcggcggcgtccctagcgctccccgagtctctgcattgtggacccaacccctccctcgctgccctcactgctctccccaaacacaccaggtccagctatggcctggcatagccatgccctctgctgtttccagaagttgtcacgctggctccccctgtttccttcaggtctttgctcacatatcacctgaccaccctgagt

SEQ ID NO: 28821 - DNA, 1028 bp, Homo sapiens
aatatttcaaaattatattaaagtcagtgagtaatgtgaataacgcttttgtgctcattaccatccttatcaaaactcatctcatttcagtgcttgtagtttctcagctttagaggaccagaaaatcttgaaagatgaggggacgtgttcagaaatgaaaatgctctgaaggccttcctgggacgagggccctcagtgtggtgtttactttatagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaaggtatggcacttggtggcagaggttctaggggcctggtgaggtcgtcatcttgggtgccatcagggcaggagcaactcctttccattgggctctattgctgttgagtctcagagcctgtgatatgctgtgtctgatcttcatagtctgcctgtcttcttggagtgagtgttgcgtgtatgtgtacataaatgtgcaaatatgtttgctaatgtatgtataaaatagtagtgggaggatgcaaaagaatgggctcctgtctgtagagggagcgggattccgaggggcagaggttatggtggagtgctccgtcttggacagggcattcttacactgttacaatgttgaactgtgtgaatgtattacctactaaaaagtaagtattccattaacactaaaaatatatgcagggaccaaaaataaaaggaaaaaacacaggtacttctcttagccaatttttttctcttaaatttcagccgggctgggcatggtggctcacacctgtaatcccagcactttgggaggctgaggcatgagggaccacctgaggtcaggagttaaagactagcctggccaacatggcaaaacccccatctctacaataaataaataaataataaataag

SEQ ID NO: 28822 - DNA, 1046 bp, Homo sapiens
gttttctgtggtaagtggcatcccatgtgtgttattctgcagctcccttttgtgcttaattgtgacttcgcaaactttctgtctctgtatgtgtgatcagctggtgagaatcatctcaccaaatgccaacaaggccaagtttgtgagttctatgaagcaaagttgttaattaaaaaaaaggggccgggcgcggtggctcacgcctgtaatcccagcactttgggaggccaaggtgggcggatcacctgaggtcaggagatcaagaccatcctggctaacacggtgaaaccccgtctctactacaaatacaaaaaattagccggatgtggtggcgggcgcctgtagtcccagctgctcaggaggctgaggcaggagaatgcatgaaccctgaaggtggagattgcagtaagctgagatctcaccaccgcactccagcctggctgacagagcgagactctgtctcaaaaaaaaaaagggggaaagagcaaatacatgcttgtgagacaggtaagggagatgaatactgctgctgccgcagccagagaccatgcagttagcagacgtgtgggtggagaaatcactgtcgtgcaaaggacaggagctcctggtgcctttgaatggtctgttgtgcttactgcatttgagttttcaatcccatttcctttggtttcctgatatactcacacatggcggttgtggactgttttccaggcatctgcagccctggctagaaagaaggggaaaagtttgcataaagacatggctatcttttggcacaggaagaaaataagtgagttttcaattattcttttcactttttaaaaaaattatttttatttattttatagagatgagatctcgctatgttgcccagtctgatcttgggattacaggcatgagccattgtgcatggccctcttttcagtttctcatgctcttggtccaaaccctttgagcgtgagccctttccccagccagtggaggaggctggctctcagtggatttgcatctcacagttatttccttgggctcttctctaacctcct

SEQ ID NO: 28823 - DNA, 1407 bp, Homo sapiens
aaggaaacagggcctgggtggtttttcttctggaaatttctgcatctgtgtagctctgaaagggcattcctggctcaggtctacagtctggctgtgaagcccccatccccatcgagtcccagcccagatgaggaatgggttgcacaatttggggcgggggaggagcctcctctgggaggatgcttagaccctgccatcctgcctatcacatgggatccagccccagttaggaacagggcgggagtggaggtggggagcagcctgggctgcgtcctaagcagcaggtgcgtctgtggcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctgagtgtgagtcacagagaccctggccggggcaccctccacccccaggcttcctcagggctgtgggctgtggcgggactatggaagggagcagggagagaccctgccaccacccggagtggctacgcgagtgtggactgcaggctcctcctggggaagctgggcaggctcgctttctggtcacggggccattccagggggcatcccttgctccgggtcccctgcagtgaggggcctgtgaaccccaccagggcaacagcccctcccagggacccctcctttcctgtagggcggcgccggcccacctgggagcctcagatccccctcttccatcacggaggtaaagttgaggccgtggacgccaccagcctgatgaaataaagatttcatccagaaagagtttaagaaaatctcagctcaggagccagaacagaaaagatcaatagctttagccacatggaagtgtgaacatcctgatggggaaaataccacaaagtctaatttaataactagggacacctgtgtccacagctgtggcacagactcccactaaagaagtaggggtgcatggctcatgcctgtaatcccagcactttaagaggctgaggcaggaggatcacttgagctcaggaattcgagaccagcctgggtcacatagcaagaccccgtctctacaaaaaataaatttaaaaaactagccaggtgtggtgatatgcgcctgttatctcagcagctctgggggctgaggtgggaggattgcttgagcccaggagttagaagctgcagtgagctctgatggaaccactgcactatagcctggaccacagagcaggcccctgtctcaaaaataaaataaaaaagtgaaagaagcaagctgtgtatgacgtgatcccttttgagttaataaaaaaaaaaaagggagagtgctaatgctataaatgcagaaatctctacat

SEQ ID NO: 28824 - DNA, 1098 bp, Homo sapiens
tcatcactgtcgttgggtgtatcaataaatggttccttctaattgctgagtagtattgcattgtgtgaatatatcagtttgttatgcattcacctgttggtggatgtcttagtccattttctgttgctcagaatatctgaaactgagtaatttttttttttttttttgagacggagtcttgctcttttgcccaggcttgagtgaagtggcgcaatctcggctcacttcaacctctgcccaccgggttcaagcgattctcctgcctcagcctcccaagtagctgggattacaggcgcctgccaccatgcctggctaatttttgtggtttttagtagagacggggtttcaccatgttgaccaggctggtatcaaattcctgacctcagatgatctgcctgcctcggcctcctaaagtattgggattacaggcgtgagccaccaggcctggccttcggttaatttttgcatttttagtagagacgggatttcgccatgttggccagactggtctcgaactcctgacctcaggtgatccacccacctcagcctcccaaagtactaggattacaggcgtgagccactgcgcctggccaaatctgggtaatttatagagaaaagaaattcatttcttacagttatagagactggggagtgcaaggttcgggggcacatctggtgagagccttcttgctgttggggactctgcagagtctggaggcatcacgtggcaagggggctgagtgtgctgatggctagctcaggtcactcttcctcttattataaagccaccatttctcctcccatgataacacattaacccatgaaatcattaatccattatctcatgtatgcattaatccattcataaaggcagagccctcatgatccaagtaccccttacaggccccacctctcaatactgccacattgaggattaagttccaaccatagcaatgagaggccccacctctcaatactgccacattgaggattaagttccaaccacagtaatgaacatttgggttgcttcttgttttcgcttatggccaacaaagctgtcgtggacattcctgcctcagtctttctgtggatgtatgc

SEQ ID NO: 28825 - DNA, 1081 bp, Homo sapiens
gcagggccttccgacatgggtgcagtaccatccagtccgagtgcttgcagcgacagcctctacgcgttccttggtaagcaagcaggttcttccctccaggaaatgaggaccggccggacgatgccctgcagactgctctgaagagaaggagggaccttctgcagagactccgggtaggccctgcaccctctgagcgaacctggctgagctcactgtagcagagatagctgctcagccttaaggcaccaggtcggggagtattagggaagacctttccagactctcagggccaggccccagcaaggacactgttagcttagagacctgcctgggtgcaggtttccatcaggactggaaatgttgagtaagggcccaattccaggaggacctgaaattctgggatgcctggaggtttgctcccacggcactcaccaaagatgcatccgagtggcagagatgcaggggaggtggggccgcttttctagggggagacctagaaaaaagtaggcctggaactggcttgaaagagagaacagaccctggggctggaaaaagaaaacaactggaaactagctgacacgcttgggtcaatttcaggaggccaccctcatgcacataaccctggaagggtcttccagtcatggccatcctgcccggagaggcgcctgtacctggcccaggctggcctgagcctgatgctgggggtgcctctgtggcgttggggctccccgtccccgtgtgcagcagctctgcatcggccttgcaggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtaagagggcgaagtcgaggagcacatctgagagtgggaggcgggtgcggaattaagattttacagaaggcaggaggcgctgtgcctgcagcgaggttgcctcgtcacccccatcctcccaaggcccacccttgaagggggccagctgcc

SEQ ID NO: 28826 - DNA, 1031 bp, Homo sapiens
gcccctctgcctcagctgctgcccacttttttgccttcccatgaagcccagctggccacacctggggatgagtgtttaccggtagcctgaggacgcacagtggaaacctggcaacctggggcctccctgtgtctggcagcctggcaactgtcacgcggcgcccagcgctggcttctggggcactgcagtccagggagggtgtggctatcttcccacagggctcttctcttccctcaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacaggtgaggcagagcccgggatgctcctgtttttaacaactcgcaggctgtggcgttggagggactcttcgagacagccctgcaggtgcagaatgcagggccccaagggctaggcctggggctggcagcccagcggacccatcctcagacttagtcttcacattctctgagggtctgggtggcccatgaccgacctgcctgtcctcgcaggccactgagcacagggtctggggagcctcggtgcctgggggcacctctgcaccccctgcctgcattgttccctctcctgctgcctgagggacctgctgcccacctttcgccagccctgcatcctggcccacaggccgccatgagagggactcacccctggacacacccagcaggtagctgctcagctcagggttcaggtggggggtgatctaggcatgcactggctgggaagcctggaggcctcaccagtgaggtgtctcccagggttgctcttcagaaatctgcctgaagggaccactcagagcatccgcccctagacttgtggatggaacacatgaatttgctagaggtcaggcttacagaggcagctcagggaga

SEQ ID NO: 28827 - DNA, 1658 bp, Homo sapiens
acatatgtagcacactaaggtaagatgttaataagaggggaagccacacatgtggtatgtgggatctccatgtactatcttctcaattactctaaatctaaaactgttcttaaaaaccctatttaaaaaaaaagtctgacaaatccatgccctctggagcatgttatgtatactactagagatcccgaggaggcaattcttagtgcttcccattcacttggcagtcacagctgtgggcacacaggctcaagtctctccttaagtcagtcagtattacaaaccatacataatagtatacttgaccactgcataaatgttataaacattccacatcaagagaaagaggagaggaaaaaaagttaaccagttcaacgaaaaggagaatctggcaaggaagcatctctgatgtgggcagagcctgcagcagcagatgtggagggcttctcacaagtgacagcaagactgtctgtaaaacggccactttgacctggtggtgttctgctcttttcatggccatagagtactctggtaaggactgatagtaagagtgtcttgtttatgtctttatctgggtgggtgcagtatctactgatgaggaaacatctggtccctgttggcctgataccctttttttttttttttttttttttttgaggtggagttacactcttgttgcccaggatggagtgcagtagtggtgccaccttggctcactgcaacttccgcctgcctggccctatcttataatttaaaaggcatcaggggccaggtgctatggctcacacctctaatcctagcactttgggaggccaagacggcagatcacttgaggtcaggagttcgagaccagtctggccaacatggtgaaaccccatctctaccaaaaatacaaagattaactgggcgtggtggcgtgcacctgtactcccagctactcgggaggctgaggcaggagaatcacttgaacccgggaggcggaggttgcagtgagctgagatggctccacctctgcactccagcctgggcaacgagcaaaactccatctcaaaaaaaaatacataagatggagtccttttctcagatgaggtcacttatatcaagggtgctctatacagttgcttaactaaattaacctggtttttgttctgtgcacactcagagctgtttaaatgtctcccaagactgtcactgttaatgactgtggacaagagccaggttcttttattatcttgtttatttatttttttattttttttattttttttccagacggaggttttgctcttgttgcccaggctggagtgctgtggcgcaatcttgggtcactgcaaactctgccttccgatttcaagcaattctcctgcctcagcctcccgagtagctgggattacaggcgcctaccacgacgcctggctaattttttgtatttttagtagagacggggtttcaccatgttggccaggttgtctcgacctcctgacctcgtgatctgcctgcctcagcctccctaagtgctgggattacaggcatgagccaccgcacctggcccttttttattattttttatagagatggggtcttgttgtgttgtgccggctggtctccaactcgtggactcaagtgatccttctgccttggcctcccaaagcactgagatt

SEQ ID NO: 28828 - DNA, 1097 bp, Homo sapiens
ttacgtgttacaatacatttacaactgtgggactgaggggatgtgcccaggtttgcctagactgtgttcctcagaaccccagagtcgtttctgtggacatcctagagaggttctgctaatgttggacttgggtcttatttcagttcttttttcttttcttttttataggcagggtctcagtctgtcacacaggctagagtgcagtggtgagaccaccgctcattgcagcctcaacttccccgggctcaggtgattctccatgtcagcctcctgagcagctggaattacaggcacaccaccatgcccagctaatttttgtatttttagtagacacagggtctcactgtgttgcccaggctggtcttgaactcctgggctcaagtgatccacctgccttggcctctcaaagtgctggagttacaggcatgagcaacctcgcccagcctcaattcattttaaactattaaaaagctgtcaaggccaggcaaccactgcactccaacctgggtgacagactgagaccctaactcaaaaaaaaaaaaaaaaaaaagctgcccagataaattttgtagatactcaccctcaaggagggaaacgtaactcccctctccttaagtgtagaccacacatagccacttcctcccaaagagtgcaataaagaaaaggagggaaagagccactttattgtggagaaaactggcagactccacctcagccaagtgacgcaggtcagcctcacagttatagtcgaggtgacagtgtgtgtccctgatgtgatggggtgacagtggcacttcacccctagatgcttcctttctgtaacctgcagtcccagtctaaccaggagataatagacacattttaattgagggacattcttcaaaatatctgcccagtactcttcgaaactgtcaaggtcatcaaaaacgaggaaagtctgagaaggagcctaaagacacataactcaatgtaatggggtgttctgatggataccacattagggacatgaggcaaacctaaggaaactgtcaaagtgtggacttcagttacttgtgtctcaatattggttcattaatcataacaaatgggccaggtgc

SEQ ID NO: 28829 - DNA, 1057 bp, Homo sapiens
gctttgtgtccaccaggacagcgggccgggctccctgcaggcgcgggcggcgccgaacggtgctcagcaaccacccggacagggccaggccgttttctcccgctcaggcattagtcgttggctgtgggccgccgcgggaagttgaggcctaccacggaggaggctgctgaggtggatctcaggggatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaaaagaaaaggtttttagtagacagaagagaaatggggccgtgggttcgtggtcccagggggaaactgacgtcgcatgaggtcgtcgtccctcagcttgagctcagcggaacataagcttgcagaggtggaaaccacggaaggtttgggtgtcttggagctctctggacaccgaagcccggacacagtcccggggtccgcaccgcctgtgacctgtggcgggaccgccggggtgggcgttttctcagctggcgcgcgcgtaggtggaacttgggaaactaactggagcgaagtggcaaaaaaccaagacagggccggtgacctcgcgcaggccgtccttaactgtggagtattccttcagctaacccctttatttcatgtgtccaagtctggtttctgggtttctttgtagtcctccgggcctgttcgtgcgccttcacttgcaaaaggttcgtcgtggagggccgtgtgcttgtttgcagcagtaacgatgcccttcccgagcgtgctggagtggctcctcgctgacgcaagctcaccttgcagcctcctcagcaactgcaacttaaacgcgccctcaggaagccctggaatctcgctcagaattttttttctttttttg

SEQ ID NO: 28830 - DNA, 1035 bp, Homo sapiens
ctgagccctggaagtcagggctgtagtgagctgtgactgcactccagcctgggcaacaggagtgagactctgtcttttaaaaaaaaaaaagaaagaaaagaaaagcccgtcatacatgggttggagatacctgggtagatgccttcaaaggttttgactccccaaactgccttaaacctttttttcgtagacagtgtctcactctgttgcccaggctggagtgcagttgctggatcatggcccactgtagcctcaacttcctgggctcaaacgatcctcccacctgagcctcctaagtaactgggactacaggtatgtgtcaccacacctggatacattttttattacttgtagaggcaaggtcttgctatgttgcccgggcttgtctcaaacttctaggctccagtgagccatcacacctggcctgccttgaacctgaagcctgccggggtggctcacctctcctattaacctgacactactcctcctccctccacttactgctcagtagatgtataattatggttgtttcttttgcattattcagctggaaacaatgagatagaaaagagaatatagctccctccccctcagaagaactgcgttattagtttgctggggcttcagtaacaaactgggcagacatttattgtctcccagttctggaggctagaagtctgagatcaaagttttcacagggttggttccttctggggctgggagggagaatctgtctcatgcctctctcccagcttctggtggtttgctggcagtctttggttccttggcttatagaggcattgtcccagtcctgcctttatattcacatggtgatcttgttgtgtgtgtctctccagacgaaggcataagtaacatcattgacaaaggtcattcgacatgggcctctttttagaaggacaccagtcatactgattagggcccactctaatgagcgcatcttaacttgtctacaaagacccatttccaaataatgtcacattcacattgaccaggggttagggcttcagcatcttt

SEQ ID NO: 28831 - DNA, 1047 bp, Homo sapiens
gcatgagccaccatgcccagccagtaatgagattgaaaaagtttatttttaaggagctcaatggttaaaagcttaattaaaagctaacatccaacatatgtgtgttgtgtgcctgtgtgtgtgtgtttgtatttaaaaggcttccagttttgttttttttgtttttttctctcctaggaccttgtctttttgagcaaaagtttttttcttcttagttgactggcttctgttttcttcatttacttttgtcgtgtcttctttctcttgcaccctctgcttcatgggaaacctaatatagtttgtaatacccagggttccttacagaaaacggagaaggtgccagattccccttggaggagaaacctctgtttccttatggaaccccaaatgtgtaaacagacaagttcatctcagctttttttttttttcatctcagctcttaaactgcttgcttttgtattgtgttacctaatttttttactaaaatagttactgcaacagaggctactctggagttcttaaggaatagtatagtttagacatgtagaaatgtctttgttgaaaaaagttttttaagtgcactgtaaaagcatgatgtagtctaacctcataataattttcgctttttggagacccaggattcagtgtagggtctgcccagagctcagagatccagttaaaatatagggagtctctgtctaaataaaactggtctccttatacaatcctatgatagattttcataattttatgtttgatttcacatccatttttaatctctctttagcaccaccagactttttcctctctgtaccttaaaatgtaaattttgctatctaatttttcatctaatagtttcctttaatatgcagatttagggctatttagccggcaactgccagggcaatgacacagatgatcaagagtttgcaagtctaagatagaaaaaaaaaaagaggtcttaggaatctataagatgtacttctatcggtatacctaatacatctatgtatttatgtgttgcgtacacaatgtttctctattaaa

SEQ ID NO: 28832 - DNA, 1047 bp, Homo sapiens
ttggagttgatctcgccaccattatccccccgggcgagcgcggaggacgggctggccattctggccaggccggaggtgttttccagcccggggctttgtgataactgggccgaaacccgagggtcctggagcgcggcgggtggcgggagcttgcggagcgcggcgcactcggcggccaggcatcggccagcccagcggcagccccctttctcctatttttatttttatttttggaaggagctgagaattagtcgattggttggcaggttgaattgccttctcttctatggcaatatgtgtcgtgacttttcaccttttgcctttggacaaaggtgaatggcaactgcgttggtcagtttttgttttctgttctgcggatgggttcgccgacgcagtaatcaaaattagagccactcttttggaagagcaaatcgttgttgttgcctccccagccccacggatcttactttgtgccattttcgggttgattttaactcgtttatttcagagctctttgcctcacctttatttttagatttagtcgtgtttgctgaaatatcagttgcttcttctgtgaatgaagtgtgggaacttgctctcgtcgcagttaatgaaatcaggaaaataaaaagatcaaaagggttggggatgggagaatgaagaggaatgtagacagatagtctagggccactcactggcttttggcgattcttagttccttaagctgattaaaacaatgtgaggaaatgtgggcttctccactttttaggaagaggtaataacgggcattttacgtggcgccacagcgtttgttttcaaagtttgaacgtgaatgtagcaagcataattttattaatgaaaatattctttagacaactgttaatattgacgaaagaagagaaacagagacacggaagctaaagagttgggaatcctaaaggtcaaaggatgtttctcagttactctgatgtcctgtgttttctttcagttggtacaaaatcgtgagtagtttaattatatcctgcagtcaaaatggtggctgtggtg

SEQ ID NO: 28833 - DNA, 1022 bp, Homo sapiens
agctagatcttctggataacttgctgcagcttctgtatccacacttgaggccttgtcttgcatgtttacgttacatttcctaaagcttcacgaaccaacctctgctagcctccaacttttcttctgcagtttcctcacctttctaagccttcgtagaattgaagcgtaagggccttgctctggattaggctttggcttcagggaatgttgtggctgctttgatctgttctccaggccactcagactttctccttatcagtaataaggctgttttgccttctcattactgtgttcactggagcagtgctttttatttccttcaataacttttcctttgcattcacaacttggctaactggctcaagaggcctagcttttggcctgtttcagctttcagcacgccttcttcatgaagcttaatcatttctagcttttgatttaaagtgagagacatggtgctcttccttacacttgaacacttaaaggccattgtaggattattaattggcctggtttaaatgtgcttctgggaatagggaagcccaaggagagggagacagggaactggccagtctgtggagcagacagaacacacgcatttatcaattgagtttgctgttttatgtgggcacaatccttggtgccccaaaacatttacagttgtaatatccaagatcactagtcacagatcaacataacagatttaataataatcatgaaaatgtttgaaatattgtgagaattaccaaaatgcaacacagagacatgaagtgagcacatactgttggaaaaatggccctgatagacttgctactcgcagggtcggcacgaaatcttcagtttgtaagaaatgcaatatctgcacgttcagtaaagggaaacacagtacaacgaggtgggcctgtattagagcggaaggggcatgaaccgctgatggtagtggtaacaggaaaggacatttctcactggtgctattgaagaaagagtaggtgggactggatgacccccagggtgggagcatg

SEQ ID NO: 28834 - DNA, 1119 bp, Homo sapiens
tttatgttctgtgttatgtttaataacaggttccccatgccagagggagttacagctcaacagaaagccttcttttgtctcatttctccactggttctacagaaattttcagaggttatctggcagctgtacctgcccctccttgcccttgtcaagcaaatctatatcttggccagtaatctataacacatctcgcaagaaaagatgaactgggccaatgaaatttccattcttgggagcgtaacctaggaaatacaaggattatcgagttagcgtggaaaagaagctgaaaggtcatggtgagcagccacgacacagccagaatcttacagatgaggaagcaagcctgggagagacccagccatagaggaattaacgagaaggccccggctccagcctgctggcgtgtgtccagcaggagccaccacacctgagggagtcttccatgccctgcccctcaaagagcctaacacttcctcacttttgtctgtgtgcacataacatgttaagtatcttgtaaacacaagatcgtacttttctatatgcttctgaatcctgttctattctgttgacagtgttatataacagaatgccctttcaatcacagcacgccatgatttccagtagctgcagaatactcatcgggtagagggactctcatttagccaaggggcgtttgggttatctgtagttgtttactatcatgacaaccaagaaccagaacaatttttttttctaagataggattagtgtttttaatcattagacttctgttagtattacattctatatttgaggttttaagttttgagttttttttttgtttgttttttgttttgtcccgagagggagtctgtctctgtcgcccaggctggagtgcagtggtgccatctgggctcgctgtaacctctgcctcccaggttcaagtaattctcctgcttcagcctcccaagtagctggaactacaggcacgctccaccatgcctggctgatgtttatatttttagtagagacgggtttcaccaagttggccaggctggtctcaaactcctgacctcaggtgatccgcccgcctcagcctcccaacgtgctgggattacaggcatgagccaccgcgcc

SEQ ID NO: 28835 - DNA, 1050 bp, Homo sapiens
ccagattcctttttacaagttggcgtgcagttttcatccataaagtttaagcgtttgattctaaaccaggtgtttttattttgttttgttttgttttgttttttgagacaggtcttggtctgttgccgaaagtggagtgcagtggcaccatcatagctcagcagcctcaacctcgccggtcccaaagtgcttgaatgacaggcgtgagccaccactcctgacccaaaaccatttgtttttaatatctgataaaaatataatttataaaaagactttgatttttttaactttgaaaattaatctaaaggagatgaacactgataaacaatgttcagaaagtgaaattactttttaaagcttcagctttttaaagcttttcctattttattttgagaattttcagatgttcggtgaagttcaaagataagtgaacccctgcgtaccctttactctagatgtaccaattgttaacacttttgccacattggctgaaccatttgaaagtaagtcgactgtgtcatgagagtctaccccttcatagtttcacatgtacatgtacttcctatgaataaggactttctcttgtatgaccacaatgttatactcacatttaggaaaattaacagtaattctgtaataacatccagtaaacagttcacactgaaatatcctcagttgtccccacagtgtcttttatagatgtaccacacctccatcctggtttacacactggttggttggtaggggaattgtttttaggcaggctgaagccaacccagttatcctagatgtagggaaaccgggaaacattggtaaaatgatttaaatttcaagctgcagggctactagtgaagtaattacaacagagagttgattggaatcactctggctccggtccaggctttgcccaaggtctggacctgtcacttagccctgttgagcctcagcttgttcatctgcatcttggttgtctcgtgttccatagggctgtggtgaggttcgaatgagccaagcatgtgagggcctggcccaaatagatctcagcaactg

SEQ ID NO: 28836 - DNA, 1089 bp, Homo sapiens
ctgtaaataccttgctgcttatccaggtaattgggatctcacttgcctgtgtatagtttgttggcaggatcccaggagagtcttttttgtttgttttgagacagggtctccctctgttgcaggctggagtgcagtggcataatctcttgctcactgcagcctcaacctcatgggctcaagcagtcctctggcctcagcctccttagtagctgggactacaggcgcatgccaccgtggctggctaattttttgacttttgttgttgttgttgtttggtagagatgagatctcactatgttgctcagactggtcttgaactcctgggctcaggagattctcctgccttggccttccaaagtgctgggattacaggtgtgagccaccgcgaccagtccccaggggagtcttattcttgcaggattttctaaagacttcttctagaacaagtgtgactacaattcagaatcttcatctcccctaaagaaagagtgttccagaggtgaggagggacgggtgacagaaactggtagctgaagaggtttgttgatggattagtctatttattcataatgcttgatatcagaagaccagaagaatatttttgcaacttattttaaaaaacagctttactgaggtataactgacataatctactgcaaatatttatgtgtacaatttggcaagttttgacatatatatacacactagtgaaaccattaccacgtcaagacgaacatgtccgccaacgccacgcgagggtgtgatatccttgtgtccctttgtaatctctttgcccccgtctcaccccaacctgtgtttctctcagggtgacccccccaatctgctttctgttactgtatgttagtttacatttcctagacttttacatgagatatacgctcttttgatgttgttcctgttcgttctactcagtgtaaatggagattcattcattctgtagcatgcgtcagtagttgattcctttttattgttgagtactatgccagttgagggatagatagtactatagtttgtttattgagtgcacctattggcaaaaatttgtgtaccattctttagacacatgcc

SEQ ID NO: 28837 - DNA, 1083 bp, Homo sapiens
ttgggaggccgaggcagaagaatctcttgaacccatgaggtggaggttgcagtgagccgagatcgtgccactgcactccggcctggatgacagtgcgagactctgtccccatccccccgacccccccgccaaaaaaaaaaaaaaaaagactatcctttattagttgcccaagtcagttttccatatacatgtgggttcatttctggaccctgttccttttttttttttttttttttttttttttttttttttgagacggagtctcgctctgtcgcccaggctggagtgcagtggcgggatctcggctcactgcaagctccgcctctcgggttcacgccattctcctgcctcagcctccccagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccctggaccctgttctatgtcattgttcactctgttctgttttcaagacaatatcacagtatcttaattagtgcagcttttaataagtagtgaaatcaaataatgttagtcctctcactttgttcattttcaaagttgctttggctattttatattttttatatttccatatgaattttagaattagcttatcagtttctacaaaaaaagcctgctagcatttagattggagttgtattgaatatctaggtcaatttgtagaaaatgggcctcttaacactattgagtcttctgacccatgatgatggtacctctctctctctaggttttctttgatttctgacagaaaagttttatattcaaattctcaactctttaggtatctcccatcttttgtcagatttatcccaaagtatttcattctttttgatgctattatacatttttgaaagttttaggccaggcatggtgactcacacctgtaatcccagcactttgggaagctgaggcaggcggatcacctgaggtcaggagttcaagaccagcctggcc

SEQ ID NO: 28838 - DNA, 1022 bp, Homo sapiens
gtccatcagttcctgctgtccaatccagtgtgaaagatccatctgggcctcccttgagtgcaagaatgtgatgtaatgggcctgggatgtgcaagctgggtttcactgaaagtaattatcaggctgggtcggatagatttggcaatgttagatataagatacaagatgggaagaactcaagacttgggttaggcagatccttaatataggacctatcttcccatttatctggtaaaatccagacccttggcaccttggtccttgtttttgttttttattaaaatatcttacataaatctcagaatttaaaacagtacctttctctttcaaaaaaattattgtaaacattttaggaaattgagagaagcaaaaagaaaataattataattacttcgagcctatataggtctacctatgtatatatacagatacatgtaaaatgtatcatatgatatatatttttatggctttttaaaggtaatatataataaatgtttttcatgttaatatgtagatctgatgtcactgtaattcagatatggccatgctgtcacttatgccctgttgtcggacgtcaaggttttttccaatcttaaatggactaacagtgctaagatgacatctctgtgtaagtgtatacatgactctttccttaggatgtaactttatagtggagtgtgtaatctcaaagtcacgtactggtaaatttctaaaatattctaatggcgagtattctctaatatcatggctaatattctcaaaacttgccttatttcttctgcatgtcaaataaacaatgatccttagctgtggctgcagttctgtttactataactagaaaagactggggaagggtcatttctatttgttgagtctggttcgcaaaatacagtaatagaagttgtcaccattgataatgtgattcagtccagttggtaaagtcattctgctgcttacagttgcgcgtcattttcagtttctagctcttctttccttgttcattccccgccccacccccacac

SEQ ID NO: 28839 - DNA, 1078 bp, Homo sapiens
tgatcacaacagtgcctcgtctgtgagtgccctgtctctatagttcttgtgcatgctgcatggtcgagtgctcacaacttaaagggaatcttggtgaacctgacagtgttgatgtttgagtattgatcataaccctgttcatccatacacattttgctagcttctgaatgctgtatctgtttttgctaaagctggggtaaaaaagaaaactctgaaatttgagtgcccatttaatcaggcatttaatatatcttatttcatttagctcttacaactctgatgtatgtaggattgctgtttcttttacaggtcaagaaactgaaacttacagtaattaattgaactggtcttgaggatatttggttttgagctatttcaaatgaagacaatactactcacctcacaaggttgatgggaggattatagtgtctgtgcaaaacatgagtcatagtgcctgacacagaagttattgtacatacatgtttcctgttctcagtaaatttatggtctagaacactcttcaaaacatatattttgtttgaacttcatcggctctaaaagtgatccattccatctggagctatggcataaaattatttgcatgtagatcttgaataactaccagcagttccttgcttttatatactactgtttcacctgaattcaataaattaaaataggagcaaagaaaactatatttatattttgaatttatattttgaacagtatcattggagcatgacttaaaatggaaaaaaaaagactaaagtggtaattcttattgatgcgtgttgtaacatcaaacacgttttctagtatccctcgtattttttttttgggaggggcgcggcttattgagatattcacaaaccgtacaattaactcatttgaagtatacagttcagtggttttagtatatttagagtgcgcagccatgaccacagtcaattttagaacattttcaacaccccaaacctttcagcaggcacactccactcacgtttttccccatcctctggaaaccactgagctttgtgcctgtatggattttgcccactcttgacatttcctgtaagtg

SEQ ID NO: 28840 - DNA, 1020 bp, Homo sapiens
agagtttcatgtagtacatgtttatgtctctaatccttgttaatctcatttgctccctatctggtcaggttatttaattggaatttatatttactagtttgtttgtttgagacagaatttctcgctcttgttgcccaggctggagtgcagtggcactatctctgttcatcacaacctccgcccccgcgggttcaagcgattctcctgtctcaacctcctgagtagctggaattacagacatacgccaccacgcctggctaattttgtatttttactagagacggggtttctccacgttggtcaggctggtctggaactgctgacctcaggtgatccacccgcctcggcctcccaaagtactgggattacaggcgtgagccactgcgcctggcctatatttactagttttgtcttgctctctgtctaggcctttctgaactaatagggtcttggaatctagctcaattctattttcttgtgtgtgatatttttgcaattcattcataatacctttcgttaataaaattctatcattttgtaaaattttttgagctatagcctatttcttgtcaggaactcttcactgaggcataagctccccaagggcagggagctttctccattttgtccactgtatccccaacagctagacggttgccttgcacatgagtgctcagtaaacatttgttaagtataaacatccatttaccatatgacccagcggttacacttttggggcatttatgccaaaggaaaaacctgtagatgaatacacatagcgattttatttgctgtacctctcaagttgcaaaaacccagatgtccttcagttggtgaatgcttaacaaaagcatggtacagccattccatagactactcctcagcaataaaaagagatgaagtattgattcatgcaaaaactgggagacatttcaaggaaattgtgctgagtgaaagaaagctaatcttaaaagcttatatatgatattatttcatttacatataacatcattgaaataa

SEQ ID NO: 28841 - DNA, 1030 bp, Homo sapiens
cagcctgggctacaagagcaaaactccattaaaaaaaaaaaaaaaacgggtgtggtggctcacgcctgtaatcccagcacttcgggaggccgaggcgggtggatcatgaggtcaggaaatcgagaccatcctggctaacacagtgaaaccctgtctctactaaaaatacaaaaaattagctgggcgtggtggcaggcgcctgtagtcccagctactcgggaggctgaggcaggagaatggcgtgaacctgggaggcggagcttgcagtgagccaagatcgcaccactgcactccagcctgggtgacagagcaagactctgtctcaaaaaaaaaaaaaaaaaaaaaaaaggtatttacacctggatgtggtaagacgcacttatagtccagatgctctggagaccaaggtgggaggattgcttgagctcaggagtttgagtccagcctggacaatatagtgagaccccatatgggaaaaaatatatttaacacaattatagggtttccagactgtactgaagaaaaaatttaaattgccatctaggtgtcttaaatgttctctgcagaaaaactatcttcaaattttaatatacagacatgggaggattgcttgagccctggagttcaagaccagcctgggcaacatgctgagaccccatctctgaaaaatcaaagaaaggacgggcacggtggctcacgcctgtaatcccagcactttgtgaggacgaggcgggtggatcacgaggtcaggagatcgagaccatcctggttaacacagtgaaacccggtctctactaaaattacaaaaagaaattagccgggcatggtggtgggcgcctctagtcccagctactcgggaggctgaggcaggagaatggcatgaacccgggaggtggagcttgcagtgagctgacatcgagccactgcactccagcctgggtgacagagcgagactctgtctcaaaaaaaaaaagaaagaaagaaaaatcaaagaaaaaaaatttagaatgcagtgttcatgccttaaagt

SEQ ID NO: 28842 - DNA, 1126 bp, Homo sapiens
tcagaactagatcttttcactagtgccctgtttactggggacagtgtaatagacaccttaacgttggagtgaataaccagcttctcaaagagaggtctttttaatgtcagtgcttcatgacacaatggtttccttataggtttactacatactggtttcctacctagattttaattttgtaatccaaataacataaaaatgggaggcacataccagtttgcacagtgtagttgaggcagggtagactcagcaaagactcaaaatcaaaaccatttctgtcaatatatttaatcatttctagactgtgaatatctatcttgttaaattcacagtagttatatttgtattgcctttagacattacatttttttttagttgttaacaatgactttaacaggaaaaccagaagtatacattgtcaactttaaagtcaaaaagaggccattgtggcggctcatgcctgtaatcccagcactttgggaggtcgaggtggatggatcacttgaggtcgggagttcgagaccagcctggccaacattgtgaaaccccatctctactaaaaatacaaaaattacctgggcgtggtggcaggcacctgtaatcccaactactcgggaggctgaggcaggagaatcacttgaatccaggaggcggaggctgcagtgagctgagatggtgcccctgaactccggcctggacaacagagcaggactctgcctctaaataaataaataaataaataaataaataaaatttaaaagtaggccaggtgcagtggctcacacctgtaatcccagcactttgggagttcgaagcaggcagatcacttgagctcaggaattagagcccagcctggacaacatggcaaaaccctgtctctacgaaaaatacaaaagtttagctggatgtgctggtacacacctgtagtcccagctacttggggggtgctgagatgggaagatggcttgagcccaggaggtgtaggttacagtgagctgagatggcaccactgcactccagcctggacaatagagccagacgttgtctcaaaaaaaataaaattaagtaataggtctcttttttgagttccttattttattttttttatttttatttatttatttat

SEQ ID NO: 28843 - DNA, 1055 bp, Homo sapiens
cccggcttttttttttttttttttttttttaaggacaagctctctcactttgtcgcccagactggaatgcagtagtgtggtcacagctcactgtagcctcgatttgccaggctcatgtgatcctctcatctcaacctcccaagtagctggggacacaggctcgtgccaccacacccagctaattattttttattttttgtagagacgaggtcttgctctgctgcctaggcttgtcccaaactcctagcctcaatctatccttctgtcttggcttcccaaagtgctgggattataggcatgagccactgtgcccagcttttattgctttaagacagggtcttgctctatttcccaagctggagtacagtggtgcagtcatagctcactgcagcctcaatctcccaggccgaagtgatcctctcgagtagctgggcctgcaggcacatgccaccacgcctggctaatcttttaattttatctgtgcgtagggtttccctatgttgcctgggctggtcctgaactcctgggctgaagcactcttcctgtcttggcctcccaaagtgctgggattacaggtgtgagccaccacacctggccccctctctacttccttacccatttaaatactactctctcaaaagccttacttaaatgtcactacgtccatgaactgtccttgtttcccccagccttttgtcgcttaacatgtttctttatgcttattttatatctttgtgagttcaggcttcttcatctcaaggaccatgtcttatctttttaacagccacgacacttaatgtcatttcttttcatgtttttttgtttgtttgtttgtttgttttgagacagagactcgctctgtcactcagggtggagtgcagtggcacaatcttggccccccgcagcctccacctcctgggttcaagcgattctcatgcctcagcctcccaagtagctgggactataggcgtgcgccaccatgcctggctaatgtttttatatttttagtagagatggggtttcgctgtgttggccaggctggtcttgactcctgg

SEQ ID NO: 28844 - DNA, 1027 bp, Homo sapiens
gagccgagatcgccccaccgcactccagcctgggcgacagagcaagattccgtctcaaaaaaaaaaaaaaaggaaggattaaatgaaaacaggacagtctctgacacacatttaaagtcacaaatgatagttttctttgtttgagacaaagtctcgctctgcctcccatgatagttcttatggaaggaatttttgtaagccataagatacttacaataaccttttccagactttttagtagcttccaactacaaaaaaagagaaataatcaattatgtactaatcagacacttttaaaaattacaacagtttattcagagaaacaagctttgtgtgacattctaagcggattttattctgcaggtccttttaacataatgagtaatatttgtgttgggaatgactgagaagaaatttcataatgatgtgaagatctacctgtaaatagttcctctgtcgtatgctggtatttatattctagcatctcaacagtgctgatggtcactcatcttggagttccctgaattttttttttttttcaaaactcctgtaatgttacattacccatatttttgttgttgctgctgttgttgttgttttgagacggagtgtcgctctgtcgcccaggctggagtgcagtggtgccgcgcccggcacatgactgcatactttcaaggagaggactcagagcttttatttatttaaagaaacttgaaaggaggaaagtggattaagaaaaaaaaaataaggccaggcgcggtggctcacgcctgtaatcccagcactttgggaggctgaggcaggcagatcacgaggtcaggagattgacaccatcctggccaacatggtgaaaccccgtctctactaaaaatacaaaaaaaaaattagccgggcatggtggcgtgcacctgtagtcccaactactcgggaggctgagacaggagaattgcttgaattcgggaggcagaggctgcagtgagctgagatcatgccactgcattccagcctgggcaacagagcgagactc

SEQ ID NO: 28845 - DNA, 1050 bp, Homo sapiens
tgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatgtgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatattt

SEQ ID NO: 28846 - DNA, 1005 bp, Homo sapiens
gaaaggggaatgctatttatttttatattgtgtatattttgtcgtggtctgctgattccctgtttcactgagagcgacacttacctcaatagttagttcaatattgtgtgttggataattttttaaaagaactttttaaaaagctttttgatccttggaggtctgtagatttatttccatatgaactggttattttgtataaagtacatgcttaaaatagcaaggctcctctgtgtgtgtggtgtgtctgtccatgtgtcatttccatatcagggcaaacccagacttccatcaggacgaaggcgtgaactaggccacaaggccaccagctgaaatgccacccctcgtccattctcatgcatccagaatccacggaggcggggcacgggtcctgtgcatgagacagaggaatatggttccagagaacttcaaaacagtcatgtactgactggcagttctaaaccatgtcagggataaaacgctcctcacagccgatccttgcgaagctggcccggccgtcagcatctcactggtaaaggcgtccgctttcagaaggttactacacctgaggtgcacgacttctctccttgcaggctttagggtgcctgggatgggaaaggagtataacagtggggcagcggggcagctccagcctggagcccgctgtgcacacacatggccagaagtgggagctccagcctaagcaagcgggcaatcttatacctgccaaggtcatttatgttttatttccagttactgggagaacagtttgaaagtagcttcattcagccaggcgcggtggttcacgtctgtaatcccagcactttgggaggctgaggcgggcggatcacgaggtcaggagatcgagaccatcctggctaacacggtgaaaccccgtctctactaaaaatacaaaaaattagccgcgcgtggcggcacacacctgtagccccagctactcgggaggctgaggcgggagaatggcgtgaacccgggaggcggagc

SEQ ID NO: 28847 - DNA, 1027 bp, Homo sapiens
agaacctttgagcgcactgctgcagtttggcgtgacatacctggaggactattcggcagagtacatcattcagcaaggtggctgggtatgagctgttatatattaaaaatattttcttgaaaaaaaattaggtttgttgtttttcttaagagatgggttcttgctgtgttacccgggctggagtgcagtgtctaattgctggcactatcatggcaggcttcggtctcaaactcctgggctcaagtgatcctgcctcaggtcctgaatagccaagagcacaggctgggactataggtgcccaccactgtgccgtgctctatcccgtactttttgatatgtaattattattattattcagttggttcagttgtttataaattttccttatatgttctttgacccttgaattacttagaaatgtattttttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtgggtgaatcacctgaggtcaggagttcaagaccagcctggtcaacatgacaaaaccccatctgtacaaaaaaatacaaaaaattaactgggcttggtggcatgtgcctgtaatcccagctactcaggaggccaaggcaggagaatcacttgaacccgggaggcagaggttgcagtgagccaagatggcaccactgcattccagcctgggcaacagagcaacaacaacaacaacaacaaaatatatatatacacacacacacacacatatgtatatgtatatacacacatgtatatttttatgtatgtttcagaacatgtattctctaatggttggtgcagaagtctgtacgtgtccatttacatttaatcagtcttaataatacgtattttaaatctttcagtca

SEQ ID NO: 28848 - DNA, 1069 bp, Homo sapiens
ctgcgagcgggcctggcagagtctggccaaccacgccgtggcagaggaacccgcgggcacgtacgtgctgggctcggaaatgaaccgatttccgggcgctcttgtggtggggctcaaggtctcaggagttctgtccttcccagattgcccacaaggagctttacacctcgctttcatcagtggtttgtctccgagagggtggtcgctcatcgtgtgcccattctacagagaagggaagtcgtgtaacaaaaacttagtggggatcccacagccaattatttgctccttgttccaaggtacaatgacatgatgggaaggctgaatgtgtattaagtgctaagttctgtcagtaagcaggtggtaaaagtcctctcccaggtacctccgccctccccgccccgcccaaggttgtttattcctgaccttggctgatgatggggaatgggggtcatggcaggagcagcgttctggtccaattagaggactggattaaagaattaattcagggccgggagctggggcttacgcctgtaatcccagcactttgggaggccgaggcaggaggattgcttgagcccaggagttcgagaccagcctgggtaacataatgagccctcttctctaccaaaaagaagaaaaagaaaagaatccggagaaaaaaaccttgggcttgcattgctctttctaatgccaccagcctcgtctggcaggtgagggagtcatttctttgcattgtaaacttgggttaggccacgctagggaggtggtaggtagaatagctaaagttgaccacaaagaaggatgatctggagagccctggctgtgttttaggggactgggtgggagctcatttcagtgaatgcagaaggctttgcttctgggtgtctggaggaaccttactaggtggtgccttttagccagctatggagtctatacctccactcagccagaaaccttgctccaagcccatttgttcacagagcaaactcttagttccagctctcttttcagccacacaccggtgctgtgtgttatttccccctcaggattacccttcctcttcatttaa

SEQ ID NO: 28849 - DNA, 1024 bp, Homo sapiens
ctggatacaaagatgaacgttgagcaacagctgacttgcctcttgaaagagggttacaggaacttttagttcctgggggaaagggcagcccatgagaccaattgtgaagcccatctaaatactaacagggatgagagagatgatggctgctgagttgggagctggagaggaacagtcccaaggtggaggtgggaatggaaatggaggggaaccacttctaactgaaattggtttttctgctgacagctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtggtaagtcttctttgctgactcatcagatcggttcagaaacgagaggattttcatctcctctcctaaatacctactcttttccccttccctactattgccctccagatcggattctttcccttcacttttttttccccagacttccatacatagcaataaagaataagggggaggaatttaggagtagaatagatataaagaagggaggaaacagggaataggagcgacgtgggatgacagagtggacagagctgaaagagcagcttgctacgtcctaggaattcctaattcttaaaaaaaaattttgttttgttttgttttgttttgttttttgagacggagtctcgccctgtcgcccaggttggagtgcagtggcacagtctctgctcactgcaagctccacctcccgggttcacaccattctcctgcctcagcctcccgagtagctgggactacaggcgcctgccaccacgcccggctaatttttttgtgttttaagtagagacagggttttaccgtgttagccaggatggtctcaatctcctgacctcgtgatccacctgcctcggcatcccaaagtgctgggattacagatgtgagccatcgcccctggccaaaaaataacaaagtttttaaa

SEQ ID NO: 28850 - DNA, 1071 bp, Homo sapiens
tcctgaacatggactgagtcatagtcctccactttttctagggctgaactctgactagaacctcagaatttaaaaaaacttcctcttggccaggcacggtggctcacgcctgtaatcccagcactttgggaggccaaggcaggcagatcacaaggtcaggaaatcgagaccagcctggccaacatggtaaagccccatctctactaaagatacaaaaaaaattagccaggtgtagtggcacatgcctgtagtcccagctacttgggaggttgaggcaggagaatagcttgaacccgggaggcggaggttgcagtgagccaagatcgcactgctgcactccagcctgggcaatagagcgagactctgtctcaaaacaaaaaacaaaaaacaaaaaaacttccgctcatcagaatatctacaaaagtgttaattcaagtattaatgtctcatgaagtgttaattcaaagcaagttgtaaatgaaaaactcatacattttagaaaatgtggaaaataggccggacatggtggctcacacctgtaatcccagcactatgggaggccaaggagggtggatcacctgaggtcaggagttcgagaacagcctggccaatatggtgaaaccccgtctctactaaaaatacaaaaattagccaggtgtggtggtgcgtgcctgtaatcccagcaactggggagggtgaggcagggagcattgcttgaacccaggaggcggaggttgcagtgagccaagattgcactgttgccctctggcctgggctacaagagcgaaactctgtctcaaaaaagaaaaaaaaatgtggaaaatagagaaaagtataaagaagggcatagaaatctgctactctgctgtgctttcagtctttttctatggatatagagattgtaggcagttacatgtcacacatatgctttcaagcatggccttaaatcgctaactattccagttcacaggaatgcccctaagtaatttaacaacccctattattgaacatttgggtgattattctgttttctgcctcgctgtgaagaaggaatgagctccctaagtgata

SEQ ID NO: 28851 - DNA, 1045 bp, Homo sapiens
agcgacagagcgacacatccacaggcgcccctggggaaatgggaccagcctaatctcgcggagtgcactgtgtcttgctgcctgggtgccctctcctttgcaccctacttcggctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcaggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagtcttgctctgttacgctcagtgcctctgcccactctttccccgccagcccttccctcccgccctgcaaacttgtcccttggctgtttcaccaggttctgcctgtatccttgcct

SEQ ID NO: 28852 - DNA, 1083 bp, Homo sapiens
gctgcaggtttcagcactgttaaggtattgcaagaatgcccaaccctctggtgtctgattgtgtatctagcaacattgcagtatgaagaaaagagatgccccgggtacgaccccatttctattaaaaataaatgtaaacacccaaccctcttggcagcccatgcacttgagaacctgtagaaaatggcagtgtgcaaccagcatggctgcgagctcagcgtcttcactagagagagtggaggtggttaggaaagggcaggcgggaaggggccatgttggccggacaactgcaggtgaagatgggattgtgaagtacagtccaaggcccactcaccaagggctggatccaaatatgtggggttgggattctgtgacctacttccaattttaatattgacctgagctcatatttagctctacatgtttcccagctcgtattttccaacagcccctttaaaacttttagcatcctcttgtcacttttgtactatccaaggtgggacggacaggtgtcagataatagcagagacttggtgaagaaatgaaagcacttttgtagaagagtgtcatttcagaaaaaagccttttttttttgagatggagtctcgctctgtcacccaggctggaatgcagtggcgtgatctcagctcactgcaagctccgcctcctgggttcacaccattctcctgcctcagcctcccgagtggctgggactataggcgcccgccaccacgcctggctaattttttggtatttttagtagagactgggtttcaccgtgttagccaggatggtctcgatctcctgacctcgtgatccgcctcccacagtgctgggattacaggcgtgagccacggcacctggagagaaaaaagcttctttaatgacgacctcaacataatttacatggagaagtttcttaggtggaaaaccgatttgtatggtcctcagaatgtaacctacaggttcttgccctcagaaaaatgcatgcatacttttatgttacaggcttattttccaaatgcggtagagggccatcccttctttggcttcttgccttgtctctgaccccactgactgccc

SEQ ID NO: 28853 - DNA, 1113 bp, Homo sapiens
cgcccacatgagccacaggccttggctctgttagtccctgagctacccgggaattctcttagccttttgcagattcattacgaggtggtctggcttcaaacctccatggagttttataggtaggggagaacggaaggggtcctgcggtagtgtggtagggagggaggcttctcccctgggcagtaggacctaatggtcttcctctcttggaagatgaggttcgggcaggaacctaccgccagctcttccatccagagcagctgatcacaggaaaggaggatgcagccaacaactatgcccggggccactacacggtgggcaaggagagcattgacctggtgctggaccgcatacggaagctggtaagatcaggagggcaggggacgggtgggtcaggctggagtggacaggcttggccccatgcctctttgatcaggctagggagaggcatctgacccctggctataggatggagctcctaaggtttgggaatttctgcttaaattctgtaagaagcatgcacaggggtgatgccccttcctctgtgttggcatcatagactgtgttccaggctgaggccctactcatactcattgatactctctgttagtatctggggaaggttccgggtataaggcaggatgaggtctctgctggtcggaaacacaggttaacaaagcatttaacttggaagaggagaggaagagattgttgatacatttgggcacttacaagtgccattacagatgttaagcacattccttcatttaatccttaataattagacttaggaggtgtccttcctgtgctttacagatgaagaaattgagggccagggtggttcaatatcttagcctgggtcacacagctaaaaagtggcagagctggggtttgaactcagttggactacaaagctcttgagttgtaggttgtgtcactttatttatttaagcttccatttgcttatctgtataatggaaaagcttggacctgatcacatgttctttccctgggaggtaagggtgccaaacttttgcatatattcactttttctgtttagaggagggcttgtcagggtcattggcctcaaagctgtctgtggtccccaaaagt

SEQ ID NO: 28854 - DNA, 1064 bp, Homo sapiens
gctcatgcctgtaatcccagcactttgggaggctgaggcaggcggatcacttgaggtcaggagttcgacaccagcctggccgacatggtgaaaccccgtctctatcaaaaagataaaaaattagctgggcgtggtggcatatacctgtaatcccagctactcgggaggctgaggcagcagaatgacttgaaccctggaggcagaggttgcagtgagctgagatcgcgccactgcactccagcctgggcgacagagcaagattccatatcaaaaaaaaaaaaaaaaaaaaaggtagccttcatcttataaacatataaccagtccagataggatatagtggaagagaaaaagagaaaacctctattaacaataacaatgaaatagttagatacttaacaataacaatttaggaaatgttagaagcctttatgagaaaaattttaaactcaaagacaaagtagatgagcaaatttaatgacattcctaggaaatttttttttttttttgtcaaggtctcactctctcgcccagcctggagtgcagtggcacaatcagatcactgaagccttgagctcctggcctcaagcaatcctcctgcctcattttcctaagtagctggggctacaggtgtctgccaccacacctggctaaattaaaaaaaaaaattggccaggtgcggtggctcacccctgtaatcccagcactttgggaggccgaggcgggcagatcacgaggtcaggagatcgagacaatccgggctaacacggtgaaaccccgtctctactaaaaaatacaaaaaattagccgggcgtggtggcgggcgcctgtagtcccagctactcgggaggctgaggcaggagaatggcgtgaacccgggaggcggagcttgcagtgagcggagatcgcgccactgcactctagcctgggcgacagagcgagacttgtctcaaaaaacaaaaacaaaaacaaaaacaaaacaaaacaaaaaaaaagagtcacacgaacacatgttctgatccacctgaggcaaaaggcgcccctgtggagcccagcacgtctgtgtg

SEQ ID NO: 28855 - DNA, 1041 bp, Homo sapiens
gcctggttacctgctggggcaagtgggtgagttgagtccgatgaagcacttagaacggtgcctggtatgtggcagtgtacagagcatggggcaatcactgcagccgacctagctggtggctccagtgggccttagtgccccaggcatctgaggagcccactcttcagcactgcccccgagtggctgcagcacacactcccccaggactcattcagccctcccaaggagtgggaagcctccggaacctggtgctgtccgaggcacgacacgcaggaagcagggcaggtgtcctccctggcccctcacccttcctagccaggctgcagctgatccgaggtggttccttgatcctggagtctgaagggacattgaggggctacctgtgctccaaacagaccagcccgcttctcatctgcttcacacacaggggttctgggtaagatttcacttcatttctttgaaacaccactctgctgggccagccaagtcctgtagaccccatcacttgtaccccttgacctcagcaacaggaccaagacctgtagaccccaccacttgcaccccttgacctgaaaaacaggaccacaacctacacccagccgtcctcacctggactatgaggatggtactgctcactggctccggacagctgtgtgactccaggggagccagctgtggttgagatctcgggggtcttggtaaatctggtaaactccttgtgcagttctagcgagcccagtgtgaggactgcctgttggctgggaaccgtaaatctgcttgggtttcatgagaatcttgccctgagtgacctccagctggggaactcaccctccatctgcgccagggagagcttggtcattgtctgcagggacccaactaatcaggacgggcttccacgaggagacagatttgaaagtatgctctcttcgggaagcagtagctttaaactggactagctcttatataatgggcactgtgtccctaacgaaaccaaaatatggtccaataatggcttctttgagggaagcacagggcagttgg

SEQ ID NO: 28856 - DNA, 1049 bp, Homo sapiens
aagagccagaatccatctcaaaaaaaaaaacctagaaataataaaagctgtatacgacaaagccatagctaacctactacagaatggggaaaagtgaaaagcgtttcctctgtaaacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacaccaataatggtctaggaaagaaattaaggaggcaatcccatttacaatagcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctcc

SEQ ID NO: 28857 - DNA, 1053 bp, Homo sapiens
gccccgagccagtcccgttccctccctccggaagaccccggtggttcccggctccgacccagcacactcacctgccagccgctgccgtccgccatgtctgggcgaccggcgcgccaagcccgcccctcagtccgccagccaatgaaaaatgaagaaaacggcacctcgtgatcgactgacagaagaactaatgagcaccgacacattcaatcacgtcttcgcccccttcttcgagaagcgccgacaaacaggacgagcaaccaatagcaaccgagggcggctgcggcgcgcgcggagggccggggtcgcagggtaaatccggggcgagacctggcgcgaagcctacgcgaccaccgcgacgacagcgccattcaccccgggccaggcgggcatcctgggccgcgcagctaccttacgtcagccgcctctcaaatcacacggctctggccagttcttttcagcagctttatgagattttctcaaatctcaacaatccggtatattttcaaaagtacatactgagcatcaaggtggtgcagcgaacctcccagatctgcagctccagcagtcttgcttgagcgtccactcaggatggaggtgaactcgcaaagtaactgagattggttgggcatgacatatggtggatctagggttgaatgacctccccagggaacgcaggcttgaagtggaggctgagaatgcaatccgagtacagccataggccggtcaaaggtatggaggcggtgtgtagcaggggtgagcggggtaggagtggcttggatgtctgtagttctattctaagggtgcgggagacatgtaacatttaccttattcatttttcgagacagggtcttgctgtgtcacccaggcttagtgcagtggcgtggcgtgttcatggcttactgcaacctcaaactcctggactccgaacagctgggaccaaaagcatgcacagcctcaccaggctaatttttaattttttttttttttttttgtaaagatggggtcttgctaagttacccaggctagtttggcctcaagcgaccctctcac

SEQ ID NO: 28858 - DNA, 1255 bp, Homo sapiens
atagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcct

SEQ ID NO: 28859 - DNA, 1028 bp, Homo sapiens
gggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaat

SEQ ID NO: 28860 - DNA, 1051 bp, Homo sapiens
gtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaa

SEQ ID NO: 28861 - DNA, 1376 bp, Homo sapiens
tctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagg

SEQ ID NO: 28862 - DNA, 1088 bp, Homo sapiens
ctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcatttt

SEQ ID NO: 28863 - DNA, 1032 bp, Homo sapiens
ggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtccccattgtggctctggtctcgaggccagtgcttgagtgtgctctgagccttctgtgggtcttgggccccaggagccctcagtgcctggcaggaaatcagcatggggattggccccaaggacaagatctccttactctgtcctccaggccctccgggtggcagtggacagaggtcaggacccctcggcatccccgcctcctcatagcacctgcaccggccactgcctggtggtgccagccagcacctggctctgtccacctaccacttcctctggtccacctggcctcagccacatagcaagtccaccctctcagccatccctccacctgtgggtctcaccatccagcactcttttccaggtctttgaaggcaggagtgatttgggtaggttttaagtcagtggggaaaagctcagaaagagtggcctggaaaagagcacacaggt

SEQ ID NO: 28864 - DNA, 1023 bp, Homo sapiens
agcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagct

SEQ ID NO: 28865 - DNA, 1058 bp, Homo sapiens
aacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccg

SEQ ID NO: 28866 - DNA, 1031 bp, Homo sapiens
tgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctgtggggacaatgacgctgtggacagtgaggacgctgtgggggcggtgaggacactgtggagtgaggacactgggggcagtgaggacgctgtggacagtgagggcgctgtgggggcggtgaggacgctgtaggggcggtgag

SEQ ID NO: 28867 - DNA, 1022 bp, Homo sapiens
aactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttca

SEQ ID NO: 28868 - DNA, 1081 bp, Homo sapiens
atgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatt

SEQ ID NO: 28869 - DNA, 1020 bp, Homo sapiens
gggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatc

SEQ ID NO: 28870 - DNA, 1024 bp, Homo sapiens
atccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgtttcagcactttcttctcttcaggtattatttagatattcaatgaatgtctattatttaacttcacttagtatgactctgaggttgaaagttactgaaaacatcttgtaagcttttttaggccaatatattatcaaacgcaattaa

SEQ ID NO: 28871 - DNA, 1041 bp, Homo sapiens
agctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaa

SEQ ID NO: 28872 - DNA, 1050 bp, Homo sapiens
aggctgggcggggtggctcacgcctataatcccagcattttgggaggctgaggcggggggatcatgaggtcaggagttcaagaccagcctgaccaacatggtgaaaacctgtctttactaaaaatacaaaaattagccaggcatggtggcacgcacctgtaatgacagttacttgggaggctgaggcaggagaattgcttgaacccagcaggtggaggttgtagtgagctgagatcgcgccgttgaactccagcctgggcgacatagcgagacttcgtctcaaaaaaaaaaaaaaagagcttcaccactgtgcaaccatacaaggtagataagaaaaaggagttctcattttgggacagggagggcctttagcaggacgggacatgactgctgtacagtaatgatgggaaaatcccatgtaatataaggctatttctactagacagcatcacaggcagagctgaaaggcaggggatggctagggagaaaacagttgcaggcctgggacaggcacatggttgcccacatcacaccagctgcactacgggtcagtgagacaaaggcctagcagtcagtacccatgttggtgaattgttggcaagaacatacaggaggtcacaagttgcccagccagtgggggatgcccataaaaccctggcgggaacatttcccacactgcatacaccctggaggcaggtgagtggcaacaggttctggtgctagacgttagcggggacttggccaagtctgtttatctgaaagcgtcacccatggatggagcaattccacctcttgcgtctatcctaggaatgtcctcagctgctctcccactgttgtaaagaaatacctgggactgggtcatttattaaaaaaagaggtttaattggctctcggttctgcaaggtgcacaggaagcatgatcctggcatttgctcagcttctggggaggcctcaggaaacttacaatcatggcagaaggaaaagcaggagccagcacttcacacggctggagcaggaggaagagagagatgggggaggtgccacacactt

SEQ ID NO: 28873 - DNA, 1062 bp, Homo sapiens
gctgactcttgcggcagtcatgacaggccagggctccagtgggacccctcatcttcctgcatcctccccagggggccccatatcagtgttcctgggagaagagcacatgcctgcagctgtggacacagcatctgtcccctgcctacaggtgaacttgtcacccactttctgaccactgacgtggacagcttgtcctacctgaagaaggtctctatggagggccatctgtacaatggcttcaacctcatagcagccgacctgaggtgggtctgccagagggggatggcggctctgcccagcactgcctcgggggcaggcctcaggctcatcaggaagtggggttccactgggggctgtggcagcctctccagggacgttgctcctcgtgacttggcaaacattctgaggactgagcctgtcacagatgtaccaactcgggtatttgggggtgaagcccaaggcttcctgtgatggcatgagggctgccggatccctggagaaagctgaggctgtgaagaacagtcacatagagtggctctggccgggtgtcctccctcccacgggcaggctgtgcagagcagccctccgcagccctggcttggagtgactgggatgctgtgctcccagggaagctcctgttggagatgaggccgcaggaactgcggaggttttggtgttttgcccttccgtgaagtgagcattcctccctcctgccctcctccccctccaaagccccagaacttggccaatgctgttagtccggggccttctgccaggacaggcaaacgggaagtggtcggcacattgtggcgggccctgaagctgcctccttccacaagggcaggtccatgggcctctctcctggctcccgagctccaggcctgctgttcgttgagcatcccttgtgtgtggcatgcccagccctgccccacatgggtctgcacacttgctatggaggctgggagagttgcagtgtcccctaggtggaaggccgagggctggtgcggggcacttgctgtccggagccgttcttcctgcccatgccttcgtgactccaggtgg

SEQ ID NO: 28874 - DNA, 1072 bp, Homo sapiens
cagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggaggccccgtcagctcacctatttctaagcacagaccatttctcaccaccttcaagttaacatcctggcccagcctacctggtgagcctctaattctctttactgtcaccttaggtcctcactccccatccaccatctatagtttttctggacacagagtgattcttctttctttctttttttttttttttgtttttttgagacagaatctcgctctgtcgcccagactggagtg

SEQ ID NO: 28875 - DNA, 1093 bp, Homo sapiens
aacccaagtgagccttttggtgcctcggtgaccattgatggtgtgacttacggatctggaactgcaagcagcaaaaaacttgcgaagaataaagctggtaacgtgcttgcttgggtgtcaaagatacgtgctgcctgctgtgtctgcctcgctgcttggttagggaggggctgagcagtggtgacaagtgggggatgtgggtggggcatgtttattttatttatgtaatcatctactttgatttttaaaattacatgctcattggaaaagactcaaatagagcaaaatgtgagacttaaaagtagaaggcctcggccgggcgtggtgtctcatgcctgtaatcccagcactttgggaggctgaagtgggcagatcacgaggtcaggagatcgagaccatcctggctaacacggtgaaaccctctctctactaaaaatacaaaaaattagccgggtgtggtggcgggcacctgtagtctcagctactcgggaggctgaggcaggagaatggcgtgaacaagcgaggcagagcttgcagtgagctgagatcgtgccactgcactccagcctgggcgacagtgcaagactctgtctaaaaaaaaaaaagtagaaggcctctctactgagtgacagctgggccagtatgtccctccctagtcctggccctgcacatattcaggggtgtgcctagagccaactgggctgtgctgggcacatgctgtagtgcttgtttgtttttaaactgagcagcatgtgggcatgccaggagggaggagaagcgggccagcatgctgttggcatcctcccccagtggtgctggctcttaccggcactatttcctgagtcctcccactccatgtttgggcctagccacacagaacacctggcacagcgcagctctgggaaggctgtgtgtcctggcgaagacccactgcccttttggaccatgcccttgccgtttgcattcatgccctgcattcgtggtagttgacattctttcacaaaaagccatttgcctcagcgtccagggttagttggcttcttgtagggtggtgttgggtgtaccccaggccctcgcacccacaggttgattc

SEQ ID NO: 28876 - DNA, 1061 bp, Homo sapiens
agaatggtgagagaataaacctcttgttctaagccactgactttgtggtatgttgtcacaggagctccaccagggaggttgtccatgctccagagtgggctggatagcatcttcctttcacccaggaggcactctcagcttcagccaaagtcctagtctgggaaggcacagtgggcaatgtctctgcacctcagcctgctgcagcttccctatgcctcactgtgtggaatctccccatcacctcttgtttccctgtctgcctctcttgtccttcctgtgtgttcttgggttggctgcagagccagggtgatgacactgttggaagccttgctgggctgggcctctgctggccacctggggctgggctctgtgtagctgtgtggggctttggcctttggggagctgggccttttaaggccagcttttgggtctggctgactttccctctcctgtagtctcagttgtggcaatagtaaagcctctctgcaaaggtgctttatctttatagagttctgagaagggtgccttatggatcagaatcagatccaaataaggtgggcctggccagccagccatgtacctggggccctcttaggataccagactccatcccacagtgctcagggtggaagggtgctgtgggctctggagatgggcaactggacggtgaggtacggagcatgtcttgtacccggtgggttccttgcagagttgaggtatgaagtgctaggcgagctcacaagaacagacattaagcatctggggaaagccaaccgcaggcccagccatgaagaggccggtgggcctggtggggactcacaagcctctgctttgtgttgtagtattttaaccacatcagcatcgaggactcgcgggtctacgagctgaccagcaaggctgggctgttgtctccatatcagatcctccacgagtgccttaaaaggtagggtaggggggtgcctccccccatgagtcaggtcgggggagctcctctctggcgtctcatattcttgtggctgtttgtcccaaggcagaggcatggccaggtttccctgggtaca

SEQ ID NO: 28877 - DNA, 1052 bp, Homo sapiens
tgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgt

SEQ ID NO: 28878 - DNA, 1033 bp, Homo sapiens
ttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaata

SEQ ID NO: 28879 - DNA, 1025 bp, Homo sapiens
atgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctggaactacaggcacccgccaccacgcccagctaattttttgtatttttagtagagacggagtttcaccgtattagccaggatggtctcgatctcctgacctcatgatctgcccaccccagcctcccaaagtgctgggattacaggcgtcagctaccgcgcccggcccacccttaatatacaacatgatgcttgcgataacacatgaaaataggtgatggtttagttattaaaaccacttaaaaaaattctgtacatgtgcttcttgacgctttcagttaagagctggctacagtggtgggtaccagccttgtgtcttgtgacagtgtcacagcaccacagagactgtggcctgtcgcctacactcaggattgcaacaaacatcatgtttagttacacacctcagtgaaaatgaggttgtagtttttccctgttcaagttcatggaatccccccatccttgaagttgctttaagagtccaggttaaggttttgttgctctggggtgggagagggaagcagagagagtcattcctactgtgagtttcctatccaaggaagggggccaggagggatacctgggaaaggagagctgtgtgtcaccctttggtcacagagggtgatggacatctccctgaaaccactgggtggccatggctccactctgctgatgcattgccgtagcccctgtttgggagtagctctttgctgtggtgaagtgcttgcctctgttc

SEQ ID NO: 28880 - DNA, 1510 bp, Homo sapiens
gcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcac

SEQ ID NO: 28881 - DNA, 1025 bp, Homo sapiens
ttggaatcttagggatgatttcgtatggggaggggccttctccccagcctgctgtcttatttttgtgccgattccccgcagcccgagctcctgcccccagcacctgcctttccagcctgtgtcctgtcttccaccagcggactccagcctggctcccactgccacgtggctgcctggcgcatgctccaccccgtgtcctcccagggtcccagtgagggcccagccccgcagtgcgcagtctccgcagccatcgagtaggcggccagctgagcagaggtgctggccggctgccagcccagcacccgtcctgctgaagttgctcctggcacgcttccggccccaggcttccctgggtggtggggcagactttgtgttgctggtgtgcaggaagggcccacgacccccacccaacatgtgagaggggcatttggcagccatgggcaggacaccaccttcgaccatcagctaggggtatgtgcaaagggcctgagtgagaaacaaaagacaaaatggaccaaatgtgcttgtgtggccgggtgtgtgaattgtgtgcaggtgagtgtggaaagatgtgtgagcacaagcctgtcagcatacacgtgtgggcgtgggcatgtgggtgagcatgcaagtgtgtatacataagtgagtgagcacgtgtgtgtggacgtgcatgttatgtggatgtgcatgtgtgcatatgagtgtgtgagtgcatgtttgatgagcatgtatgtgtgggcacacgtgtgtgtgtcagcgtgtgctgactgccatggacgtgcacctggctgagtgtggaaatgtgtgtgtgagtgtactggcagtccaggttttacacccacacggctttgcctccccaggaatccgttttaatagcagagtgggctggaagggctggccaggccctgaggcagttttcaggccagcagtccctggctcctcatatgcggtgacagcccaggaggccggggccctcagagtgcagtctttggacatgcctggttgatggatccgtcattacc

SEQ ID NO: 28882 - DNA, 1050 bp, Homo sapiens
ttaaaagattgtatattcaagacgttcactcagtatgtgatcctgcatagtaaacctcgggtgaaacaaagacaactatttttatatatttttaaaaatttagtggcatatagacttctaatattttggggggggggatattctttttttctttaattatggtaaaatatccataatataaaactgaccactcgaatcatttctaagtgagcagttcagtggcatttggcatacttacattgttgtgcagccatcacccccatccatccacagaactttttcatcttcccaaactgaaactctgtatccattaaataacaaatccccacccttccccgcccctggcaaccactgtctactttctgtctccatggatttgactacagtgtgtctaagtgggatcattcagcatttgtccttttgtgactggcctatttcacccctctgttttatacctttctgctgcgtggcgctttggctttctatgttctgcggcggtgggtggtaaagtggatgtcctgcttttaattctgagggctcgcttctcagttttcaaaaacacactttaatctctgattctccaattatcaagcatttgccatgaaatgatacttgctgctccccagcactgcagactgtgtaagagacatctcagccagcatttggattaagtcaaaccccaggaatccgcacctcctccacctcatcacccaataaaaaaggtaacgctgaggtattagaacattcacattagttccatgagcatgccctcttatgggcctgagagcacccaggctctggtgcaagccccccacagcccagggaagtgtttcaggactggagccctgctcagtgctgtgggctgcacaaggggtcaactgaggacccctaagcccaggagtggcagaggctggggaccatcccatgggctcccaggatggccttggggccacagggattatggccaggcttgtacttccaaagcccttccagggaggaaggcgctccacttcctgctttggcttaaaaaagtccagggaagcacctgat

SEQ ID NO: 28883 - DNA, 1408 bp, Homo sapiens
atttttttcgatattgctgtttgtgtgtttttctgttgccgctctaacaaattaccacaagtttagcatcttaaaacaacacacctttagccaggtgtggtggctcacgcctgtaatcccagcactttgggagactgaggcaggcggatcacgaggtcaagagactgagacccatcctggccaacacggtgaaaccctatctctactaaaaatccaaaaattagctgggtgtgatggcgcacacctgtagtcccagctactcaagagtctgaggcaggagaattgcttgaacccgggaggcggaggttgcagtgagccgagatcgcaccactgctatcccgcctagtgacagagcgagactccatctcaaaaacaaacaaacaaaaaacacacatttatcatttggtagtttctgtaggtcagaggtccaagtaggttccactaggtctcctgctatcaaggcctatcaaggctgaaatcaagacgttggcagggtgcatttcttactgaatgccttggggtggaacttgcttgcaagcccatttatgctgttggccatattcagttccttgagcttgtaggactgaggtgccctctttccttactggctgttagccaggagtcagtctttgttcccagaagctgcccgaattccttctcatgctttttatgtgtctccctccagcgagggccagttcttctgccacatctctctgatttcagctagagaaaatatcctgcttttcagggctcagattagatttagtgcacacagagaagccaggataatctctttattttaaagtttgtaattttaattacatctgcagaattccttttgacatgtaatgtagcatattcacaagttctagggattaggcacgagatgggcattctcctaccacagccgggaagagcagtttcagaggttgccttccctaggtgatgtgggtgttctcagttctcaaatttgtctgttttctctctagggttcactttctctctagggttcacgttgaaagtcgtgattcttggtgccttgatttattgtgctcatagggttaaaaaaagatttgcattagaattctagacatacctttaactcttaacttcctcccatgtttttacactgttgtttaaatttggccattttgggaaatgctttatacccaagtaatttatagttgatgaagggatagagaaagtgtcttgcttgtggcaccgtgactcacacctgtaatcccagcaccctgggaggctgagatctgggactacttgagtccaggagtttgagaccagcctaggtaacataaacaaatacaacaatcagctgggtgtggtggcgtgcactcgtagtcccagctactctggaggctgaggtggggggatcgcttgagcctgggaggtc

SEQ ID NO: 28884 - DNA, 1078 bp, Homo sapiens
cggagagaactctggagggaggaggctgaccagctgtgccctgacctctccagccttcgtcttcctgcagactgtgaagtcgcatgatcctccccatcccgtttcacacaaatgctgcctttgcccagcaaaaagataaacactcacaaagctattaagacattatccaaaagtgttgagctctctggtagagaattattatgctgttttcagtgtaataatatgtagtagcatttctgagaaaatgctgtgaattcacttttttaagttacaaagtttctttgtaaatttagaaatctggctgggtgctgtggctcatgcctgtaatcccaacactgtgggaggctgaggcaggcagatcagttgaggtcaggagttcaagaccagcctggccaacatggtaaaaccccatctctactaaaaatacaaaaatagccgggtgtggtggcatgcgttgtagtcccaactactcaggaggctgaggcatgagaatcgcttgaacctgggaggctgaggttgcagtgagttgagatcgtgccactgcactccaacctggatgactgagtgagactccatctcaaaaaaaaagtttagaaatccatatttttaaatttcagcgtttatcacatgaggggaattctgtcaattcagccttggtctctgctgactaagctgcaagggaaggggtttaacagatccaggctggccaactgcattctgccattgggaagggagtgcactgacctcacaggctgcacgccactgtctgccctgccctagacagtagagctgtacatgccagctgtctctgcccatgtgggtctcacctctcagccaggacagggattcttggccaactggggctgagcggcagcaagggcatgtggccagaacatctgggccccttggcattggagcatggggtcctgggtaccacccagttgtgtggcatggcggtcctgccaggacatacctgtctgtgggtagctgtttgctgtgaagtccacactgttgtgacaatggcatccttgtccttggttgtggcattgctcactgagctgctgacctggtgggcttg

SEQ ID NO: 28885 - DNA, 2062 bp, Homo sapiens
gagaagctgaggtgggaggatcacttgagcccaggagttcaagaccaacctcggcaaaataggagacccccatctctacataaaatttaaaaattacctgtaggtacacttgagatgctgaggtaagaggatcacttgagcccaggaggtcaaggctgcagtgagccatgattgcactattgcattccagcctgggctgcagtgagacccaatctcaatcaatcagtcaataaaattagctgagtgtggtggtacacacctgtagtcccatctacttgtgaggctgaggtgagaggatcgcttgcttgagcctggaacgctgagtctgcaatgagccacgatggagacactgcattccagcctgggtgacagagcaaaatcccgtctcaaaaaagaaacaaacaaaaaaaaggatgaagaaagatgtattgggcaattacttcaattacatctctttgttattgataaacagaccaaaaaattcatttacagaaaatttgaacaatgtaatgaacaacttaatttaagcatatgatggaacaatatgtttataaaaataaatcataaagcaagcttcaacaatttcagaaaatttaaaagtattgtcatactttttgttgttgttgttttgagacagagtctcactctgtcacccaggctggagtgcagtggcgcgatctcggctcactgcaacctctgcctcccgggttcaagcaattctcctgcctcagcctcctgagtagctgggattacaggcacgtgccaccatgcccgctaatttttgtatttttagtagagatgggtttttgccatgttggccaagctggtctcaaactcgacctcaagtgatcctcctgcctgagcctcccgaagtgctgggattagaggtgagaaccaccgcgacccgccggtcatacatgttttatgaatgtcaaataaagttagaaatctgtcacaaaataaattaaaaattttttacacttggccaggcacagtgacccacgcctataatctcaacactttgtgaggtcgaggcaggaggatcacttgaacccaggagtttgagatcagcctgggcaacaaagtgagactgtctctataaaaattttacaaattagttgggtgtggtggcatgcacctgtagttccagctactcgggaggctgaggcaggagggtcacttaagcccaggaggtcaagggtgcagtgagccacgatggtaccacttcagtccagactgggcaacagagtgagaccccacctcaaaaaaaaaaaatcttacacccatcagaattgctaaaatgaatagtgacagcctcaagtgttggtgacagagaaactgaatcactcatatattgctggtgagaatgtaaagtggttttaccttctttcaaaatgaaatatgcaactcagcagttacactcttgggtatttttcctagagaaatgaaaacctcgcataaaaacccatgcacgaattttaacagcagctttatttgtggtagcccaaatctacagttacccaaatgtccttcatgtagacggttaaacacactgtgaggtgcttgtaccatggaataccctggcagtactgttgctagaactacaacctgtatgctgaatgtaaaaagccgatcccaaaaaggttcatactgtatggttccatttttgaaatattatgtataattttgaaatgacaaaattttagaaatggaggatgctgcagtggttgccagagtttgcgggtcagggttgctgagagaggtggcaacacgagggatccttgtggtgtggggactgtgtagtgtattgactggtggtgactgaacccacccaggtggttaaattgtccagaacttagtacacacacccacacaagtgagcacacatcgtggttgtgataccttgtaagtttgtagaatgttaccattggaggaaactgggcaaagtatacaaaggatctctctatatttctttaatacagctttattgagacataattctcattagcatacaattcacccatctgaagtgctccactcggtaggttttagtgtaatccac

SEQ ID NO: 28886 - DNA, 1042 bp, Homo sapiens
tgtggctgattgcagcagttctgtgggccctttcagggtgtgagcacttcgactgatgagcaccacatgaaaggatgtgccagctccgtcagtgtctggtggtttgccaactactcagagttaatgttctaagcaaatatctttttttttcctttacactctgccaagtctcaggagaacaaagttcattactatatttttgagaggagtattaatataaaatactgttattcctagtttcattttgtatctctgcacaaagccagtctactcagtgacaggcacagaggacagagtatgatcaccaggatgaaggtagctgcatcaaggggccatttggacaactctttggctcccttggtttttgtggccttttctgtttgtgattcatgagtggaatggggcctgaggcaagtgtgggggtgaacaagaggcctcataggcagactggaagtctaggagagttgtgaggagcagatatgctcactcatctgtcacctgggagtcgacacactgcctgaccccggggactgtgcagactgaaacccttgtgtgctgcatggtggaatgtgccctggcagggtttgccctagtggcttggagatgtctaaggaagagcccgctgcatgttggaatgtgccctggcagggtttgccctggtgacttggagatgtctaaggaagagccccctgcatggtggcgcgggcctgtctcgtccttctggaggcccctccatgcagtggctccacagttgccccttttgcccaagtttgccccccacccccacttttttcttttgaagacagggtctctgttttccaggctggagtgcactgatgtgatcagacctccctgctcaagcgattctcccacctcagcctcccaagtagctggggctgcaggtgtgcatccccacacctagccaaatttttgtatattttgtagatatggggtttggccgtgttgcccaggctagtcttgatctcctgggcttaagcgatccactggccttggcctcccagaatgctgagaatacagacag

SEQ ID NO: 28887 - DNA, 1081 bp, Homo sapiens
ttactggcacctgtcgctgcctgcaccgaaggctggcagcacctcctggagcttgggacccagagcacagcctcccaccatgagatgtgttgtttttctgtggatcagtcctcctttctttctgagcctggcgtgttttgttctagtttgttaccgtcctaagtgcctgtaggccctgctctccagggacgagactcgggctctacccccaactcagaacccagagcaagagtggtcgggcccgggcccacaacagtgctcagctgtcctgctgcctttgtagttcaagaagtgtccattgatgaggggaatggtcctggctcatgctggagttcctgactcgcatccctgtggagatgaacttcctcgtcagggcggaggcctgccaagcagtccccccaggcttctcttgctcacctttgcccatttttattacgaaagaaaaccagttccttgatagataccaggaccatcagcctcaggcctggaggaggagaggaggatgatttgggttcgggctgtaagaggtgtgccactgagaaggagggatgctgtgagcaggcttaactgagctcatggttcagtgggagttgagtgttctcatcacaggctttggtggaatgtactcttgacatctgtccccaggagcctggtctccagaaacaccagctcaggccctcaaggtctggctctgatggttctgtgggctataggattctgatctgttagcgaggtgtgttcagaagtgtgttgaggacaccagtgcaggagagcaaccagtagaacagaaaggtctggaagcagcattcttggcaaatcttctagattcccaatgcccagacagacctggaggtgctgtgggcttgaacatgtgggtggcctcccctcccaggctgccccgagctgcccaagctttccttgccctggtgctccttcttgcagaggctacacgtgccctctccacctgcccaggcactgagtttctttgttgcgatcaccttgtctgttgtccctctgtcctcaaagatgatcacggaagccttggcccaaggtgggatgcacataagagcccggttcccgc

SEQ ID NO: 28888 - DNA, 1020 bp, Homo sapiens
tcacagcccaactccaacgtcaggtaggcctggcctggggtgcccctccccacctggccctcgaggctggccctgcctggaccccggctcacatgtttctctcacttggctgcagctctggccctgccccatctcccagtagcttcctgcccagcccctcaccgcagccctcccagagcccagtgacggcgcggaccccacagaacttcagtgtcccctcacctggacctttaaacacacctggtaagttgggcctgaggtgctaaggtcactcctcacctttatgaggcctcagctcatactgggtgtgcgagctctggggccctcagagctcaagttccccacccgagggtcgagggctgtggcctcacccgcctgtgtcctgcagtgaaccccagctctgtcatgagcccagctggctccagccaggctgaggagcagcagtacctggacaagctgaagcagctgtcgaagtacatcgagcccctgcgccgcatgatcaacaagatcgacaagaacgaaggtaggctgcagccagggcaggggcctgcaccctggggacaccaccaggcttgtgtcttagtgtgtaccctcttctgtcccagacagaaaaaaggacctgagtaagatgaagagccttctggacattctgacagacccctcgaagcggtgagctttgcccacagcccacggagggtccacaagggcacagatagcccagccatggatgggcacttggtgatgatgtgggtttaacaaaggcaccaggcagctctttggaccctggccagaggcctccaaggctccactctggtgtgtgctggggcttcaagcccaggcttcatcttggcccatgcccagcctttgccctattcctggctgctgctgtggccctcatgctgggccatcacagccagacctcatccagtcagcagccaggggcccagcttgcagtggcctgaccatcagctggcccagatgggcctgagcctgacctggagttctgcccctgacttgctg

SEQ ID NO: 28889 - DNA, 1093 bp, Homo sapiens
tgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgaca

SEQ ID NO: 28890 - DNA, 1030 bp, Homo sapiens
ggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcct

SEQ ID NO: 28891 - DNA, 1053 bp, Homo sapiens
tcgaactgctgacttcaggtgatctgcccacctcggcctcccaaagtgctgggattacaggcgtgagctaccatgcctggccctcaagtttttctttggaccagtagtagtatctgaatgaactgcacctgaaggtttgtttcaatgtttgattttttgcctccctttcatgttggctataaggaaaaggagcatttgaggctgtggtgggggtcagggactgagaggctccaggtctcaggaggctgcctccacagataggagtgctggctgagcaggccttccagctttctttccttttttttttttcgagatggagtctcatttgttgcccaagctggagtgcagttgatagaatctcagctcactgcaacctctgcctcctgggctcaagcgattcttctgcttcagcctctcaagtagctgggattacaggtgcccgccaccatacccaactgtttttagtagagaccgggtttcactatgttggccaggctggtcttgaactcctagcctctgatcatctgcccgcctcagcctcccaaagtgctcggattacaggcgtgagccgctgcacctggccaggccttccagctttctcacccacacacagacctgcctaggcacaggtgcatgcctctggcctggtctatgcctcagcaccttggtgctctgggctgttaataccctgtagcatgcattgtgttttcagccttttgaggcattttcacgtccatcatagcataggattggggagctaggagtcagagtgggtgtgactcgtgtgtgtttggcagctgctcgttgagaaccttgaaagtcgaggctcccagtcagaattttaggtacctgcctgttgacctctggctctaggatgtgtgttttagaaacctgtatctagtgtgcgtgcgtgtgtgctcactggagcgagtactaggaggttgtagggaggaataccaggtattacagaagggatcacttagagcttggtgagtgggtggataagtaggtgcctgagagaggtcaggagtaggaggaaggaagcctggttaa

SEQ ID NO: 28892 - DNA, 1003 bp, Homo sapiens
ggctcatgctgcttccagatgctccacttcccattctaaattctcacaaaccatctgttagctaatcgcatccagaattttgtctgggtttcatttcaagctcactgttttacattttatggaatttgccatcttttgacaaaaaacaagagacttgacccttcctaagtcttccagtgtcctgtgatgtaatttctctatgacaggagactagtcttggactcttactgctgtttgccagtgtgtttggtcagctcttaagaacaccctttcctcatctttggtgctccttttttttttttttttttttggcattttttttcttagtgatactcagcgttctttgaggtcaccagcatcctcaacattcttgctcttcattcccataattgctctgtgtcatctgtgattgcgtttttataatttcttcttggattgtctttgccccatttcaaaacctgtagtaatttggattacatctggtctctgtgtcttttgaattggccttcccaagggcccatggtacaacttcctttactgactgacctggaattatcagattcccactttaccaattggttttgcttcattgcttagaattaaatttgtattagcattttcttcattgctgcatctgcttgctgaggtgaagtaatctgcaaagtaagtttaggtttcattaatactgattggactttgtattggactcatgatgaatccctaagagatcatcatgagttcctcctgctgggtggcctgcagtgctcttggggctgtatgtgttcatcatgaagcatctgactcagccctgggggtccatgtggcaagcttacaggctcccagtgtaatggggcttctgtccctcacctcacgtcacattctagcaacgtgaagccttcttaccaaggcttcccagaaaggcccacaagttagcattcaccttaagcaagaatctcaggtgtgtccttcccatgccgtggtggtgtgtggatgtctggtgccc

SEQ ID NO: 28893 - DNA, 1028 bp, Homo sapiens
tgctctgttgcccaggctggagtgcagtggcaccatctcggctcactgcaacctccatctcctgggttcaagcgatttctcctgcctcagcctcctgagtagctgggattataggcacgtgccaccacacctggctaatttttgtattttttagtagagacagggttttgccatgttagccaggctttgaactcctgacctcaactgatcgctcacctcagcctcccaaagtgctgggattataggcatgagcctcctatgtttagctttttgaggaactgtcaaactattttccatagcagctgtaccatattccattccaaccagcagtatataagggctcccttcttcaccgccaaaaaaaaattcttccacatcctcatcaacacttgttattttccatattttttattatagccatcctagtaggtgtgaagtggtatgtcattgtggttttgatttgcatgttcctagtgactgatgttgagcatcttttcatattggcttttggcaaatctttggataaatattttcaagttctttgcccattttttaattgggttatttgagcgtttttgttttttattttgttttatattttttgagacagagtctcactctgtcgccctggctggagtacaatggcactcacgatctcgactcactgcaacttctgccttccagattcaagcaattctcctgcctcagcctcccaaatagccaggattacaggcactcaccaccataccccgctaattttttgtatttttagtagagatggggttttaccatgttggccaggctcttctggactcctaaagtgaggtgatccacctgccttggcctcccaaagtgccaggattacaggcgtgcgccaccatgcctgaccttagttattgtatttaggctgttgatccattttaaatgactttttgtgtatagtgtgaggtaaggtttcagagtctttcttttgcatgtggaaattggtgcagttgtcccagcaaggttattctttccctgttgaatag

SEQ ID NO: 28894 - DNA, 1032 bp, Homo sapiens
gtggaggtggaaggatcacttgagcccaggcgttagaggttacattgagcagggatctcaccactacactccagcatggctaacagagtgagaccctgtgtctaaataataatgtatgggccctttggataaggtagtgtttgtgatttaatgtaaactgtctttttcttgttgcagagaaatgctaactttgtcttcttcatccatacaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctca

SEQ ID NO: 28895 - DNA, 1027 bp, Homo sapiens
ggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagc

SEQ ID NO: 28896 - DNA, 1044 bp, Homo sapiens
cagcttagcaagataaggcctggcgaggaggcccctggctaggcctccctctgaacgtgaaggacgtccccttcctcgtgaatagcttggtcagtgccaccagtaacagacgtggcctgcatagatctcaaataatggcagaagaccagaggggcctgcaggtcctgagaggtctggcccatgctgcccctggctgctggccagcccttgatccctgcaatggggctgcaggagagggcacaaggagtgtgagctgcaggtacagggggtttgggaagggacttgggagcttccctggaggccacgggtgcgtgggaggaagggcagggagccccaggatgagggaaattgtcaagggcctggggctcagcatggagccagatggcatagccctgccaggccaggatctgttctgaagtcttcagctaacttagcaaaagagaggacttgctgggaggtactgggaagcctgggaggtggaaggtgctggggcagcatcaggatgtggggtacaggcagctcccaggatggggactcagctgtggggatgctctgactgggcagcgtgaacacagtgacctgcaatggtctctgcacaactttactccccagagagcaggactgcctgggcgggtcagatgccaccctcctgcccatcactgctgcctgctccatggggagaggggggagctctggcaggaccctgcggtgggccacatggagccaggcagggctggtgcccgtgctggatggggtgagaggtgctcagcgcaggtgtctaggccctccctctggaccctgggctagtcaccgtaagggatgcagggggacctcccagtgaaggcctgctgtggggaggccccgagggtgagcaggagcccctgtcccagcattgattcactgttgtgtacccccaggtggacacgcatcccaactgaacacctgctccggggctccccaccacccccgcagcggcgctacgggcataccatggtggcctttgaccgccacctctatgtgtttgggggtgcggccgacaacacg

SEQ ID NO: 28897 - DNA, 1044 bp, Homo sapiens
tgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgcttt

SEQ ID NO: 28898 - DNA, 1048 bp, Homo sapiens
cgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggcccc

SEQ ID NO: 28899 - DNA, 1127 bp, Homo sapiens
aaactctccttctgacctgcagagttttcatctgcagaatgtcccctcctggtgcacagcattcatgtcccttgtcctcatccctggtgggtgctctcgccgcctcctttctgatcccatcctcctccttgtcctaccaaccgtctgtactcaccctgtgtatttagtttatataaatgttaatgcctggccagccgtggtggctcacgcctgtaatcccagcactctgggaggctgaggcgggcggatcacctgaggtcagaagttcgagaccagcctggccaacatggtgaaaccccgtttctactaaaaatacaaaaaattagctgggcatggtggcgagtgcctgtaatcccaactactcgggagactgaggcaggagaattgcttgaaccctggaggcggaggttgcggtgagctgagatcataccattgcactccagcttgggccacaagagtgaaactctgtctcaaaaataaaaaaattaaaaataaatgttaacacctgtagtcccagtgctttgggaggtcaaggcaggaggatcactttagcacaggaggtcgaggctgcagtgagctgggatggcgctactgctccccagcccgggcaacagagtgagactcgatctcaaaaaaaaaaaaaaaaaaaaagaccagcgggggtggttcatgcctgtaatcccagcattttgggaggccaaggtgagtggatcacttgagcccaggagtttgagaccagcctggtcaacatagtgagacttcatttctacaaaaaaataatcagccatgctgtagtcccagctactgggggtgctgaggtgggaggattccttgagcccaggatttcaagaccgcagtgagctaggatcaagccactgaagttcagcctgggtgacagagcaagatcctttctctctaacaaaaaattaaaattaaaaaatattggccaggtgtggtggctcacgcctgtaatcccagtaactttgggaggctgaggcaggtggatcattcgaggtcaggagttcgagaccagcctgaccaacataatgaaaccctatctctactgaaaatacaaggattagccagacgtggtggtgggcgtctgtagtccagctacttgagaggct

SEQ ID NO: 28900 - DNA, 1051 bp, Homo sapiens
tcctgtactgggttctgagatcccgaagggcagggatcttgacctaattcatcctggtagccccctagcctatcccagttgacccagtttggaatctccaggctctcaggggtctaagaggggacttattatggttttaaaattattactctgtttctaaaaaaaaacagaccttggaaaaaaattgtaacattaactgagtatttattaagtattaggttatttacgtaagtcatcttttcaacactcaaagttagtgtattgtcatttgtattttttataaatgaggacattgtgaggttaagtaggttaagggagttacctaaggtagaattgtggaacgtggtggggagagagaagacgctgactcttcctggctccaggatccaaattccatgcctcttgtcaggctgtctttcttactcaaaggctgcatggagcggtgtgttgtttcttaagttgaggatggaaaggctttcagttcactaggggaacaccagttatgtaatgctgatcattggctgtgagaatcaatgtttaagactgttttttttttcttttaaaggaagaaaaattattgatacaagttgataaacagtcttttcagtacatagggtggtaataaagtgattttcgttggtgaaaagttggggcttagtgcatggaacagtgccttaggcatagcaatctagcaaatgttgaatgatcaaattaattacatcttaaagaactttagatttctgttaaaaatgttttctaggacattccacagcaaagatttctttgtaacaatggactgtctgcagatagtgtaaaacacattattaaaagtagagtgatttacatatactacactgagaagttattttaggcaaagtgagtatgataaagtcttttatttcaaaagcacttgccaggaggcttaacctcttttagaagcctttttaggaattacagtgttaataaaacattaagtacattttaatttgcaagcagctaatttagcattgttggctacaaccagattgtaaccattgcttcaatcaggatg

SEQ ID NO: 28901 - DNA, 1048 bp, Homo sapiens
cctccacactccagcctggagagcgagactccgtctcaaaacaaacaaacaaaaaacaacaaaatgtggaattactggcataagccacttcgtccaaccagcaggtgaactttttaacgtttgaagacagatgtatgtcatcttcacatttctttaggccataggttcctggaccttttgattgttcctggtaggacatggtccttgctgttcttgtcctgagcagcccttatttgatgtggtcttctaaagtatggtgtccagaactggacacagcatttggctctgaatagttcagggtggcctggacgctaaacatggcacaaacgattggtcagctaaaccagtcagtttttcatgctgctgctaaggttcatgccttgtgcttggtgaaaaattaagtgtttggaaccaagtccaggtctttactggatctctaaaatatttcattctgtgacttggggtgtggttttgctatccaggatccttagaggtttggtctttaagcctgtattcgttccttccctgatatgtggtacctaactacatctctctcagcccacttcccaccagggtgacttcaggccaccagttctaaagccattcgattctcctcagctcttcttgatccagcctctgtttatccattttgtacagaaacattgtagtggctgttgagagaaaggagcatcccttttagccagggcttggggagctccttagaggaacaggcatttgagagaggctttcaatgatgagcatgttggggatgtggggctggtgataggcaggacagttagggacatccttccagaagacatcctggggaaagacatagaggggggaagtcaccaggctgacttggtaggattctgcacactgctcatttgggttgcaccaagagctttagttggaattactgggttgcaccaaagagttttagctggaaatattggatgggaggattcctacatattttgttgggggaagggtcgtctagtgctgttggatttcttttctagtttttctttttttgagacagggtctt

SEQ ID NO: 28902 - DNA, 1035 bp, Homo sapiens
gatgattaggagtcctacaagccacaaaggggaaagagagacttcccaggccagcagaagagattgtgccaatgcatggaggtcattggaattcaggggattggaatggaacagtgggtgcccttggggagctggtggaagaaaatgtttgagatagatagacagcttgactgttagcctgaggggctgaattttaggctgaaggtaggtcagaggggttaggactgggaaaatgtggaggaggaggccttagctccgtggggaccagtggtctctgcacagacagatgcaatggtgtgtgcatgtgtctgaagagcccatgctggggagggagtgctagaggttgcgggggcgggtcatggtgtcaccttttgcagctgtgggagctgaggctccaggaagggtagggaagaacccgaggctcggtgtactaggtgcgaatgccgccttctgtggtgaccactgtcttctcatcctttgcacctataggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatgattgcgtttcactgtgagcctgaggatgaccaggaggtgccagcccaggcccagttgatcatttcttcctcagtgcaaaacctgtctccagcccagcctgactgctgaatctgtccaaaccctttattatttttttttcgg

SEQ ID NO: 28903 - DNA, 1032 bp, Homo sapiens
ctctgtcacccaggctggaatgcagtggcacagtctcagctcactgcaacctctgcctcctgggctcaagagatcctcccacctcagcctcccaagtagctgggactacaggcaccaccactgcacccagctagtttttgtgttttttgtagagacggggtttcaccatgttggccaggctggtctcgaactcctgggctcaagtgatccacctgcctcagcctcccaaagtgctgggattacaggcgtgagccactgcgccccacctgtttctttgttaattggaattccccgtgcgtgaaagtggagtgaggaggtgtgatacgcctcccctgtgcccatcatcaactccagcccctgctgtctcccatctgtgcagttctgtctttgctcccaccagtacccccttgcatgatgctgaagccccaatttaaaaaacagttttcacatcagaaggatttttgtttgtttgtttgtttttgagacatggtcttgccctgttgcccaggctggagtgtagtggcatgatcagagcgcactgttgcttcgaccttccaggaccaagtgctccttccacctcagtctcccaagtagatgggaccacaggcatgtactaccatgcccagccaattttttttttttttttttttgagatggagtttcgctcttgttccccaggctggagtgcaatggcgtgatctcggctcactgcaacctccgcctcttgggttcaagcgattctcctggctcagcctcccgagtggctgggattacaggcatgtgccaccacacctggctaattttgtatttttagtagagacggggtttctccatgttggtcaggctggtctcaaactcccgacctcaggtgatcctcccgcctctgcctccgaaagtgctgggattacaggtgtgagccaccgcgcccagccccagctacttttttaatttttatttttgtagagatgaggtttccctatgtcacccaggctggtcttgaagtcctgggctcaagtgatcctcccgcgtcag

SEQ ID NO: 28904 - DNA, 1074 bp, Homo sapiens
cggggacaagaagtgtgcatgcggattggttcctcgcggctgggggcggggccgcgcgggccggcggaagcggcgggcttcgggaggggcactgcgacggcgttgactgagggggcgccactaggcgcggtcacgtgcattcgcggtgcattcgcgggggcgtcggtgcgggtcgcgtctcttaagacacccagggagacagacgtggggcagaactcatgggctgaagtgagagatggctggggcccaggcgagcgaccgagcagggtccgaacagagccagcgagggaccccgggctgtgcttgaggcccgacgacgcgccatatcccggcagcgccgcagctcaggcctctgcgaatctgtggtccacacgctgataaacttagaggcctctgcactggggcagaaaccgaaaggcatgacccagaccgagaaagatatttgcatactgagaaagtgtgaaacacaattgtcgagactaaaaggagacactgagaggatacgccaatcaggttagttcagatgtttgttgagcacactccatgttcctggggatccacccttatagaagttaccttttagagagaggagacagacaaatacgtgtaatgctcaagttgtgataagtacgatgaagaagtacaaagcagaagggagggcgcggtgtctcacgcctatcatcccagcactttgggaggccgaggcgggcggatcacttgaggtcaggagtttgagaccaggtctctactaaaaatacaaaaattaagtccgggcgaggtggctcacgcctgtaatcctagcactttgggaggccgaggcgggcggatcacgaggtcaggagttcaagaccagcctggccaacatggcgaaaccctgtctctactaaaaatacaaaaattagccgggcgcagtggtgggcgcctgtcatcccagctacttgggaggctgaggcaggaggacaaagcagagagtaagggattagggggtggtgggtcgaaacacatgagagatacatttgcgttcagagacagaccgagattggtacagataggcagaaatgctgacagagcagg

SEQ ID NO: 28905 - DNA, 1065 bp, Homo sapiens
gtctcaaaataagtaaattaattaattaattacaaaaattgacaaccagttggtctctatcttcaaaaaattctgctgggattctaattggaattgtgttacagttgtaggttaatctggggataactgacatatttgagtatttcaatccatgaaaacaatatgtctatccatctatttaggtcttctttattaatttatttcaccaagattttatagtttttttttttttttttttttgagacagcatctaactctacagcccaggctggggtgcagtggtgcgatctcggctcactgcagctttgacctcccaggctcaagtgatcctcccacctcagccctttaagtggctgggactacaggcacgaaccaccatccagggctaatttttgtaattttcgtagagacagggtttctttctttctttctttcttttttttttttttgagacggagtcttgctctgttgcccaggctggagtgcagtggcgcaatctcagctgactgcaacctctgcctcccaggttcaagggattctcctgactcagcctcccaagtacctgtgactacaggcatgactacaggcattcctggctattttttgtattttttgtagacatggggtttcaccatgttggccaggcctgttcatattttgttagatttatatgatatgtttcatgtgttttggagttattgtaaatggtatttaaaacatcttttgtttccaattttcagtatatagaaacactgtgaattttcctatatcagccctgtattctgcaaccttggtaaactcattggttagtttttttgtttgttttttagagatggggtctctctatgttgctctagcctgtgcaacagggaaatctcagctctaaaattcacaggcacaatcatagtgcactgcagtgttgatctcctgggctcaagtgatcctcctggctccacctcacatgccatggcacctggctagctcacagagttttggagtttttagcaatcatgtcatctgcaaatagagagaaatttatttcttcctgtccaatctgtatttctt

SEQ ID NO: 28906 - DNA, 1031 bp, Homo sapiens
ccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagt

SEQ ID NO: 28907 - DNA, 1050 bp, Homo sapiens
ctgagcaggggagagacagcaggtgcaaaggcgctgagcagacactccctggcccctggaggccccaccagagtggctggaacctggtgcaggagtgtgggtggggtgtcagggccaggtcctgcaggactcagtgggccccaatgaggcaggaagaccttggcagggttggagcagagaagagactggagctgccctcccaggaggagctaatctacactttgaaaagatctctctgctgaggtgggaaaataggctagggtggggtaaggctgggggccatgaggggctactgcaacatcccaggcagagaggctgctgacccaggggtgggagctctggaggccctgagaaatgcaggtgggagatttgtttttttaaagctgcagcttttaaaggacagctgcagttttggtctgaaccagtagaaagatggagctggtattggctgagaagcaagatacagaaaaacccattctggagaggtggggaattaggaggtgggtctgagacctggagagccattgatgggcacatgtggccagagggagagcaaggctggaggtggcaacctggagcccctggcactgaggtgtgtggcaggccggggaccacgtgaggtcacttagggatcaagggtaggtaggatcagaagaggctgagctgggctcctgggcctccactgtggggaggatgagttgagaagcatcgagaaagagagattgaggattgacgggcaagtgaggtggaagcacagtcacagtggcgcctcgggaggctggagaagagcgggtcccagagagcaggtcccctgtgtcaagcaggcagggcatgcccagggactgagcaatgcaggcacagctggccacatgattttgggggcccccatttgaaaattattaagggcctgacatgatggcgcacacctgtaatcctatactatgggagactgaggtaggaggatcacttgaagtcaggagtttgagaccagcctgagcaacatgtaagagcctgtctctacaaaagtaaaactaaaattatgcattccag

SEQ ID NO: 28908 - DNA, 1069 bp, Homo sapiens
tgcccaggcaaggtggcaaagccgaactgctgcggaaggcagggagcagcacgctcagctgtttctggcaggttcagagcaagggcttttcaggccattagggcctgagctagggctttagcggcagcctgttatcttgtttaaacagcccttgctgtttgaggtgccaggcttagctggtgctgttactatgagcactacagttgtcaccaggcatagttgcaggggggagggggccaccggcaagcagaggctctgacttctggactcggctggaacacacccctgccctggcccccatcccagaggagccccatctgtcgctggcctgggacctacaggcctgagtactctgtaaaatgggcccctcccaagctgcctgtgccctcctgagctgcctacatgggcagctgagcagccctgtgcgggtgggcaggagcggtggcctttcttatccccagggaaaagtcgagggcctcatgaaaacccagggcctgagagtgtctgaggacaggagttgtggccaccccaggttgtcaatcctcctgtgccactcgagagtctccacttcagccaggcaagtcctgtgaactgggggcctctgtctgcaggtggcagcagctggggtgtagggagcagaagctggggcgggagcaggggtcccaagcacagtgttccagcaagaagcaccggaacccaccaagggagcgcagcagtggagtcgggtcctgggcctctgcacacagaaccccagggggttggccgcagggtgtgaaaatcaaacccacattttcattcaccagaatacgggatcagatagttcctgatcgttttaaagccggaagagcacctgcttatcaaatgcctcttcagtctgttctgccagattgacccattgaccgacgaagccacagtgaggaaggacacagaccagctgtcactggagggccagcccagggcaaggcctgctgcgggggaggaaggcccagcccgagtcccttcaaagcctcctataggtgcccatcacccaccccagccacaccctaggcatccacagaagtggcgggtc

SEQ ID NO: 28909 - DNA, 1037 bp, Homo sapiens
tgtgtatcccacatcagccctcagccccctcacgagggaagtatgcttacatattctgtgtgtgtgtggttatttttttggaggggggacaggttcagaacagctggcagagcaggaggttgggcctgcattggccactccgcagctgccacaccggctccagcattccctcctgcctgtcctcacccaccttgttgagagcaaggctgtctgcttgcctccatccctcacacaagagcacctggagagcctctgcccagggaggtgaggaaagggagagggcagtggggactgccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaatacaacacagtccgggggcccctcacctggctgaggtatgtgacaaggctctgagctgatggtgtacgttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgcccagaggggagcgaggaggaggcccagaacataccccttcctagaacaggaaggtggggtgaccctgcagggtggcctcccacacctcagtgatgcctcggtgacccctaaggcagaagatgcgtgaagcaggcatgaggccctg

SEQ ID NO: 28910 - DNA, 1141 bp, Homo sapiens
accactatactgggctaatttttaattttttttttttgtaaatacagggtcttgctgtgttgcccaggctggtatcaaactcctgggctcaagcattcctctagcttcagcctcctgagtagctggggttacagggatgagacacctcaccaggcctcttagacgtttttagtaactaaggtcacttaaacatttttaaaagggattattttccctcagacagtttttcttttttaagacttaatttttttagagctattaggttcacagcaaaattgatcgggaaatatagcaatttcccacatactccctacccctacacccccacagcctccccagttaacatctcccaccagaggggcatgtttgttacagtccatgaacctacctgcattggtgcctcattattacccaaagtccagagtttacatttgggttcactcttggtgttgtacagtctatgagtttggatcctgttatgttttaaaactcctgcttcttttagccctgggcaccttgacactctgcctagcagtttcccctgacgtgggtccatgtatggcaggcatggaaagaggaatcctcactggctcagccatctgtctctgcctgtttactgatgttctttagagggctgtggagcctgctggtctgaaaaggaacaatgaggaaaatcactcatgggggtgggtggggggaggaagtcaccctaatgctccgcagtggcagatgtggtgacccagatctaataacctcggaatcagtctgtttggatgaatggaccgtcccatttccaagttgagggcccctcaagggagggggctgaagccatccctgggcacggtgacaaagtgcttcccatagggcccctcatgggctcatctgtcgccctggggtggggctgcccatttacaggtaaagacacaactgggaagcggcaaggctgggattctgggtctctgtgtgaatgcagagctgttccgtttggcacgtggtggccctgcggtgttcttcccactaccccacactgctacctgcaaagcacaactggggaggttcagggcgtccttccagtctttgcaccctgggcccgcctgtgggggtaatgatagacggctgtgagccctgctgtaaaactatg

SEQ ID NO: 28911 - DNA, 1032 bp, Homo sapiens
ggggaaggtattggtaggactggggtgccctgtctcctttgtccccatgagtgcaggggatagatctgaaaggagaggggaaaatggatgttttcttctttgtctctcctttctccctgctttcaagtctgtgaattaattggagtcattcccaagggaggagggtcactttattgaattttaagacaaggcggggccaggcgcgatggctcacgcctgtaatcccagcactttgggaggccaaggcgggcagatcatgaggtcaagagaccatcctggctaacacagtgaaaccccgtctctactaaaaatacaaaaaaaaaattagccgggcgtggtggcgggcgcctgtagtcccagccactcaggaggctgaggcatgagaatggcatgaactcgggaggcagagcttgcagtgagccaagatccaccactgcactccagcctgggtgacagagcaagactgcgtctcaaaaaaaaaaaaaaagcaagacaaggcatatgacagggcatgatactgacgagaccttggacatcaaaggctggagcaggacttcctcctagggaacatcctcagatatgtagatgtcaccgtgtgggctcagacatccagggtggaccagagccggtggcttaggtctggtggtctgtccctgactgcacttttttcagagctgttttggtttgaagctcaaagcgggctttttatttatttatttagagacagggtcttactccgctgcccaggctggtgcagtggcacactcacaactcactgcagcctcaacctcctgggctcaaacagtcccctcatctcagcatctcaagtagctgggactacaggcatgcaccaccatccccccaggtaatttttaaattttttgtagagacaaggtttcactatgttgcccaggctacaagaggactttaacttttttttaattaaaaaaaaattttttttgaaacaaggtctcactctgtcgcccaggctggagtgcagtggtgcgatcatggctcaccgcagccttgacc

SEQ ID NO: 28912 - DNA, 1045 bp, Homo sapiens
aaggagctggtggttgctgctcgccaaggggatactcagacagccaaagcctaggcaggatcagaagctcaggcagcagagccaagatttgaaccaataatttttttttttttttttttactttactctacagtattgggattggctgaactttccttaaatgaccagatagtaactaattttatgtttgtggctgagaggcaaaatcgatgctactttgtggatacttacataaccatttggaatgtgagcatgtgaaactataaagagcattcttaaggcctaggtcacatgaaaacaggtggcagtgggctggatttggcctgtgggctgcagtttgccaacctgtgtttcacagcgagctgcctccaaatgcctggtggtgatgcaatcgatgacagagccaggtgtgggcgtctcacatctgtgctcaggagctcacaggagcttctctcctatagaacctgtgaggcaggtagggtagtcttccaaaccccatgaggattctttcctcagagaagttgccggaggaggaaaagctggatgagagatggtcacttggtttctaacttccctttctcttccctgtttcctgctgcttcccagggctgaatgaatattccctgaaacaaggctggccatgagctaataatcgttgaagccaaatgatggggtaatgggcattcatgatgctgtgctcttacttttgtatttgtttgaaattttccaggataaaaagctaagaaaataggctgggggcggtggctcacgcctgtaatcccagcactttgggaggccaaggtgggcggatcacgaggtcaggagatcgggaccatcctggcttacacggtgaaaccatgtctctactaaaaatacaaaaaaaaagtagccgggcgtggtggcgggcacctgtaatcccagctactcgggaggctgaggcaggagaatggcatgaacccaggaggcggagcttgcagtgagccgagattgtgccactgcactccagcctgggcaacatagcgagactccgtctcaaaaaaaaaaa

SEQ ID NO: 28913 - DNA, 1067 bp, Homo sapiens
cctccgccttcaaatggcctcctgtatgcctgtgtcttctgtctctttaaagatatttgtcattggatttagggtccatcagtgtgatattgtgatataagaaacctgtatgtggtcttccttctggtttctggcacaagctcctaaaatcattgtaattttctgaacgatggggtgataggagcatcttttgttattcatacaagcccttttctgtgggacctgaggttatgctaatgaggtgatgcttgaggggcccctagatagctgtgggacggggctggttgccagaggaaccagccacgtgattagagggttggaactttagctccacccctgaactctggggatggggagaggggtggagattgaattgatcacccgtgtctacagccatgccagcctgatctcggctgaactgatcatcagtggccaatgatttagtcttgcctacctagtggaacctccatgaaaacactacacagtgaggttcagagagctttcacgttggtgaacacatgaaggtgctgggagggcagtgccccaagaggccatggaagctcccccacaatacacaccctgttacccagccctcttccgtttggctttcgtgagtggtatcctttacaataaactggtaaatgtgagtaaaaggttttcccgaattctgtgagctgttctagcaattttttttttttttttttaagatggagcctcgctctgttgcccaggctggagtgcagtggcgagatctcggctcactgcaacctcccgggttcaaatgattctcttgccttagcctcccgagtagctgggactataggcgcctgccaccacgcccagctaatttttgtgtttttagtagagacgcgatttcatcatattggccagactggtcttgaactcctgaccttgtgatccgcctgcctcagcctcccaaagttgctgggattacaggcatgagccaccgtgcccggctctagcaaattattgaacctgaggagggggttgtgggaacaccccatctccactcccagctttagagtcagtaggtcagaagtacaggt

SEQ ID NO: 28914 - DNA, 1052 bp, Homo sapiens
aaacaggagctgcaggaaggccctggaggagggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctccactaaaaatgcaaaaattagccaggcatggtggcaggtgcctataatcccagctactccggaggcggaggcaggagaattgcttgaacctgggaggcggaggtggccatgagctgagatcacgccattgcactctgcactccagcctgggcaacagagtgaaattccgtctcaaaaaaaaagagttggaaaacagttggagaagccagaccctgttggcaaagtttgcaaggggtgctacggagagggaggtgcccaccccaggggtgaagacaggatgggtggggttctcagctccactggacaccaaacagaagctgtaagtgcaaggctagtgcccatgtcgagggctgggcctttctgggcccttcataaacattggcaaacaaagcttgggttctcggcttgtctgggccaagttctaattccttccaggagcgtgggcacgttgcttacctcttagctgtttcttctccaggaagtggtggagctggagcctgctgcatgggagggttctgtggagtgagatgagatgttttacgtcatgctcttttcacaccttcttggcacccagaaagagctcagcaaacattagctgctaccagccaccctgactgtggctgtcagccagcattgttcttcccaggccctgccctaccctcctcctggcatagtgtctctcagggcataggaaactttctcggccagattggccatgggaggctttcttggggaccagagagtctgcagggagggcaagtcaagagcaggtgagagggagggaagggcgagcaggacccttgacct

SEQ ID NO: 28915 - DNA, 1074 bp, Homo sapiens
aatcctcagaacataccaccagactggtctttctcaccccatcatgtttaaggaaacagaggctccaagaaatggaggagcatagccagcatcatcgtcacagagaaggagaagggtgggctcgggacagtgaagatgcaggctgtcctggccacccttgctttctgcgggctcctgtggggatgatgattttagttattcaagaagacaggtggcgtttcttccaactggtgtttcccacctgggatgtgggggggctccccaaagggagtgttgtcctgccaactggggcctgctgtcccactgccctgccccgctctgaagcacacacagggacccatgcccacacggggttacttgcaccaggacacacacaggcctgacacgcacaggacatgcccttgcatgggaacacacacacagaaacatggagatgcacacagtgagacacacgggcacacacctacccaggccacaggcctgtgtggggttccacgcacgagggcacgctcaggcactcacactcacacaagaatgaacacacctggaaacatggagacacacagggacacacagacgcagagcacataggatcttcccctgtgcccttttcatacacagactcccatggccccggggagccaaagtgtggtaccgtccctgtcccggggccactgaggccctggccctctctgtcccacagctccagctgggactgtttgccctagttgagatgctgagccttggggacagtggtttccagccacgtggccttatgccggctttgggatgcagtcaggattgtgaccccggcccacccttgccgtgtgccctggaggacgactcgggtgggctatgcaggaagcctgtgctgatctcaaggccaactgtcctgtactccaggccggggaccaggctgctgagcgcttccgagagggacatctcctgggcagggagtgacataggccacgccatgtgggcctcccagccatgtgctggtgctgtgtgggctgggagggcaggcaggggccgagtgacggggactgcagagcggggcctgagatgctgtgacat

SEQ ID NO: 28916 - DNA, 1041 bp, Homo sapiens
aaacagtgtccacgggggagaaagaggccaggctggtgtcgcagagcgccaatggcatagtcaccaccactcctccgacttacttcctcctgggatcccacaaacaagccccccagctgggagcctggacctccagggaccagggcagccgccacctacttggcgtgagtcatgaatgcccttcacacagcaatcagattccttcctgtctagccatggttcccacccatcactcccactgacacagggaccaggggctggagccagatagtgcctgctccatcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacataacttatagaggtatgttttatgtctctgtctgggtactggagataccacagagaatgaactggacaaagccctgtcctccacgtttactttccagcagcagagacaaacataagccaaaataaagatcacgtcacaggggacgtgatgggagtcggaggaggtatggtcaggtaaggcggataccgtcatgaaggcaccaagaatcctcatttgtatttcaaggattatctgagggccacgtaggtcttgtccacacagccattcacccattcaggggggtctctgatgtgcctggggggcattccgagatgaatgagacatgcatggtccatgtggcagaggcaccaataggagagaaacttatgtatgtagcctcttaaacagacttggagaggggcaggccccagggggtctcttgcagcaggaacacaaaatgagtgatgtttgttttgaaccaatatttggggaagatatgaagatgtaaacatcatgaaaatgtaagatcacatg

SEQ ID NO: 28917 - DNA, 1084 bp, Homo sapiens
agaattggcccatgggctggagtttgatgaccccagctctatgtcagtctattttcaaataatcttacactagttaacatagagcattttaaaagtatttttccattttttctttttatgtaatttttgcacaaaattttttttgtgaaattatgttttcactttagagagtacattatcttctaaattaaaatgattcaaaaatgcttgttgaagtgtattcacgtatttaaatacatgaactgtattcacgtatttactgcttctggcagtagtgttccttcctttgtgttgatccagatttccatctggcttttttttttcttttgcaggaagcacttccttaacatttcttatattgttgtcctgccactaacaaattttctcggcttttctttgtctcaaaatgtctttatttcatcttcatctttaaaggatattttcactggatatagaattctgtgtcgacagtcattttttttaagcatcttaagaacgtttgttttgttgttttctggcttgcatgggttctgacaagaagtctgctagtagtcttatctttgtactttgtatataatatacaccccacccccagctgattttctttgtatttatcctgcttatggttcattgagctccttggatttatggatttatagttagtcagatttgggaaattttggccattgtttctttaagtattttttctgttcccctcccctttttccagtactccagttttacatattttaagtcactaatattatcctaattactgaagctttgtactttttgttttttggttctcaatcttttttctgtgctttaatttggatagtttctgttcctgtctttaagttcactgaccttttatcctggagtatctaacctgcccttgatttcattcagtggagttttaaaatttcatttgtttttcatgcctaaaaggtctatttggttatttttttcatatctttggtttctccttcatttttgtagtctgttgctacgtaacaactttctccagaagttagcacctaaaacagcaggcatttgttgtctcgtgaagtttttgaaattcagg

SEQ ID NO: 28918 - DNA, 1158 bp, Homo sapiens
tgagatggagttttcactcttgttgcccaggctggagtacggtggcatgatgtcggctcactgcaacctccgcctcctgggttcaagcgattctcttgcctcagcctctggagtagctgggattactggaatgcaccactatgcctggctaatttttttgtatttttattagagacggggtttcaccattgtgcccaggctggtctcgaactcctgacctcaggtaatcctcccgcctcggcctcccaaagtggtgggattacaggtgtgagccactgtgcccagccgggagtgccctttctgtaaagcatcctgacatcaaacttttttgttctctggcccattaataccgcccctgggaatttgtcccaaagaaacattttcaaagaacaaaatgaatcagtaaacccactatatgtacagagattctctgtagcattgtgaataatactggagaatatggagtcgcttaagtatccagcctttaaggaaaggctaggttagtgacgggtcagccacttgaatggacaaaggtgtgacccatacatggtataattaagtagattctgcagtgacccgagacgggtcctgtgggtgagacgtgcagaatacaagattgtacccatctaccttgtgcattcagctctcaacaaagtatgcatttctctgcacaaagcccaaggagcattaagaaaaaggattattgttcagagtgatgtggttatggaaaatcttttttatgattcccctgaaaggtggcacgcctccaggctggccagtgttacagacgtgtgctttgcagattctttttcccccaagggatgtggtaagaacataaggatggcttggccttcccagggaagttgcagaaggaaattgtgtacatatggagggcactttaattctgcacatgtcagctgggaatcttttatggggcgataaaacagtttcttggtgatcatgtcgtgaggaacagctgcaggagtggaatcccgttgccctggaggtcaagtctttaggggtgggggctggcagaggtttgagggaagtggctttggctggctccacactactcagtcagcccaataaggggacttatggcaccctccccatcctgtcatcggacaatttgagcagaggctgggtgccctctctcag

SEQ ID NO: 28919 - DNA, 1060 bp, Homo sapiens
acaacttccgcctcccaggttcaagtgattctcctgcctcagcctcccgagtagctgggattacaggcatgcgccaccatgcctggctaattttgtatttttagtggagacgggatttcaccatattggtcaagctggtctcaaactcctgacctcaggtgatccgcccgccttggcctcccaaagtgctgggattacaggcgtgagccaccgcgcccggctgctgtttctcttaacatagaatctagcccagcataggaacttagtgttccaattggatcagtccatgctctgtctcgttacctttctttgggcaacacatagaaagttctggtttgtttatacccccgccctgttccagaaaggatgcaaggaagcttaccataagtacactgggcccaaatgactaaagcaaatgaaaacggagtggttaggaaaaactggataaagaggaaatgttcaagttgaagagggagctcgtactcagcttttatttggtgaacattgctgggagttgggcgtggctctgggcctttttagaaccaggcagaatgagacgtgaaaatcatttgcatactcagtgtggtcaaggttagcagcagcctgtggctctgaagaagtagaatcacacgtggtcctggaatctgagatttcctacagccctcaggaagagggcacagtatagtaaggaagaccaggatcgtccatgaactccacagtgagtttcactgggctgttcctcctaggagttctaatgtaaaatatgatgcccactgaaagtaatttagaacaaagtcttaaccagtggagaaccaaaatagtgttgttctgcgaactcttcctcagctctgggtggtatttggcatttgtaagagctgtgattcttaattggtggttagatgccatgccaaaattgttactgatttgctttgaaatttcagatcatcttaaaggtgggcatgagagtctttatcacagagggattaaatatgtgaagtagcagtacttgagtagcacgaatgaagtgtatgttcagcccaccttcagaatcaggattggc

SEQ ID NO: 28920 - DNA, 1051 bp, Homo sapiens
gctacttgggaggctgaggcaggagtatcacttgaacccgggaggcagaggttgcagtgagcagagattgcgccattgcactccagcctgggtgacagagcgagactccaactcaaaaaaaaaaaagaaaaagtaaactatcccctgcagaccttccctaaaagagtggctaaaagaaaggaaatgattgccggcatggtggctcccacctgtaatcccagcactttgggaggccaaggcaggcggatcacaaggtcaggagtttgagaccagcctgaccaatatggtgaaaccccatctctactaaaaatacaaaaacaattagccaggcatggtggcgcacgcctgtagtcccagctactcaggaggctgaggcagaagagtcacttgaacctgggaggcggaggttgcagtgagccgagatcacgccactgcactccagcctgggcaacagagcaagactctgtctcaaaaaaaaaaaaaaaaaaaagaaagaaaggaaaagattaaagaagaaacattgagacatcaggaaggaacaaaagaaagcatgataagaaaaaatgtagataaataaaatagactttcctctcctcttgggtttaacaaattatgtttgacagttgaagcaaaaattgtaacagtatctgatacggttctaaaggtatgtagaaagatttaaggctttaaggctgggcatggtggcttatgcctgtaatcgcggcattttgggaggccgaggcaggcggatcacctgaggtcaggagttcaagaccagcctggctaacatggcaaaaccctgtctctactaaaaatacaaaaattagctgggtgtggtggcgggcgcctgtaatcccagctactcgggaacgggaagctgtggcagggataattgcttgaacccgggaggtggaggttgtgttgagctgagatgacaccattgcactccagcctgggcgacagagcaagactgtgtctcaaaaaaaaaaaaaaaaaagatggataaagataaaacgttaatcaaaggaaagcaggagtgacaatgttagta

SEQ ID NO: 28921 - DNA, 1056 bp, Homo sapiens
tagccaggaatgtctcgaactcctgaccatgtgatccacccgcctcggcctcccaaagtgctgggattacaggcgtgagccacagagcctggccttctgttgctagcatttaatagtgaaaggttgcatgctttctgccagagaccaggaacaagccaaatatgtctgctgtcactattcttattcaacatagtgttggaagttctagctaatccagtaagctgagaaaaggaaataaaagacgtgtagattggaaaggaagaaataaaatcctatttgcagatgacatgattgtccgtgtagaaaatcccaagggatctacagaaaacttggagaactaataactgaattccccagggtcacaagatacaagggatacaaggtaaacatgcagaaatccattttatttctatatgccattaatgagtacctagacacaaattaaaaatacattaccatttatcatcactcaataaaaaaaggaatacttaggtataaatccaacaaaacatttacaggacttatataccaaaaactataaaacactgacgaaagtaatgaaggaagacctaaataagtagacatatcatattcatggattaaaagactcaagatgatgtcagttttccccaaattgatatacagatttaatgcaatttctgtgaaaatcccagcaagattttttttgtagataagatggttctaagatttatatggaaaggcaaagaaactaaaatagctaaagcaatttatttattattattattatttttttttgagatggagttttgctcttttgcccaggctggagtgcagtggcatgatctctgctcactgtaacctccaccttccggtttcaagcgtttctcctgccttagtctcccgagtaggtgggattacaggtgcccgccaccatgcctggctaatttttgtatttttagtagagacagggtattaccatgttggccaggttggtctcaaactcctgagctcaggcagtccgcctgtctcagcctcccaaagtgctgggattacaggcatgagccaccacacccg

SEQ ID NO: 28922 - DNA, 1062 bp, Homo sapiens
aagcacgtaccaccatgcctggctaatttttaaattttctgtaggaaatggagtctcggctgggcaccgtggctcatgcctgtaatcctaagactttggagagctgaggtgggcagattgcctgagctcaggagttcgagacaagcctgggcaacatggtgaaaccctgtctctactaaaaatataaaaaattagctgggcgtggtggcacgttcctgtaatcccagctactctggaggctgaggcatgagaattgcttgaacctgggaggcggaggttgcagtgagccaagattgcgccactacactccagcctgggcaacaggctcttcccatctcactgactctgtctcaaaaaaaaaaaaaagaaaaaagagaaaatggagtctcactttgttgtccaggctggtctcgaactcctgggctcaagcaactcttccaccttggcctcccaaactgctgggattacagacatgaaccactgtgcctggccagagctgggtgtttctgtaaggacgtcctttgtcttgatcctggaacatgactgaaggaaaacaagaatctttggagccatggcacatgaggaccatctctctcctcagaaagagtgccttaggttagagcagcatcttccagatattcttggcaatgctgggaccaaagcccaggcctggctgcccttgccagggcacctggcccaagtcggctttgcccagttccagcaggggttggggggcaggggaggaagctggggacatggtgctgctgcagtttgagccatcagaccctgtggcactgtccaggccccgtccagagagtgcatggggtgagatgtgagtcagggctggggaggtgggcaggggcctggccctgctgtgcacctgcttgggagtcctggccccgtcttagctctgtgagtccacctggagtccagcactcctcactaccccaccaaggccactgccagatggctcccttcctccctccccgccttccagtagaggtctcagcatggcagctcagcccatgtctcttgtctgcccaaaataccgcagaagcttcc

SEQ ID NO: 28923 - DNA, 1027 bp, Homo sapiens
gggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggtacccctggccctgtggtcctgggctctgcccacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagtggcagacaggcgaggctgagagaaggctgggtctgaccctgctgggggcccacatcctgcctctgttcccacccctacacttggctgccctgtagagccttgggaagggcagcgcccaggctgggagctggccccgactcattgccctccccactcctcttccaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttct

SEQ ID NO: 28924 - DNA, 1051 bp, Homo sapiens
aattggggtcttctgcaggggcatccaggagcagctttctgtggggaggggcccgtgttgagcacaggccagcacaggtccccatcggtggggatccttctgagggtggggagagggagggagggctctcaacactcacaggaagccaggggtctgcaggagcctcttgcctccaggctggttggggaagacgtcctccaggaagtagtagatatggcccaccgcaatccctgtgagacagccacggactgtggggtcaccctccacagcccagagtcctagaccagcagagcctgccccaggcccccatccacagcctggtggccctgcaggccccacagcatgagtgccccaaagccttgcacagagtgccagccccgggttggccgtgaaggacaagcttaaaaggcccagaagcaggcaggacccagggaggggagggcctgagaatagtggaggagtgggagccatggggcaggaaccctgaccctcccatcctcactcccatcaggaccgtgcaagcatcagtagatccgtcctgacgatgcaaattatgtgggccggctggcttgaggggctgtaagagcacagcagctgggagggcaggaagatggggatggagccaggtgtgaggagaactccagcaaggatgggagaggggccccagggcataagcagcgtgtcctgaggggagtggccagcctggggcggactagatgtaccgggaggctcacccagcaggtccacgaggatggagttgcccagcagcagcgagaagcccatgagcgcccaaggcaggaacggtgcctggaaagtgagcaggccgaagaagttgaccctcacccgagggctgcggcggctccacacgtacaccagcatggccatgagggcctggcccaggaagaacaggctgcccaggagtcccagcagctgggccagagtcaaggtgctccggtgcaggcctcagcccaagcccagggcccctctgacttcccaagaccctggaattcttcccctcatctcccctatgtgctattccctcatcaagatg

SEQ ID NO: 28925 - DNA, 1011 bp, Homo sapiens
tgcaaaatcacacagcaagcagtgtgggtgcagggaggggtgaagaattgggtttgataatgtgctgcaatagtcatgtcctgtctgatatgtccgcagaaccctgcgtttctttctaaagccttttttcatccatggtggcaacaccgcaacagccctgagaaatgtcagggcaaggaagatcatctccatctgaccagggaggcaaacagagacagagagattgagagagacagaggcagagagagagaaacacacacacacacagacagacacagagacagagagattgagagagacagaggcagagagagagagaaacacacacacacacagacacagagacagagagattgagagagacagaggcagagagagagaaacacacacacacacagacacagagacagagagattgagagagacagaggcagagagagagagaaacacacacacacacacacacacagagacagagagattgagagagacagaggcagagagagagagaaacacacacacagacacagagacagagagattgagaggcagagagagaaacacacacacacacagagacacacacagagacagagagattgagaaagacaggcagagagagagagaaacacacacacacagacacagagacagagagattgagagagacagaggcagagagagagagaaacacacacacacacacagacacagagacagagagattgagaggcagagagagaaacacacacacacacagagacacacacagagacagagagattgagagagacagaggcagagagagagacacacacacacacagacagactcagagacagagagtgagccaagaaggaaaggaatggtgggatggaggggggcgtccctgtagggggaccaaagaggggcttggggacggggagctcagtaccctcctccctggctcagcactacggcggctccggggctccggggacttggcaggggagctggaggagctggaggagg

SEQ ID NO: 28926 - DNA, 1034 bp, Homo sapiens
cagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacag

SEQ ID NO: 28927 - DNA, 1050 bp, Homo sapiens
ttgtttttgttttggagacagagcctcactctgttgccccaggctggagtgcagtggctctgcctcccaggttcaagcgattctcctgcctcagcttcccaagtagctgggattataggcacatgccaccatgcccagctattttttgtatttttagtagagatggggtttcaccatgttggccaggctggtctcgaatccccgacctcaggtgatctacccaccttggcctcccaaagtgctgggattacaggtgtgagccaccgtgcccggccagcatattcttgactgtcatatcatcagtgtgaattgtgcctttgttacatttaatacttttgggcttgaattctactttgatgtctatccctgtgctattttttttaacaaattgtatttccttttattagaatttttttatacttattatgtttaattaaattatttgaccttttttggagttatagttctgtgacttttgacacatgtgtagacttgttaccaccaccatcattaccactatcaggataaggaacagtccattgcttatggcacccctttacagacaccttcctttaccccgggctgcccctgatgtgttctccatcactatagttttgtcatttcaagaatgtcatgtaaatagaaatataatagtgtacaaccttttgagactggcttttctcacttagcataatgcctttgaaattcacctcagttgtttcatatatcaattgtttgttccttcacattagtagtagtattccactgtatgatatatcacagtttatctactcacctaatgaaggatatttgagttgtttccagtttttggtgatttgagtggagctgtaaacatttttatacaagttttgtgtgaacatttctctaggataaataactaggagtgagattgatgtatcatatgctagtgtatgttgagttttataagaaactgttttctagcatggttgaaccattttccattcctatcagcagtgtatgattcttccagttgctctgtgttggcattatcagtttttaaaaaaatac

SEQ ID NO: 28928 - DNA, 1051 bp, Homo sapiens
tacatacgttagttttctagatggtatcccccatatgtccgtatgtctctattcatttttctttattctttttatttttctcacactggataatttcaattgcctttccttcacattcgctgaccatttatttcgcctgctcacatttgtttttgaattttcagttgtatttttagtcttcagaatttttgtttgatttctttttagaatttctgtctctttagtgataatctcatcttgttcttacattattttccttatttcctttattattttgttcatctatcctgatttcctttagttgattcagtgtatttaggacagttaatatttttgactagtaatttcagtgtctggtcaggaatattttctatcaaattcagtttctcagggatggtttctatcaaattcctttttcctgtgaatgtgccacattttcttttttctttgtattctttgtaatttttttgtttagaattgtacattctaagtattatagtatggataatgttggaagtcagatttctgactttttcttgttgagggctgcagccatcaatttttgactttttcaaactatttttgcaaaatgtattccttgttgtttgtgggcactgtagattctgttccattatttctttggtcagccagtgacctgacaacgatttccttaaatgtctgattcaaaaggggggaaaaggtgttccatctctttaaatcttctgatagaagccacctgtgaaaacatcgatagcctgagaaggccaaaaccaaggcaagtatataccagttctacagggatctgccagaccaaccaaagtgcacaaacccacatttttgtaggtttggaaccagccagccactttaggaacatgagctgctatccctatagccgtgagtggtggggccgaggaatgggggatggtagctgagtcaagttattcttttaccaaatatcagcagcctctgctcatcaaacgctctgctggttgttttaagtgttcagtcaggttgcaaagttttgttttgttttgttttgctttgtttgaga

SEQ ID NO: 28929 - DNA, 1046 bp, Homo sapiens
cagatattcagattgacaaaatatatcaagacaatggggaaactgaggcaggaggatcacttgaggctaggagtttgagacaagcctggataacatactaagaccgtgtctctacaaaaaaattgaaaattagctaggtgtggtgatgtgcctctgtagcctcagctactcatggagctgaggtgagaggattgcttgagcccagaagtttgaggatgcagtgagctatgatcacaccactgcactcttgcctgggcagtagagtgagacccagtctcaaaaaagaaaaattttttaaaaaaattctaagttaaataacttggtccctgtaactttttatatgccattatcactctagatcttggaaacgtgcgactccaggaaagatgagctggcattacttgtcagttataagatagtcatggcacttttgccatttccctgggaagttcaagtggctgtgccagtgccgtgctcctcccgtccccggggtgcatattcaaggagagatctgactgtgtgtgtgtgtgtgtgtgtgtgtgtgtgtgtgtgtgtgtgtgtgtgtgtgtgtgtgtgtgtgtgtgtgtgtttgccctctgcttgtgtcgcttccaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaagtgagtcatgctttgatgctttcttccatgtgccagtggtttttggaacagcagaggaaaggcagtttgggtaaactgaaagccaaagttaacactgaaggggtttgccagactgtcagggagaatggcaatgttcttagatttctgctttattctgcatctctttcttgatttgttaaatgccttgtagtaataaagtagcatgttttctgaatgattttactttttttttttttttttttttttgctt

SEQ ID NO: 28930 - DNA, 1050 bp, Homo sapiens
gtctccaactcctgggctcaagcaatctgcccaactcggcctctagagtgttgggattataggcgtgagccctgtgcctggctatttccagattttttgaaggctgttttccaattagccaatagataatcactgtgagccctgttggatttttgcagtagtttctagaggtgggattcccaggtcatcgaggatctgtgtgtaattgcctatggtcctccaaaaagatcctacggtctgtcctctgccagaatctttgggtctgctcaccttgcagtgcccagtctactctgggtcttattactaacctgactgaattagttaaagtggtatctcattattttttaccaggcatttctttgattctaggagcaggattttcctgatgttaactggcaaggccagagcttctgagtgcggtctcagaagtcataaactgtctctttccccgccagcatgtctgtacttcatctgcaaagctttggagaaggattgccggtacagcaaagggctggtcctcaaggagaagatttttgaggagcagccttgtctccggaaggactctctcagaatgttcctcaaatggtaagtcctgcctcttcccatgccatgtgtgcacgcttactgtgtggctggtgaaggtcaggagcacaccacattctcccctcaggtcccatggatggagcccctgtgctctggggcttcatgccctgccgcagcccctgatctagtgaactgaccttggactgccttgttgatcacccacctctacctaatcttggcaaggcctcctcaggctgcctgctgcccgcctctcctgctgtcctgccagctttcagtgttcgctagctgtcctctggatgcttggggcagcctgctgcccagcttgcctcctgcctttccccttcccagggttttgttctcagtgctgcccgagttcagtgtcccaaacatgcctctgatcatgtgccacccctgccttgcctccaggacatagcccatgctcagttgcattaccaaagaggttctttgcagcctgaccccatagtt

SEQ ID NO: 28931 - DNA, 1026 bp, Homo sapiens
caaatctatatcctcacccctccagcctttgtttctccctctgtcttcatctttctgctgtagtccaggccactgctactcttgcttgagctgtggcagcacacttgccacagtctcctctgcccgctccagccgctttccagccacagaggcacctttccaaaacagatatgaatgtgcttctccctcacttaaaacccttcatgttccctccaggttgtgtgtcacttaaggtacactgagctccaggcctgtctctccccctggtcttgtgcttccttggctgcagccttcctgggctaccccctggggtccctgcctgcatgcctgtcctctgcccccactccttgccctccctgggtgttggacacaccacagccactcacttggaaactttcttaataaggctctcacctgtctgccccacccctcctctgtgagccattgtggctgcatctgttctcattgcagcagccatactgactctttgcacttgtgtagcttgtccatggctctcttctctctgggctctcagctcccccatgccctgttcacaggacacagcacatagtaggtactgagggtatcagtaactgcatgtggcatgaaggagagtagtgtgactatcattggaccctatgggtctctgtccgatgacatgctgaggatctgctaggttacagtgcccacatctgagagtgggggtgggcaggcagcacataccagctccccaagaggcctcctgcctcccttcagtctgccctgaaggcttaccctgctgtgacacttctgctgtctcccaccccgcactgtcaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaaggtgcacaggcagtgggtgcagtggggatgagctctgactcccatgtccttgcc

SEQ ID NO: 28932 - DNA, 1045 bp, Homo sapiens
gcaagccttaagtcaggcaggagacctggggcatggggattggatatgggaagaggggccagattgcaaaaggcttttattttctgttttgtaaagctgttgctccattttgctccattgttttcatcatgctgatgagaggtgcatgcactattgaaccatccccgctgctgaacccttagtttggctgcactatttcattcttacgggtcatgccgtgatgaacacctcattcatgcctttttgcttgtacccaatttttttttaggataaatttctaggaatgaatatctttagagctcttgataattattacctctggtaccacattgttctccaaaaggattttagtggtgaaaaaaaacctaaagtttataactataaaagtttgttatttttcttagaaaaataacacgaaaagacttctggactgaaattctccttttcctcaaaattaattatgcaaacaaaaattagttttcaaaaaactgccagcaagtaaatgcggatagaggaatagtcaaataccttaaactttgaaaagtacatcaaagaaagagagagagattggaaaggaaaaagaaagaaaagaaagaaaaaagaaagattctggtggagtggcagtagatgtggctctgtctctgcatgtccctcagcaggagaactgatggaagatagcaagttgaccaaatcctgggaaatattattaatattctcatttgtggagagtggcatgaggggaaacctcctccatcccacccttggccttggcagaggcaggaagagccacaggatcctgccatcttccagtgtgcagactgagctgagggaaggggccctgggataaaacacactatggttgggtggtgaggggcctggtgaggatattatcacccaggaaaaataataacagttatcacatactgaattctctggaagcagatactaagacagggtttataaggaaggcggaggaagcagaattgggcttttgagctgacaaacagaatgaaacaaaaaggaaaatcgtagaactgaggaaaac

SEQ ID NO: 28933 - DNA, 1099 bp, Homo sapiens
ctttccagactgtaaaaaaaagtactttttatacataaatatgtactcctagaaaaaaacaccaatctaaatgctatcacactgtgtatggtactcagcttcctttttcactcagcaccacactgttgagttctatccatgataattcctgtggatctagtacattccttttaactgctgtaaccctattttattgtaactgttctgcactaaagtcccttgcgggattctgtttgtgttgcagtggccccagagttgggcaggctggggactgaagctgctgccctaggatgcagagcctgactccccaagaggccttccttgtaacagcaggagcaccattatcctctgctggggctcagtgggctgagctgatcatggttcttgggattttctccctaatctcccaccaatgatggcaaatgagatttggcagagtgggagttttccaggaaataaatagggtgagaagtcagagttccctttctgccattggcacttgtttgtagagctttgtttgtagaggttcccccaggaagggagcagggaagtcagggagtgggtaaggagactgagctcaagtttccacatactttttccctttgctttgttctttcctctacttaggctcataacctttgggactgaactcagtgttgatcttatggaagccattggcccaggaagctcaggtcctgaaactgggttcccaagccatcttgttggagtgttagggtggcaggagagagatggaaatccaccaggaatgcagatgtcccgacagggagggagggaaggtagggggaggtgtttcatagttgccgagggtgaaaactaccttgcagagctgccttgtgcctcctgggttttttccacctctggagagacagcttccaaccctgaaatgtgtcacgaggacacagtcccctgattgctacttttctgtctggatttattgtgtctggaggatgggctgcaggacacatgttggcagctgttcgagctgctgtgtgcttcagcttttgcccagaaactcctcagaggtggtggtgtaggagaacaaatgctttccccatgatgtcagttctcaggcaagggg

SEQ ID NO: 28934 - DNA, 1033 bp, Homo sapiens
gacgggcaggggacaggggaggctgtcagcgaagagccactcacctcttttgttctcttctttcattcttagctttttgaaaacctttaggagttagctggtcacggcatttattgaacatctgttgtgtgccaggcatggaaaagggtgccatggggaaagtcaagatgatggtgccttgattcctgctcccaggttggatctgatgtcccatggtatcatgggacagtagttggtgccaaggaggagtgccatgagctggcagacgggagcaagttctggggtttggtgggttgggaagaattcctggagaaggtgagtctctagagaggcctgcaggcccatttagacatggagcttggagagtcctacagcttttggatactgaggtgactggggtggatgaaaaagagactttgaggggagagagcttgggaaagcagctgggctctgagggttgggctctttcctgtgggcagtagggagagtgatgtggtcacaggatctctctctctctgggctctaaggaaggcacaattttccccccatcatcctttgaagagccttcctgggaagctcactagatggctgggggatgccagcctcacaccttacagaactgcttcgcttcttctggcatttgtatcaagaggggctgttcacctgcctttggtcaggaaaatgtttaaagcctcccgaggcctccctggtcagtgcctttcctggctcagagggcaggatgagagatgcatgatgaggcctccgagcatcaggccccttcagggcagcaccatggtgtctacacatatcaggcttctgatatgtctgccaggcttcgaggtgcctggcagtgctcagttggccctcacctgtgagcactggcaaagaatggacaagtggtgcagcctggccctcacacaatgccgtcatgcccacctgctgcctgctgtgtatcttcctctctctcaggggcccccaggtttctggtaccacttttctttggcatccatccagtcttctcagcctgacaatg

SEQ ID NO: 28935 - DNA, 1031 bp, Homo sapiens
aatgaatgtgactatgtttcaataacattttttttttttttttttttgagacagtgtcactctgttgctcaggctggagggcagcagtatgaccacagcttattacagccctgacttcccaggctcaagtgatcctcccacctcagccttccaggtagctgggactataggcatttgccaccgccccccattagtttttgtatttttttgtagaggcggcgtttcaccatgttggccaggctggtcttgaactcctgaacttctgggctcacgctctccaccctactcggccaccgaaagtgttgggattacaggcatgagccagtgtccagcccaaaatagtcttttgattttttttcccccaaccatttaaaaatgcaaaacattcttagtttttgggctgaaaaaagacaagtgatgggtcagatttggccccggattgtggtttgtttacccctgttacagaggaacaggaagcagagaggactggttatagggcctgggaagccaagccagggagttagacttaaggtagtatgtaagaggaaaccatttttgtaatgtaatgaaaattttaaaggaaggatgttttgtatttatatgtgttcctggaagcatctgagtttttattcaaaacatgttttcactatggaaaatttcaaacatttacaaagtagagagaaaaatgtagtgaaataccaagtgatgtatttatcacctaccttcaacaattatcagtcctaggtcctttgcatttctgtgttttagaatcaacttgtcacattctacaaaaaagctcctggaatttctgttgggattgttttgattctgtagataatttcaggggaagaattgacttcttaataaaattgaatctcctaacccatgaccatggtatacttctcaatttatttagtttttctttaatttttctcaacaatattttgtagttttcagtgtacaaatctttccagttttttgaagggatgtggtcagatttacttctatttcatatattttgatactgtgaa

SEQ ID NO: 28936 - DNA, 1030 bp, Homo sapiens
tgagttgagaaatattcttctcagttttctggaagagtttgtaaagaatttgttttatttcttctttagtggaattcctgagtgaatgcatctacgcctggggttttctttgtaggaaagtttttaactacaaatccaatttcttcaataactatagagctattcaagttatttatcactgtttgagcttcgatagtttgtctttcaagaaattcatttattttatgatagtttgtctttcaagaaattcatttattttatctaggttcttgaatttactggcataaagtggtttctaacagtctcttattttcctctgatagctgtagaatctgtagtgttgttaccctttccattcttaatgctggtaatttgtgtcctctcttttttatgagtgtggctagaggtttatcagttttcttgatcctctcaacccattttttgtttcattgatctctgttttacgttttctatttcattgatttttgcttagatgtttattcttttcttctccatactttgtgtttcattgctcttctttttcatgtttcttaaagtaggagctgatttgagtcttttcttcttttccaacataggtgtttagtgttataaatttccctttactgctttaagtttttaaaggtaatttaaggatagcccacaaattttgatatgttatgttttcattttaagttcaaaacacattctgatttcccttttggtttcttctttagttcatagacgtagaagtatgtgagttcccaagtatttcagaattttccagagatattccattattttgtaatttaattaatagagaatcttttattttattttattttattttattttgagacagagtcttgctctgtcgcccaggctggagtgcagtggcgtgatctcggctcactgcaagctctgcctcccgggttcatgccattctcctgcctcagcctcccgagtagctgggactacaggcacccactaccacatccggctaatttttttgtatttttagtagagacgggat

SEQ ID NO: 28937 - DNA, 2328 bp, Homo sapiens
aagggagagctatatgtctactagtactgtgacaagatagaagaaagtaagtttaggataaagggaaatttgtccttctggttgtagtgggaaggaaaggagatggatgcttactgtaattctgtgggctgagcattttccttgttagtttccacacatcgtttgatgtggttcttatagcatcctatgtgttagctgtttctacttaaagatgaaagaccgaaatttggagatgagtaatatgcccagagccagataactaataagtagtggagttgttagcatttgaacgcatattctacccaaccagtctgagttctttccacttggtatgtaaattcatgaatacaagccagcaaatgtcccaggctgctcctattcaaagagctgccttctgtgtatcacgtggtctatgttaagtgttatgatctaaaacaatactgctgtttttttttttgttgttttgttttgttttttttgagacggagtcttgctctgtcgcccaggctggagtgcagtgtcgcggtctcagctcactgcgacctccgcttcctgggttcaagtgattctcctgcctcagccttgagtagctgggattacaggcacccaccaccaagcccggctaatttttgtatttttggtagagacggggtttcactatgttggccaggctaatcttgaactcctgacctcatgatccgcccgcctcagcctcccaaagttctgggattacaggcgtgagctaccgcgcctggcgcgctgttcttttttgaaaagaaaatcttgattttgtgttttgaagtccttaaaagcgattgtttatttaagctaaaataatcaagttactcatttattcagtaaatcagattcgacaggcaacattctcagaggcatgtatatgtgtgtagggctttggtgattttttggtgatgtttgtaacctagaatatagtttcgaaggcttagatttaagacttccatctgataaagtgggggtaagctgcagtgaaatctgcatggtagtctattcttgacacttgctgttagtagtaaccttttactgaaagtcaaagtttgcttatgtcttacagtactgttctgaaagtttactttttaaaaatgagaatgaaatattgggaagaaacatcatagttattttacatattctgtttttttagtacctgattggttatgttatattgacattctcgcatgtaattacactttattgcttgaacttgcaatacattgctcctgagataaagacataggtgaagcttatcctaagttggtaacagcaaaattattgtattaataattgagtcatatggtgtgtttcggcattttaacaaggaagtatggaccatgacattttgaatttgaaaggaagtactttttactgctttcctctttttctgtcttatatctttgtcctaccactaagaagtgagtaaagttctagactcagttataggatatcttaataacaggccgtgaactgtgtcactgattaactgacctatctagtaagagttaggatttacttctgacattcatgtactttttgcagtaattcaggctattcacatcatagctttgcttttgtctgtttttcaagtaagaggctgaggcagaagaatcatttgaaccctgcaggcagaggttacagtgagctgagatcgcgccactgcactccagcctgggctacaaagcgagaccctgtctccaaaaaaatgaaaattaaaaataagtaaatgtgaatttcagataaatagtgatgacttttttggtctaagtataccctaaatgttgtctggataaaagacacttaggtgagtgctgtggccagaaaggtaagagggatggggggccaaccaactagagacaagggaaggtatcactaaggacacggcagtggagctgagtcctgaagtgatgcacgagcagttatttctcagggaggaaagtggtaaggggttttcaggggtaggaacagtaggagccaaagtgtgggtatgtgagagtgtgtgactatgtgtgcacgtaaaatggaaatgagatggagggatgggttggagcctggatttgaagaagcaggtatcggcgctggggtatttggcctgggacagtgaggcattattttacaggagagtggcctggtgggatgtgtgctttagagtgtggacacacagctgtggcacagaaggattgctggcaggggagggcgacaggaggctgccagagttgtccagctggacttcttccctgacacagacaggctggcataggattggtgtggtagtggggatgggaaggagggaatgccgcg

SEQ ID NO: 28938 - DNA, 1049 bp, Homo sapiens
ccccccattttgaaaacaaaacaaccaaaatacaagactccttcataggtggtggtgtgtccacccatcaggaaacacatagtttttgattgtccctctttaaatgatgttagaagcctctgatgatcagtgcctagatccattcattctaattctgccatctttcttcattcagtaacaggtatttgtttttagatttgatggagttgataaattatcctacagtccaaggagtaatgctctcatattttacttcttacgtttatagaaaaagaactttaaaacttctagtaaacataagatcaagtgtttgtaataaagcttatgaaggcaaattgtaaaaattacatcagatccttttctgtcatcgtaatttaggctcttagcccctcttgtgtgtattagactctcctagcccaggattacctactgtcttcatttttgctttggctttatgcagattcttccttccatttcagattgggcctccctgttaatgataataggtgcgattaacaggaaggaatattgaagtccttgctttctgatttacaggcatgatttcattttatcctcacctgtagtcctgtgagaactagtatcctcattttagagatgagaaagcttaagtgtcttggccaaggccatgcattcatttgctcagtaaatatttattggggatctgttttgacaaggccacaaggctggtggtgaggcaaggtcttttactcccaagcctggggtcatcaccacatttaacattgtagcttatgtggtaggaaggaaattaaatactcttgccatttgcatgtcttcctgtttcctgcctttagaattgtactgggagagattccatgtgtttgtatacttagtttcttactgactgatgctacctgacctcaggattcagttatcacctctctggattagctgccccagtatggctttgtacgtttattttattttgctggggatgtcataacaaaataccacagactggatggcttaagccacagaaatttattttctcaaatctggaagccagaagt

SEQ ID NO: 28939 - DNA, 1067 bp, Homo sapiens
tttatttatttgttattttagtgcaatgattttaaaataaattttcatatatctttggctaaaatttgagtaatttagattttagggtgtttttagtgatcacttttaaagttacagtttaggagatttgtattagttcttggcacatacatgttgagaggctactgtgaactaatacttttgtaaaaacactatttgagaattgttttccctttttcagtttgatactggaaccgtcacaaatatgacatcatttttgttaggacaacatgttaatcattaaacaaacgtacatgctttcagtccaaagttaggagaaacgaaaatttccaaagtttccttgtaaataatcaggttaagttcaatgatacatcaatataatttcagtcagtgttacagcaacagtttaagtgtattagataaaatcttaccatggagtgctttttcatactttttaacagttattacacaggttgttttagtttatccatagtgcctcatacttagctccccttggaaactgtgtgtacctcaattctggaacgtaccttagaacaactcttaacttttctaaatctgcatcgtcaattttacgtaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagagtaagtgataagaacttttcattcttttttgtcctactcttttaaacatgcggggataatttgcatttagtaataaaatagggctgggcacggtggctcatgcctgtaattccagcactttgggagttcaaaaccgaaccaggctgggcacagtggctcacacctgtaatcccagcaccttgggaggccaaggcaggcagatcacttgagttgaggagtttgagaccagcctggccaacatggtaaaaccccgtatctact

SEQ ID NO: 28940 - DNA, 1045 bp, Homo sapiens
ttactacttgaatttcattgctttatggagcactttaactacataacataattaaataacaaaaacgaaatgactgccataacaagggttagaaataagcatgactactctacagatgcaaataattcacctgatgggaggaaaagcacctgtgtgctaagacatggctacaagtgttcagcagaggctagacatcagccaagacagtgtccagcggggtttgagagcattgggtaatcaggcgagtccttaagtggagaccagttaagcttccactgtacagtgacattatttccctttttgtttgttgtttttgtagtaccaaaccctgctgcagctgcaattcctcgaacgcccctgagcccaagtcctatgaaaacccctcctgcagcagctgtgtcccctatgcaggtgagtgcctggaaccacaggaggctcttagagcctcagaatctgaaagttgaggccttttcttcacagtcatttacacctgtattagttgggtaaatgactacctcagcagggatgtatctagaatttgtttcctaaaatactataaatatctttaatagagataaattatataagtgtaaattgtgttattctgatagactctaataatgatggctaacaacagttgaacacttgctatgtgttctacactgttctgaatactttataatgttaactcatttaatccttacaactcttgggtattaggtactgttcttatctgtatttttcacatgtggttactgaggcccagaaaggttaagtaacttgccgaggttcatgcaattaagtggtagagtaggggttcagagttaggctgtctggattcagtgactttagtcactacactaagacacaaaggtgtctcttgagtagaatatgtggttgccatgtctcagcctttactgcatagcaaatcacttcagaacttagtggcttgaaagaacagttttgttagttttcacatttctctgagttgactaggcaattctttgctggctttcctgggctcattcctgcagttgaattcaca

SEQ ID NO: 28941 - DNA, 1048 bp, Homo sapiens
tcctcttccctgtggttcttgataaaaatcagaacttatttttatcaatctcagctcttattttctccccaacatattataatgaaaattttcaaacatacagaaaagttgcaagaagttgtgccgtgaattatccacttacttacagcctagattctgtggcattcttttatatttgctttatcacaaagtaagttataatcactacccttcagcatgcatatcagtatttatggtgttctgtctctctgtgtgtttccttttgaaataagtttagacttaacaaaaatattagagttcccttcccccagcttcccttataggaacatcctacataactatagaacagttacaaaaagtaagaaattaatagcagtaaaatattattaactaacctacagaatttatttgaattttaccagtttttccactaatgtccttttttaattctagaatcaaattgaggctcctactttccatttagttgtcttatctctttagtccccaccagtctgcagctgcttctcactcttcccctgtctcacatgacctcaacacttttgaagaatacttgtcagttattttgcagaatgtctctcagatgggcttgtctgatattttcttctgatttaagttgagtttatggagtttttttcgttttttgtttgtttgttttgttttttgagttttttgagataaggtctcactctgcaacctccgcctcctgggttcaactctcatgctttagcctcccgagtagctgggattacaggcgcataccaccacactcagctaatttttttgtattttttggtagagatggagtttcaccatattggccaggctggtcttgaactcctgacctcaggtgatccgcccacctcgacctcccacagtgctagcataacaggcatgagccaccatgcccagcctgagtttatgttttaatggaagggatactgcagaggtgatgtgtccttttcaagttattttatcaggggtacatgagattgatgtgtcttgttacttctgatgttaaattaacttt

SEQ ID NO: 28942 - DNA, 1174 bp, Homo sapiens
agctggaaaccatcattctcagcaaactatcgcaaggacaaaaaaaaacaaacactgcatgttctcactcataggtgggaattgaacaatgagaacacatggacacaggaaggggaacataacacacaggggcctgttgtggggtggggggaggggggagggatagcattaggagatatacctaatgttaaatgacgagttgatgggtgcagcacaccaacatggcacatgtatacatatgtaactaacctgcaccttgtgcacatgtaccctaaaacttaaagtataatttaaaaaaaaaggaagtagaaaaaagataagctaaacccaaaataagcagaaggaaggaaataaagattagagccaaaataaataaaatagaaaatagaaaaacaatagagaagatcaatgaaaaaaaaatgggttctttgaaaagataaacaaattgacaaacctctaagtagatagataaaaagaaaacgaagactaaagttaccaaaatcaggaataaagggacgttactaatgaccttaagaaataaaaaggattaaaatggaatactgtgaacaatgaatgccaaaaattggataacttagatgatatggacaaattcctagaaacattaactatcaaaatggactcaagaagcaagaacatctggagagacaaataacaactaatgagattgagttagtaatcaaaatacttccagcaaagagaagcccaggaccagattactttactggttaattcttccaaattttaaaagaggaattaatagcaatacttctcaaactcttccaaaaatcaaagaaaatattacttcctaactcattctgtgaggccatcattactctcataccaaaaacggaaaaagatattacaaaaaaagaaaactgtaaaagcccttgacaaaataatgacaatatccagcagtatattaaagaggattatacaccctgaccaagtgttctttatcccagcaatgcaaggttggttcaacatatgaaaatgaattaatactgtaataccatattattagaataaaggggaaaaaaccgcatgatcatctcactagacactgtaaaagcatttggtaaaatccagcagccatttatgattttaaaaactaggaataaaaggtaattttctcaatctaataaagggtacctat

SEQ ID NO: 28943 - DNA, 1027 bp, Homo sapiens
tccagagacaaccacttttaatttttttagccgttgtctttagggtttgatggtacaaggttgataatacaagaataaccaactggaatagggaaagtatttatactttcagtaaacttttctttggttttagattttatatctaagagcttgtgttgcatcactgttttcttgccctggaaaaccctaactgaatgtaatcaggatgcccccaaaggttgatttgagagctttattttgaatgaaaaatctcaatgttttctgataaaatgctagacctagaaatggattggttaaatctaaagaataatgaaatcacttaatctagtacaaaatagtttaaataaatgaacaaaatattttagtgctgcctgaggtaatttaatctcagattaacattgagaatacagttttattgggggatgtacttcattaatatgtgggccactgaagaaaagattggatattccttactggagataagtggaattaaaagaattaatgggttggactggtttagcaggcgtatatttatgtgttatgctttacttgaattctaaggtttttttcctaatataaaagctaataattgccggggcgtggtggctcatgcctgtaatcccagcactttgggaggccgagggaggcggatcacgagatcaggagatcgagaccatcctggctaatatggtgaaacgccagctctactaaaaatacaaaaaattagccaggcgtggtggcaggcgcctgtagtcccagctactcgggaggctaaggcaggagaatggcgtgaaaccgggaggcagaggttgcagtgagccaagatcgcaccactgcactccagtctgggcgacagagcgagactctgtctcaaaacaaaacaaaacaaaaagctaataatttatcaaatagtaagttctgtgtcaggtagtgtgctgagtgtttaaatagaagttaggaaataaaaatagtttctattctcaggaagtttatagactagtcagtaaaaaaaaatcagtaattaaaa

SEQ ID NO: 28944 - DNA, 1028 bp, Homo sapiens
ctcagctcactgcaagctccacctcccaggttcacaccattctcctgcctcagcctcccaagtagctgggactacaggcgcccgccaccacacccggctaattttttttgtattgttagtagagactgggtttactgtgttagccaggatggtcttaatctcctgaccttgtgatcagcccacctcggcctcctaaagtgctgggattacaggcgtgagccactgcacctggccctcaggatctaatttttattagcatttaaaaaataaattatagccaggctttgctatgtctgcagcagattagacacagaaagcctgatttaaaaagctgataacaccaagtgttggcaaggaagcagagaaacaagaacacttgcaccctgctgacagggctctaaactgttctagccagtttggaaaatgttggcagtatctgctgaagttgaatagtctccataagaatcaaaagctggaaacaacccaaataatcattaagacgtaaatggataaatgaattgtgatatataaggtactacaaaacaagcaaaaaaaagaataaactgttgcaacatgcagcagcatggatgaatctcacacatgtaatattgagcagaagcagccagatgcacaggagtctaaactatgattccatttaaatgaagccaaaacagtggtgagattaatctattatgatgtcagaatagtggttatctttaggggaactgagggatcctttctgggattctgattcattctgtatcttgatttgggggaggcgactacatggtatattcactttgtgaaaattcttttagctgtacttatcatttgggtacttcatgtatattgagcaaaaattaaggaaaaaatttttttggtattttcaggaatgttgtcgccccaattatctgtggttttgaggtttttatgtcacatgtttctgatattttacacttcttcatttattccagatgatttattaagattcattagattcattttcttttctatataaaacaaataat

SEQ ID NO: 28945 - DNA, 1049 bp, Homo sapiens
tggtgcgatcttggcttactgcaacctctgcctcctgggttcaagcgattctcctgcttcagcctcccaagtagctgggattacaggtgcatgccaccatggccggctaatgtttgtatttttagtagggacagggtttcaccatgttggccaggctggtctcaaacttgacctcaggtgatccacccacctcaaccccccaaagtgctgattacagatgtgagccactgtgtctggccaataatacttcttagtttgttgtttgcctttggttgatttgccctaaaatggtaatttgtgacacttttgtccaggtttatatttgtgtttgtgggggctttcgggttttttttttttttagggaaaggatctatctacctctttgctctactgcagccagaagtttcctagcatgcgtcattttgggattcttttttattttccctaccctctttcctaagcaaggaaaagaagtacttacctttattctcccagaattgtgtgtccccatagattgaagaatcaatagagtgagaactagtgaacagataaaaatagctcagtccttcacagcttcctttgtaataatagaaataggagacaaataggagaaaaaggaagtgctctttataaattgtatgaagtattaagtatggtacttgctacctgcacaacccaggcatgagattagcacttggtgttagtcacacccccttaggccactactcattgccaccatttcaaagcctgtgggttgagtagattcttatataaaggtgactttcctaacctaaagagattgggcccaaaagcacaagtttcttctgattcttcctagacactacatactggaaaagacaagggaatagagacgcttccttttcacatgtcatccctctttcccttatgtgtccagccttgaaggggaatgttatttctactcatcccctaccccaacccttaaaaaaaaaaaaaaaagaggactttagtttcctctctggaaaacattccagaatgccgctcttcccctgatccttccttttctcacc

SEQ ID NO: 28946 - DNA, 1109 bp, Homo sapiens
ttctagtgattcacctaagatttagcttataccctggaacacacaagatgactttctgccagttagcgtccacccaggatatcttccatcagacatcagcttttgaccagggtcccttggactgtgcctggactgtatccagttctgccatggtttatacctgtactacattcagttaaaaagctctaaaacagagagagcctgtgtggtacctaaatgtgtttgtggccttgggcttccttttttttaatagttgcattgaggtatagttgacataataaattgcgtataaagtttacaacttgataacttttgacatacatatacatatatgtcacatatatacacctgtgaaagctatcaccacatgatagacaaaccatcaccatgaacatttcctcgtgcccctttgtactgccgtcatcctgcttctcccccacatttcccatccccacacagccactgatctgctgttgctgtatattgtttgtatttgttatagttttatataaatagaatcatagtgtgtacaattttaggggagttctggctcctttcacttagcacattgagattcattcatgtcattgtgtgtaaccgtagctcatttcctttttttccctgagtgttagtccattttttgggtttaccacaattattaagccattcagctgctgatggacatttgggttgtttccagttattgcttattgtaagcaaaactcctatgaacgttcacgtgcaggtgttcatatggtgtcttagtcagtttggactactgtaacaaagtaccatagcctgggtggcttataaacaacagaaatttatttctcacaggcctagaggctggaagtctgagatcaggatgccagcatggtgggattcttgtgagggcatcttccaggttgcagactgccatcttgtgtcttcacatggtagacataaagagaatgagagagctgtctggggtcccttttaaaagcacactaatcccgttcatggggactccaccctcatgaccgcattacttcccaaagaaccccacctccctatattatcacattggggattaggatttcaacataagaatttggggaaacaggaatatt

SEQ ID NO: 28947 - DNA, 1032 bp, Homo sapiens
actaaagtcatgagaatggtaaaacaaccctcctgtacatagccctagcgacaagatatcagcatagggcactgtccccacgcccacctggaggattcggaagcaaacaccagccacttaatgtcaccacacacttagagctcactcctcccattgtgtcataatcagtttgcttgaattaagatccaaatagggttctcacattgtgtttggaagtatgtctcttttaggtctctttcagttcataaatctttttttctttcagtttctttttgaaggaacgggattgattgtgcatcctacagagtgacccacagttcagattctgttggttccttccccatcctgttgtccgtggtgtaaactggtaggcagagctggagggtggatctgattccagttcatgtttttggcagaaacatctcagctgtggagttctgtccattcgcagcaggactggctgcctctttctgtgatgtcactgcctctgataacgaggtcagtcattctgggtaattctgtcactccttccttcattaggcttcctctttacagagaaacccctttgtcagctgttcagctgccttgactatggtttggtctggaaagttctatcaggtgcttgttcctctcccttgattttccagcactcaggttcacgagtggtttccaagccaggctgggtgtgcctttgtagatatcaccataaactcaccgatgtcacattttagatgtaccaccccattgtacttaacacctaacttcagtttttcaaatggtgagccttcctgttggctgtggattcagatcacctgggtacctttaaagaacattatgccctgactcgttcacaccacgtgaatgaatgtctctggggtggggcaagcgtaggaaaacccgaaaaatctttgcagtgattctagcgcacagtgaggattgagggtccgtattagatcaagagcaaagacatgcagggcttatctccagaggctgccagctccacctcggccgcctgccctacctcggccgcct

SEQ ID NO: 28948 - DNA, 1088 bp, Homo sapiens
caggaccccactggtccccagaggttctagaatgcaaggattcccaaaagcctttggccaccaatgccccggctgtctgacatagcctgtcctgtcgtgaacagttgggattagtccacatccctccagatgcaagggtagaaggcgggtccccttggacagcttggagggctggacatgaagttgttcccagttggaagtctccagaaaataggcgagtggggcggggggatggggggggaattcccagcctcaggctctaaaattcccagttagtctgtggtgcagacaggactccctgcctccttgttcagggaagtaggggaggatcaaggccacactgggcaccaggagctggaagaacaagagggtctctggcccagagtctgggatggggagaggcagagggggcattggaaattggggacacatctttgaactgagataacagctgttgccaagaccagcacctgggccaggctaaggaagggcagggctaaaggtgggggagctaagggtcaggcagggccttgaacgccgtgttcaggaggctggcctttatccctcaggacctggggagccatggaaagatctgaggagcaggcattgggcacagctggacactggggaacgggtgacacaggggcatggatccagcccaactctgataaggaacagcagagttccacaggaccatagtggcagaggcagcagtgaggacttcttttttatttatttgtttgtttgagacagagtctagctctgtcccccaggctgcagtgcagtggcgtgatctcagctcactgcaacctccgcctcccgggttcaagcgattctcctgcctcagcctcccgagtagctgggactacaggcgcatgccaccacgcccggctaaattttgtacttttttagtagagacagggttttaccttgttagccaggatggtctcaatctcctgacctcgtggtccgcccacctccgcctcccaaagtgctgggattacaggcgtgagccaccgcgcccggccggcaatgggggcttcttaaaaaagagggaggctgggcccggtggttcacgcctgtaatcc

SEQ ID NO: 28949 - DNA, 1050 bp, Homo sapiens
aacactttgagaggctgaggcaggaggatcacttgagcccaggggttcaagaccaacctgggcaacatgacaagactttgtctgtaaaaaaaataaaatagacggatgtggtggcacatgcctgtagtcccagccattcaggtggaggctgagttgggacgattacttgagcccaggaagtcaaggctgcagtgagctatggagtgccactgcactccagcctgggcgacggagtgagacctagtctcacacacacacaaaagcacaccacaacgattcggaaaagataaatagaggatctcactctgttgcccaggctagtcttgcactcctggacttaagcgatcctcccaccttggcctcccaaagtattggaattacaggcctaagccacacctgccctgttttggggttttagtatttactttttattctatcctctttcagaaatagttagaccctgtctcttctgaaaagcaaaaaagtttaaaaattatctggatgtggggctgggcactgtggctcacgcctgtaatcccagcactttgggaggctgaggcgggcagatcacgaggtcaggagattgagaccagcctggctaacacggtgaaaccctgtctctactaaaaaaaatacaaaaaattagccaggtgtggtggcgggcgcctgtagtcccagctactcgggaggctgaggcaggagaatggcgtgaacccaggaggcagagcttgcaatgagccaagatcgcgccactgcactccagcctgggcgacagagcaagactccatctccaaaaataaaaaatatattatctggatgtgatggcttatgcctgtagtcccagctactccataggctgaggcaaaaaggatcacttgagcccacccagcagttcaggctgcattaagctctggtcgcaccactgcactccagcctgggtgacagagcaagaccctatctctaaaattaaaaaaattctatggcaggataaaagtagatgcatagatcatggtgcaggtaagctggggtagaatgtaaaatgaagccaag

SEQ ID NO: 28950 - DNA, 1039 bp, Homo sapiens
cagagcaagagcctgtcacaaatgaatgaacgaatgaatgaatgggttctaggcctgaagtcaggcctcctgagttttagtccagcttctgtgctgtgtgttcttgagtataccccctcccctctctggaccttttttttacaggaggacaaggaactggataggtagattctagagcctcttatttctgccatacattctgggaagaattaaaaccagccttttaaaagacagggcctagaaaaatcacaatttgctgacagggcctactgtgtgccaagtcccttgttagggaggtactgttaggtgccttcttgtcaaatcctcggaatgactcaggcagttggtattaccaaccccctttacagttgaggaaacggaggctcagaaagataaagccctcctcaatgtcataagcttggggtaagaggctgcagagcctgtatttgaactcaggtcttcctcctgcaaagctctgactccatcagaaataccttctctcccatcggaagttccagtgctgtgtgtcctttcttctcttgggatagttgatcattttcatctttgttatttgttgagcatctactgtttaccaaggcctgcactgggccttgggcctcagagctgcctggggcctggcctccgccctcaaggaggacagagaagaggaggcagagagcagcaggcctagggctctgatcccagcctcggccccattgtcccccagccttgaagcaaaaccgtttcccttgacacacttaagacttggatgagggccgggcgcggtggctcacacctgtaatcccagcactctgggaggccaaggtgggcggatcatgaggtcaggagatcgagaccatcctggctaacacggtgaaaccctgtctctactaaaaaatacaaaaatttagccgggcgtggtggcgggtgcctgtagtcccagctactcgggaggctgaggcaggagaatggcgtgaacccaggaggcggagcttgcagtgaaccgagatcatgccactgcactccagcctgggcgaca

SEQ ID NO: 28951 - DNA, 1020 bp, Homo sapiens
ccatgttggtcaggctggtcttgaactcctgacctcaggtgatccacctgccttggcctcccaaagtgctgggattacaggtgtgagccaccacgcctagccagctgctgtcattgatactactatctagctgtctgattccacatgggaagtgatcaatgaaggacagccatagtggttattcctatttttgctggtactacccagagctgtccatgtgagacatagctcccttgccaaccgaatatccacaaatttgggcatctaccccttgtgtagaagtgagtcttctcctggggctgttcttgagaaaagctccttgtttttcttgttcatgacacctcaatgccatgccaggttgcctttagtttatgatgctctgagccctgtttctctgttttagtttccctgaaggatggctgctaaatcttggggttatcccctggggtcccccagtgtgaatgttgtacccacaacatggtacattcccagtgtctctcaaatttgggggtgatccatctggctgctgtgggatgtggtactgaatttgcacccagaaattggtatttttttgggggggtcgtggatcatgaaggaaagagtttggcttgtaggtagagggttggggggttacctgggcttcccctgggctgtggcctgagtgcttcctcaaacaggctggaattcttaacgtgccacagtttccagagaggtttctttagcagtgcttccaaagggagcatgaacttgggggtttcatgttccagggtgtgtctagtgggaggggactgagggagggtaggtgcctggaacaggctagggtcccagctggtgactcagtttcccttctacctggtcagggctttgaagtccaagatcatgctagagagagatgggaatctttaaacataactttctgtggtgtttattcctaaaaccatataggatcattgcagaacatgaaggaaaaatgggtaggtaggcaggcagaccaacattatgcaaaatgttatcacccag

SEQ ID NO: 28952 - DNA, 1079 bp, Homo sapiens
ctttccctgcctgctccccacatgctggggcccacccctagctgagcccatgggggacctacctctggctgggcctgagactgcaggagtctcgtgcaagagacgcactgccaggttggggtgcttgggctgggaaatgcaagggtggaaactctggcttcccggggacctgccagtcatgagtgggacctgccagtcaggattcggaccatgttattgggtcggggaggatagagcaaagcaggtaggctcccctgtcctgtaagcctgggtttgagtcctctgcttcaccacttgctgcctgtgaaacgcaggggaagttcaatcctcagtttccctgtctgtgcaatgggaacgatattaatagtagaaccatctcagagagctgtcatgaggattgaccgagaggctgcctgtgaagttctgagcccagtgccgggcatgttgtcggcagctgttattatgattactgtcaatgtgctaattatactcacgtttccacgatcagcatcaaacatatccctgtgtgtttactggtgaccttgcaacctcggaattgtgtttctttgaaaaaagggaaactgacagcgcaatggaggcaggagatggataatgtgaccctttaaaggccctttgtgtccaggacttttggataaaatgtttggcccatgcctgttaccatgcgctgttgtctgctcccccagagccttgataaaccgggctggaggcctgggtgaggctcagcagggatggtaggaggcttcttaccccacagctgcctcctggtagcagctgccaggtctggcctcatagagcctgtgagtccaaacagaaaggcctgaatgtgtctgagaccctctaactctgattagctcaggaatccacctcccccagcccaccctggggctccaaagggccccacgggtctgatgtgctgacacgccaggatcttggactggcttctcgcccttagattcccagggttgggggttgaggggcagggcctgctgaagcctagagagggcagggccttggcctacgtcaccctgcaagtggagacagaggttttttggctctgg

SEQ ID NO: 28953 - DNA, 1026 bp, Homo sapiens
ttaacgttttaagaaacaaccatatcatcttccacagtggctacactattttatattcataccaacagtgcacaagtgttccaatttattcacatccttgccaacacttgttgttattattatttttttttttttgagatggagtcttgctcttgtcacccaggctgaagtgcagtggcatgatctcagctcactgcaacctccacctccggagttcaagtgattctcctgcctcagcctcctgagtagctgggattacaggcatgcgccatcatgcctggatgatttttgtatttttagtagagacgggctttcaccatgttggccaggctggtctcaaactcctgacctcaggtgatctgcctgccttggcctcccaaagtgctgagattacaggcatgagccaccatgcccggccaacacttgttattttctgtgtgtgtgtgtgtgtgtgtgtgtgtttttactgtatctattcttatgggtgtggctggcacattatttaatttgtgggggatttgtaggctctgtatttgttgggcctctgtgtctatgtgagctgaggtgccgggcaggggctggttcctgttagaatgtcggtcacatcctgctgtgttttctggaaatactttgttctccctcactggactgtgaactttctgaggatgtaccctggtgcccccaaggagagctggcctgggtgagatgctgaagaaatacttaagaacccacttctcactgacccggggcacaccctggtgtgtgtctttggtgggagaaaggctggagccccgcatcgcattcttccagggtgctctatacttcctagggaagaagaagcccctgagtgcctgagacatgactcttagccctggatgctcaggagaaactccctggggagcttcagaaaaatacagatgctggggccaccatctagagactcaggctcagctggtctgaagcaggacccttggggatctgtattcaaaaggaaaactcggccaggtgcctggctcatgcctgtaa

SEQ ID NO: 28954 - DNA, 1045 bp, Homo sapiens
tcactgcagcctcaaattcatgggctcaagcaattcacctcagcctcccaaagtgctggaactacaagcatacaccaccatacccagtaagttattttatctttctttcataacgaatcttgctatgttgaccaggctggtttctaactcctggcctcaagctatcctcctgccttagcctcccaaagcattgggatcacaggtgtgagccaccacacctggctggatttacgattattaaaaacacttttgtttgtgtgtattgaatttttctgtcgttatcatgtggaacgcctaaagaagtctagtggaggggtgaggctcagccagaatactgtaagagctttgggtatttgaaagaggacatcacacccttgggggaagtccagtctctcaggaggctaagatctcctcaatctaaagcaggggtcagcaaattttgtctgtaaagagctatagtatgtattttaggttttctgggcgatatggcctctgtaacaactactcaactctgtcactaaggcagagtcatggataaaggctcttgaaggaagccatagatagtctgggcaacatggcgaaagcccttttctacaaaaaatttaaaaaattagcaggtcatggtggtgcatgcctgtagtcccaactagttaggaggctgaggtgggaagactgcttgagcccaggagattgagactgcagtgagctgagatcatgcctgggacacacagcaagaccttgtcccttaaaaaaaaaaaaaaaaaaaaaggcagcagcagcagcaaccatagataatatgtaaataaatggctgtgggtgtgttccaataaaactttatttgcaaaaccaggcagtgggctagtttggcctgtggactctagtttgccaattttggatccagagaaaaacacggggggaaacagcagcttaattaatggtttcagtgagtggtcagccagtccaaaaatagcataaattgtaggaaggaacaagccaatgaaagttgaaaaggcggaggttaagcagaggggtaaagataagttgt

SEQ ID NO: 28955 - DNA, 1025 bp, Homo sapiens
ggttcttatgaaaggcagggtgccgtgcggtccagtctctgcacagactcacattccagcatctgggagcaaaaaacaataaaaattacaaatgctatgcatctctaaaagaacatcaagaggccgggcactgtggctcacgcctgtaatcccagcactttgggaggctgaagagggtggatcacaaggtcaggagatcaagaccatcctggctaacatggtgaaaccccatgtctactaaaaatataaaaaattagccaggcatggtggcgggcacctgtagtgccagctactcgggaggctgaggcaggagaatgacgtgaacccaggaggtggagcttgcagtgagctgaggtcgcgccactgcactccagcctgggcaacagtgtgaggccacatctcaaaaaaaacaaaaacaaaacaaaaatcaagaaacatgtaaatgatgataagctgtaggaatactgatgactgctaagcccccctagattcatccccttatgcccaatctcgcacaacctcatctttgctccttttcatggttctgtttcctgatcctttttgacttagcatgacctcaccgttctggttagccttcggctttctcctcccttgtttctgctcctgttcttctgtagccaagataaaaaatttctttgaaggtgcagcacccaatggaggaagcctaggttttctgctgggcctgacagcaatagcactgtccctgggatcagacggagagggaggatttggagctgcagagccagatgtgttccctgcctgccgcagatggtagttggggagctaagctgggagttcttcctgtcctctctgtgatgagtcggggagaaaaagcctagagctcctgaggaattctgttgtgtgtccccggccttgtcagatgaggagagaccatctgcagggtacacggcgaacctgacactcgacacaccaactctagcatctcagaactccaaaaagtgcttgtggctgtttggcacagcccacacagggccttgaggctc

SEQ ID NO: 28956 - DNA, 1028 bp, Homo sapiens
ctgggtttcaattgtgtacttggtgtccgaacaataaatatttacagagccctgactctgggccaggtaccatgtcagacctgggaaaacctggggtgggagcagctctggtgcatgcctggtgacatccttgctgtgtgaccttgggcaagtgaatctatgtctctgaatctgcatttccttgtctgtaaaagtagtggggttggggggacatggatccctgctagaaggagaaacctcctttaacaggtgtgcctgacctccaggatccagctgctgcccacccccttctaacaacccctgacatgtttgggatctccaggcagaggacagaaaacctgcatgggtcagatgagcggggcctggccgaggacagtgggtgttagggtctagtcgtacccccaacccctagtactccagccctgtaagggttaaaacccagggagctcacgtgacctagtgtaaaccatgaatcattcccattgctcccagtgctgagcctgctgcccaggacagggcagatgctgtgccccgggttgccatggcaactccgcctgtactgaaatacagccctccccagtccttcctgggggacctcagaggctgtctcacctggatcagtgttgccttccagagagggagggagagacagctgaaaaggagagagagaggagagacgcttagagacaagcaagtggaagttgagacacagggagagggaggagagcgaggctgagaaatcaacagagaaacagaccacgagagggagacagactgacagccgaccagaggtcccaagacgctgcctgtaaccttagaggcagaagccgtttcccagcagtgctaaccttcccggggctgccagatcgccgacatacacgcacacacacacagagtgcacacacatgcacacacgtgcagccgcatttcctggtgcgcttgctgtgagggcacaggggtgggtaggctggcaggcacgtgaagttgccatcagccccgagggaccgtgagcgagttgggacttgggg

SEQ ID NO: 28957 - DNA, 1031 bp, Homo sapiens
agggttaagcctcttcttcaaatggtgccattttctctccagagtgacccccagcctcgagtgttttagttgttagaagggagtgaggtggacacatgggcctggcatagagccagcagccccatcctcttcttcccggcctcttttgcatccacttggcttccctgccccccttgcaagattcttcccatcccatcctgccccaccccacccctaagttgctacttgatgatcaaagcatatttgtgtgtcattaacagccacggctaattaggaaggaagggttaagtaggaggcattcctatacacgcctgggagctgaacagttagagatttttcatatgctatgttggattttcttttcctcttctcatgcataaatacaagtccttttgtgggggagatgaaaaaagaatggaggtcattagagatctgcttagtgagtttcctaatcttttcatgggatgcggagccccgtggattttcaacaacttagtgccattggttgaaaaatggtttctgagctgaattgtggtgaagcggctgctgtggttcagtggtgtctgattgctgggatgggggtggaggaggagacaacaggggtacagatgggcctgagttcaaatcctggcaccacacttctgacatctaggaccttggccaagggcctcaacctctttgagttgtgatatccttgcatttacagagggctaaagatatgaagattgaactcaaacttgggtgggcatcagatatatcttgggtcctggtgccacgaggagagtaccaggcaggtgccttgggggtctgaggaaggacccagaatctgctttgtgtggcaagagctctaggtgagccccaggtagagatggttacgtggacaccgccctttaaggaccaatcccttaatgtttcttcatgttcataaaaataagtaaataaatacatatctgatggatgaatacatgaatgcatggaccagtgcatgaacggatgccaagctcctagctggcttcacaccaggtgttggg

SEQ ID NO: 28958 - DNA, 1026 bp, Homo sapiens
caattccatggtcaccaggatttcttggcaccatccccctgcactggttccagctgccatcttcgccagagggtctggtttgaaatgcttttttgggtccacaggggctgaggtgagtgggatgttgtccatgtgtgcttcttttaaaccagatggatggaccgggcatggtggctcacgcctggaaacccagcactttgggaggccgaggcgggtgggtcacctgaggtcaggagttcgagaccagcctgactgatatggtgaaaccccgtctctaataaaaatagaaaaattagccaggtgtggtggcagacttctgtagtcgctacttgggaggctgagacaggagaattacttgaacccgggaggtagaggttgcagtgagccaatctcatgccactgcctgggcaacagagcaagactccatctcaaaaaaataaataaataataaaataaaccaggtgaatgaatccaaggtgctcctgtgccttacctgggaagtaagtggggactggcccttcagaggcaggccccagctgcgcttccgttctcaaactcagagctctccagtgtgaggactccttggtagggacacctgggcttctaaacaaaggctgatgaggggctgtgatcttttcacaagccttcacccttttcccacgtctatttactcaggtatttttcaggctctccccgtcctgggcaccggccaaggtgccaaggagacagtggtgagtgacattcaccttcccttcagggagttgccagtcagccaggggaagaaggccttgaaacaagaaaaccagcagacacacaagaactcccaaagggttaggaaggaaacagatggaatgtgtgggcctccactctcaggggtctgaggaggagtctacgccagcacagggttgggcaggctgagcacatggcagatgtgtcagaaagcaactgccttttgttctgaaatggtgtttgtcattatttgaggatgttaacatgtccaaatgtccattttgaaatgaattcgta

SEQ ID NO: 28959 - DNA, 1821 bp, Homo sapiens
atcccgtggtttgtgaggcagacgggcattgttttcctctgctgttctcatcactgcatgatgatgttgcagaggaggccacctgatgggagcagccacagttggcctaagagggtggctgctttctgcctggcagcagaacccctggattctagggatggacccccattttacagagggggaaactgaggtcctgagaaagtgacttacctgaggccatacagccagggacgcaggctctgtcggccctctgagccctttccctgtgctaagccatggcagtgggtggcagtccagggcagtggaattttcaggaaggtgctgcctgcactctttcgggctgcccctgcctcccccgacaccccaacacccttctctaaggcctaatctgcctgctcctcacctggactctacctctcgctcttccctggcatggtctcataaaataccaagactcgggaaatagaactcgggcgtagctggatgccaggcagagtgagccggtctgtaaccaacacaatgccagctctcatggcggtggggagaatatgcaaattgggggctgaacagcaccccgctcctcaagtccgtgggtgggaaaatcataatgtgtgcgtaactgtgttggtttatgactgtgttctgggtcctttgcttttttttttttttgagatggagtctcactccatcgcccaggctggagtgccgtggcgcaatctcggcttactgcaagctccgcctcccgggttcacaccattctcctgcctcagcctcccaagtagctgggactacaggcacccgcctccacgcccggctaattttttttgtatttttagtagagacggggtttcaccgtgttagccaggatggtctctatcttctgacctcatgatccgcctgcctcggcctcccaaagtgctgggattacaggcgtgagccactgcgcccggcccctttgcttattttaaaagaattactcaagcaaaccatgcccattgtagaaaaataagtttatagagagaaacaagaacaaggttatttagcatcccatcccctggaaatgatccttatgacatatctgtatcctttaagaattttttgcatttatatatgcaacatatatacatatatgcatatataataaatatataaataaatatatatgtatacatatatttttgtttatatacacatatgtatatatagacagatcaacaaagtccagttatacaacatcaacatgaactcttttttttttttttttttttgagacggaatctcactctgtcacccaggctggtggagtgcagtggtgcaatctaaggtcactgcaacttctgcctgggttcaagcgattctcatgccgcagcctctccagtagctgggactacaggtgtagtccaccacacctggctaatttttgtatttttagtagaaataggtttcaccatgttggccaggctactctccaactcctggtttcaagggatcttcccgccttggcctccccggcctcccaaagtgctgggattacaggtgtgagccaccgcacatggccaactctttttttctttttgagacaggtcttgctctgttgcccgggcaggagtgtggtggtgctatcttgactcactacagcctctgcctttcaggttcaagcagttctggtgcttcagcctcccgagaagctgggactacaggtgtgagccaccacgcccggctagtttttgtatttttattagagactgggttttgttatgttggccaggccgctcctgaactcctggccttaagtgatccgcccgcctaagcctcccaatg

SEQ ID NO: 28960 - DNA, 1032 bp, Homo sapiens
atcacctgaggtcaggagtttgagaccagcttggccaacatggtgaaaccctatctctactaaaaatacaaaaaattggctgggcatggtggcaggcccctgtaatcccagctactcaggaggctgaggcaggagaattgcttgaacccaggaggtggatgttgcagtgagctgagattgcaccactgcactccagcctagggaacaagagtgaaactccatctcaaaaaaaaaaaaaaaagtacttgatgtaaaatctggtgcatagtatgtgtacaataaatctcagctttgcttgcttgcttggttgattgattttgtctgtactgtactaaacttagtttggggactaaatatacaaatacaaatcatacatatatagcccttgtttttaggagcctatgtcttctgggaaaagcaggtgtgtttggtaattagaagtgtttgataatacccagggaggtatttataagcactgtgggtgtctagtgtgctgggcctaaatcagcctgaaaaataagaggtatcgtctgtggattttcaagtcctttgtcccatttaaccccctagagaactccgagaggttgggaaatattgctccatttcaacagaaggcccagaaaaatcaaggcaccgtggccagcgttctctgctgcacctggaaggtactagacaccctgaggcatccttgctaggcctaagctgtggccactacagaggtccagatacttccaggaaggtctgattgtcagtgaggcagtctctgtgtgcagccaggaatctccgagtgcaaaggacagaggaatagaaatctagcagaacaggcttggctctaagcccacatctcagggccagagagcagaagagattctgagtggagtgagatgaccatctctggtctcttacttaggcccagtacatgggcttatgtctggggccccagaggagtgagggcagcaaagaacagacaatgggctccacgcagacctctgcaacacactggagcctgagcccactgctgcaggacccatc

SEQ ID NO: 28961 - DNA, 1044 bp, Homo sapiens
aggtattatttctctgtggtgagaacactcaaaattgttcccttctagcttttttgaaaaatacagtattgtaaccagagtcactcagctgtggaacaggaatgtattcctcccagctaactgtaactttgtttctataaccaatccctcctatctgccctccttcccccagcctcaggaaaccactcctgtactttctgcttcttgaaggttaagtttttggattcatcataagtgaggtcatgcagtgtttgtctttgtctttctgtgcttggcttatttaacagaatgttttctaggttcattggtgttgccctaaatgaaaattgcattattttttatgaccggagagtatatcattgtatatgtgtactacattttctttatcccttcatctgtgggtgaacaggtagtctgattccatcatcctagctattgtgactagtgatgcaatagacatggaaaggcagatgtctcttcaaaatactgatttgctttgactgtatagctagtagtgggatgaatagatcatatggcattggactttgagttttttgaggaatctgcaactgctttccgcagtgtatatagtaattgaccctcccataaacacttcttttttcctggaaattcacaccagcatttgtgtttgtatttttatttgtcatattcatttcaaataagagatgctttctgtgtatggttttgatttccattttttgcaggagtagtaatgttaaccacatttttgtaaagataaagtcagtgttatgtcttctttgccaaaaagtctattcaggctctttgcccaattttggttcggttactagtttctcttttgtttagtttttttgctagttactagtgttagtagcttgtgccttttggaaaacaaggtcttatcagctgtatgtttccctaaactttcttctcatctttgcgatgctgtttgttcgtttcttctctgccccctcctctccccacgacagagtcttgctctgtcactcaggctggagtgcagtagcatgatctcagctcactgca

SEQ ID NO: 28962 - DNA, 1026 bp, Homo sapiens
atccttgcaggccaggcctgtgtgacattttctggagagaagaccagcactttcattaagtagcccctggaacctctttgatcagaaggcccctggaacctcccccaactcttctttgactttgcagccaggcttggaggtgggataagactggagggagatggttcaaaggcctggcttattctaagcttcagtgagcttaagatatcacccccttgctctgaccccagtacagtatagtacaggccttcagtcaaaatttgcttcaggaggcagtgagctccccgtcaagagaaggaagaaagcagaggctcaatgctggaagggtggggtggaaagggtgtcctgcttacccttgggaagtggcaatggttgggaggcttcacccttcctagtggcttatggatgctctatctctctcccctcacctctctctctgtctgcttctcttcctgtccccctggttcaccctcccctcccctctggccctgcaggtgggttggctactagtaccctggctaccgtgggctgcagtacctgctggagaagggagactacaaggacagcagcgactttggggcccgtcaccctcaggtacagtccgtgcgctgcatccacgacatgcaggggcaccaatgtggtgccttccacccctccaactagtgcccaccccaccatgcctccttcccaggacccaggtctgctgcccaggaaccctccagacctcccagagagtgaatgaagtgtgacttgcaacttgtctgctgtgggtctttgatctcccctggcagctggtgtgtgtgtgtgtgtgtgtgtgtgtgcgtgcgtgtgtgtgatagaaatgagaattggcaagtatctgggctatgagtagggcaacagaacccttactgagtcttacggttctgcagcttcttagctcttaactgtgtgaccttggacacagtgcccaacctctctgagcctttgtttcttcacctgacttgcaattcccttgcctctgagtgtctggctggtctcgaaccc

SEQ ID NO: 28963 - DNA, 1122 bp, Homo sapiens
aagtggttaaaatgattatcataaaggtagaaaccagtaagtgctccatatacaccatggaatactatgcagccataaaaaaatgagttcatgtcctttgcagggacatggatgaagctggaaaccatcattctcagcaaactaacacagaagcagaaaaccaaacaccacatgttctcactcataagtgggagttgaacagtgagaacacatggacacaaggaggggaacatcacacaccgaggcctgtcagggagtgggggacaagagggagagagagcattgggacaaataccaaatgcatgcacggcttaaaacctagatgacaggttgatgggtgcagcaaaccaccatggcacatgtatacctgtgtaacaaacctgcacgttctgcacatgtatcccagaacttataataaaaaagaaaccagtaagtgctcaataaatgttactaacatctatttcttcattcattcttcaaccattacccactgagtgcctatttggatacttggcttagtacctgggtgatgaaataatctacagcaaacccccatggcatgagtttataacaaacctgcacatgtatccccgaacttaaaagttaaaaaaacagaatctgcacaagtctaagctacttccttgaggaaaagactcgagctgagatctcaaagaagagtagaagttgcaggggtaaagaggccaaagaagagtgtctcagatgagagcggcacgtgcaaaggccctgtggtgggaggagcctggtagctctgagaaactccacaaaggcacggtggtggctggaatgcagagatgtgggggcacattgaaaaccttgttaaagtgcttaaaatgattatcataaaggtagaaactaataagtgctaaataaatgttattctcgtccgtttctccattgattcttcaatcaatacctattgagtgcctgtttcactcctggaactgggcagagtaggaatacaaagtaagacagattccctgcccctagaagctctcactgtggggggattgtaatagtttgagagtagagcaatggtgattattatgggttgaatgagaaccccccaaattcatatgctgaaatcctaatcctcaatacctt

SEQ ID NO: 28964 - DNA, 1050 bp, Homo sapiens
aaatgaaaatgaaaaatacaacaatcatccccaatttaaaatttttatattaacagttaaaacagactgtcaaattattaaaagtcttttttttttttaagagacggggcgggagcgggggggggtctcactgtgttgcccaggctggtcttgaacccctggcctcaagagatcttcctgcctcagcctcccaaagtgctgggattacaggggtgagtccaccatgcccagccaaaagtttctaaagtcttagtctctctttagtctctctctcattttttttgagacagagttttgctcttgttgcccaggctggagtgcaatggcacgatctcggctcaccacaacctccgccttccaggttcaagcgattttcctgactcagcatgtaatcccagctaattttgtattttcagtggagatggggtttcttcatattggtcaggctggtcttgaactcccgacctcaggtgatccacccacctcggcctcccaaagtgcagggattacaggcgtgagccaccgtgcctggcctctaaagtcttactctcaatttctgtgtttatctcatcgcagattggtaacaaacaattaccaccgaccagactttgagtaggtgttggcgaactttttctgtaaagaactgggtagtaaatatttcacattttggggggcagtatggtctctggcaactactcaaccctgctggcatcacgtagaagcagcagtaggtaaatgaatgggtgtggctgtacctctgtaaaactttatgaacgctgaaatttgaatttcattgtcatgtattacacagattttttattactttttacattttaaaatatattgatattttggggtagatgtgatattttgatacacgtatacaatatataatgatcaagtcagggtaatcaggatacccatcccctcaaacatttatcttttatcttttctttgtgttggggacattgcccaacacaattttcctcttctggatattttgaaatctgtaagacgttattgttaactataatttccctgctgtactat

SEQ ID NO: 28965 - DNA, 1056 bp, Homo sapiens
gtatgtaaagcagataatagtgttggaagtgacaacctggaattctgtccatggggactcttctccttgtactcccacacacagaaacccttcagcttatgcttccaacgtcagtgtccaaagaaactttagacaaatccagccccttcattcacagatggagacattattgttagttgtagtaaatgttagctaactaccagtacttacactttaaacgtgcctggcataggagaatgattttatatgtctgatagtatcaaatccccacaactacctgataaactaagtattataatgaccctcattttgcaggtgagtaaacagaagtctagagaggtacaatcacttccgaaagtcacccagctggtaagtggtgaaggcagaattcagagcccagtgtggctgactcaatagcctgtgccatccacccctacatgagttgcccagggaggttagagactgtcccacagtctcataggagctgagcagggacaacgaggtggcctggtgtggagggaaggtcacgggtgtgtggggctggagctctgggtccaagatgttcatcagctgcctgtcctggctggtaagagactgagggtgagtggtcagtgagcatgacagggggaagggagccttgggagaccacactggagaacctggaactagggagctatagcaggtgtctgagctagagaattaatcctactgttggctgcacatcaatattgggacaataggcccagatgtgtcattcctaataatcacaatggggcaggatggtgctcaaagcactttactggcatgatcttaatcatcacaaagcctctatgagagaggtgatgtcatgatacccattttacagatgaggtcgctgggggctcagggaagtgaagtgctttgtccagggtcacgtggctgaagagtgggggagctgacacttgaagccaagactggctgactttcaagcccacatgcctctgtcagttaagtgtggtgatggtaatgctgtgtaacaaacaatcccccaaatctctgtgctgtaggacagtaagt

SEQ ID NO: 28966 - DNA, 1066 bp, Homo sapiens
tgagaatgaaagaggcactatgaagaattacacaaggacaatagacattaaaacagtccagggaaaccaggacatagggtcgccttaagagtacaagggtctgggaaggaagggatggggaaagtgggttctcagactgaaaagaggtccaggagtgtggctgctgcccagaaagtgccaggttcataagtggagggctggacagccaggagggaagcacctgggtacccagagataattttatattgcctgcccagtaggtggacaaccttcaggcatggcttgatccaggggctcaaatgtcaacaggatcctgtttctctttctctctgtactcatggaactttgatccatctgcaacaaaggccaatggcagcccacagcctacacagagggagacccaggcccttctactcatcttctcagacttccactctccaatgtttgaaaccataggagacctctatacactggcaggtcatggagagaaactccccagatacttagagtgggaaagtgggactgaaggtgagcatccccatcccatcctggatcagtgtgggcacacctccctgtgacatgcaaagctcttcatatcacatctgtacactcagaactccatacatgctgtgagtcttccctgacctccaccacttcctccaggtctctgctttctagtgaccacacctctccttgactcttcactttgtcttcctgactgactcctagccctgacccttatctcaaagcctagcaatgctgagacaacgttttccactccccaggtaggccccagaatgctctcacccccgggggatcatgggcccctccctatgatagacatatgtggctcttctcatccagcttattacctctcccttttatgtggcaacaatgccccagtattgctagagtgggaaaccccctcactcacattcattctctatgctttcaaggaagccatctccaccctggatatgagtaatggaacataggacctaaactaagccagccagcacattctgtctctctggccactaactagtctaagtatgggtcaatcaga

SEQ ID NO: 28967 - DNA, 1804 bp, Homo sapiens
ggaagggtgggtggatgggtagatggatgcgtaagtggatacaaggatgggtggatgatagatggatgcatgaatggatgcatggatgagtggatggatggatggatggatgggtagatgtgtgggtggatggaagtgtggatggatgggtggatggatggatggatggacggatggatggatggatggacggatggaaaggtggatagaaggatgggtgtgtgggtggatgggctggtggatggatggatggaaaggtgagtggaagggtgggtggatgaatggatgggcgggtggatggatggatggaaggatggatggaaaggtgggtggaagggtgggtggatgggcagatagatgcatgagtggatacaaggatgggtggatgatagatgaatgcatgaatgaaggtatggatgaatggatggatgggtgaataggtggagatgtggaaaggtgggtgggatgggctgggtggatggatttgtaggaaaaaaaatgtaagctttgatttctgaaaacctagatctccagccttggccttatgctcgtgtctctaattctcctccctctctcatcttggtgtgcatagcccaggtagctgtgagtgcaaagaacaataggataaacattcagcactctcctgtgggtattatttttagtttccatgctgcagaggtcagagtgtcaaataacaaagagagatcttttcttttctctctcaaggaaagaatcggtcatatctgcgtgggcagcagtggaggtgggtgttagtttgtttggtttaacagctatttgactcagacctcctgccagcaggagtgggtgacctttccttggagctctgggcaccaagccaagcctaggagggcagttccctttgctcatgagctctgttaatgtagctgtgtcctgctgagattcaattcccacggacttcactgttgccaccaaatgtgtgcatatgagggctctgcagaagtaagagtcacaggggcctggaatgagagcagaggaggaggtgcagaaattgaaatgccagtcatacacactctgttacattaactctttgtggtagactaacataataataaccccacaaagagtctgtctctctgagtccacactcttttgcaatgtactttgttgcttttcccctcttgaatttatgacttgctttggccaacagaatgtggcatgagtgatgctgggtattttccaaggcttggtcttaaaggctgctgcagtttcttttgctgttttgcaactttggttccaccaggctgtgtagaagcccagtttcacctgtgtggatgagaggccacatgaagaaaactggagatggcccagtagacagccagcaccaaatgccagacactggcagttggcctcttcagctcaaccaatcctttaaccaaatgcagccttgtgaatgaactcaggcaaaactgggggaggaactgcaaaagcaacccaaagcatcaggagccacaaggcaatgttgtcttaaggcacatcgtggggtggtttgcaacccagcaaaggctaatgaaatgcttctgtaacaaacatccccaaaactcgtggctcaaatgataaaaattttcttcttgtttccatcccagtctggtgtggatgaagacttctgctccatgtagtcattgaggagcccacatttcttctatactctagcttttatcatattacaaagttcctctactgaatccttaggcaatgaggaaagaaagtgcatggaagatgtcccaggaggctcaggggtgaggcatggaagtgacccatgtca

SEQ ID NO: 28968 - DNA, 1050 bp, Homo sapiens
gcttttgtgtccatgtcattgcacttttgatttacattgagttttctttgaacaaaaaaacccatgtattcgtttaactcattgaagcgtttgcaaaattcatcttgtacttgtgtcatttttaagacctaagtataaagctttatatttatctcttctaaatgtcatcttctaagatttacctcctaacttctgtttagatcttgattctgaaatccctcatatttccagtctcttacagaactctgcctacatcatgcagtttagcatatgacctttgtagtggctatgtgatattcttcccacccagaaactcttccagtaacagcaccacgactttcctctgttagattcccttcctcactccctacagaactgtaggtggaattgactccacttcccttctgggatgtgcatgtaaccaagttttgaccaatcagagtgtggtgcaccccccatctctggttggttgacagatagtcacatgataaacagcagtgagagggaaaccttcagtttagtcaggagagactgggaaagtggccagaaatgcctcattttcctcgaggcttggtgcagtaaggatgaaaacctggagctgctgacagctgtctgactggtggtcacatgcaggggcctatctgagggcagtggcagcacagagggaggcttggaagagagaagaaagtagggagagagtcaggaccttgtggcactctttaaccagtgaatgctagttgaaggcaatacaaccctctaggaggagtttggaaagttgtcaaggttttcaattgtctggaggatgtggttccgactggaactctttggaaaacagttggcattttctgttaaagccaaacacatacacctacccaatgtccagcaattccattccattcttaggtatatatccaacagagatgctatgaatagatgtgttcacaaaagagttgcaaaagaatgttcatagcagcctttttctctaataacaaaaaaaaaaaaaaaaaaaaaggaagaagaagaaagaaatcatagtcctttagggcagaa

SEQ ID NO: 28969 - DNA, 1045 bp, Homo sapiens
gctcaagtgatcctcccacctcggcctcccaaagtgctaggattataggcgcaagccatggcacccagccagaaaactttctgtagccattcttttagggtgggtcttccagaaacaaaatttcctagtttgcctttgtctaagaatgtcttttttttttttttcattcctaaaggatatttttgctgaatataggattctagtttaacagttcttttctttcagtacctgaaaattatcttgccatttttttctggcatcgatggtttctgaataaaaatctgctatcatttgaatttttttccccctatggctaagatgccgtttttctctggctgctttcaaaatttttctttgtcctttgttttcggaagctttattatgatgtatctttggtttgctcagcttcttaagtttcttcttgacatatttgggtagttttcagccattatttctttgagtagttttctagcctctcattttttcttctcacctccaggactctgtggacacaaatgttagctattttttataatttcattggtccatgagcgtgttagtccattctcacattgctataaagaacttctcaagactgggtaattataaagaaaagaggtttaattgactcagttctacatggctggggaggcctcaggaaacatacactcatggcagaaggcacctcttcacagggtgacaggagagagaatgaacacaggaggacaggccaaacactgataaaaccatcagatctcatgagaactcactcactatcacaagaacagcatgagggaaaccacccccatgatccatttgcctccacctggtctctcccttgacatgtggggattatggggattacaattcaacatgagatttgggtggtgacacaaagcctaaccataggctttatgagtctctgtttattttttttcactctattttctctccgttgttcagcttaagtcgtttctattgcgctaccctccagttcacagattctttcctctgttccctcttttctgctgtgagctggtccact

SEQ ID NO: 28970 - DNA, 1034 bp, Homo sapiens
acacatacatacatcctctcatctaccaatctatcctccatccatccatccatccatcctccatccttttattcatccattcatccatccatccacccctccatatatgtatatatacatgcatacatcctctcatctaccaatctatcatccatccatccatccacccatccatatacatatatatacatacatacatcctctcatctgccaatctatctatcctccatcccttcacccatccatatacatatatatttacatggatacatacatacaccatctcatcatttatccatccatccatccatccatccatcccgtccattcatccatccatccctccttccattaattcattcatctatcaatctacccatccactcacccatcctttccttcattccacagatatttgttgaacactcaacaatgtgctaaatcctaagccagaataaaaacagaatcttgcaatgctctcctccaagctggacgagatggtctcctcactgtccatgtctccatacctctgttcacttcactcagtacctgggtcatcctacctaccccctctgcttatctcctggccccaccccctagaaaggtctgacctgaggctgttgagctaaacccacccgaacatagtctcactggctcgctgaaggtgagccaggaggaggatgaacagatgtagtccatgcgcatcccataagtgtagcacagggaggtgagtgtaacaagagccaaatgctgcaggaagagaagagggtccagattcgggctccataatctttacttgaaggagtcagaggagtgtttacagaggggaacgacatgagggatggggcaggtagggccagttgacactccctaaacagacaggatgggggcagtcactctaggccaaaggaactgcatgtgtgaaggcacgtaagcatgaagcactgtcttctgggttggtgcatgtgcccagaaccagagttttaaaggaacagctcagagatcattcgatccaaccttccattttatagatg

SEQ ID NO: 28971 - DNA, 1023 bp, Homo sapiens
tgatatcagcctcatctcctagttgctgggcgacaatgggcacattagtgaatctctttgagcctcacagaatttgtcatgaggttttgagggttagaagaaatggtgtacattgctggctgggcacggtggctcacgcctgtaatcctagcactttgggaggctgaggctggcaaatcatgaggtcaggagttcaagaccagcctggccatcataatgaaaccccgcctctactaaaattacaaaaaattagctgggcgtggtggtggcgcctgtaatctcagctacttgggaggctgaggaaggagaattgcttgaacctgggaagcagaggttgcaatgaaccaagatcatgccattgcactccagcccaggcaacaatgtgaaactccatctcaaaataaataaataaataaaagaaaaaagaagagatggtatacattaggtacctgacatttactaggtgttcaataaattttggccccttccagtggtgtgctagcaaatgttgaataactgactctcaaaaaaaaggctctgatttagcattagctaatttctgtggtgtaaatactaccatcatggccaatttcaagctattgacatgatgtcatagcatttggagttgggataataagtagatgggggtgaaactgagtccctgggttcagagtcacacagccgattagtggcagagctgggactatgttgtgtgcctcctcactcccagtccagatcacttttcacattttggtgctcttggaacttgccagggtgctgtccttcctggcaaaatggccacatagagagaattttgggtgattgcagaagttaaatccttctagccaggctctaataggtcagccttgctttcgattatacaattgatccttgaccaatacacgggttgaaaatctaagttgactctatgcatttgaaaatctaggtatacatttttaatccccaaaatcttttttaaaaattatttattttatctgtattttttagagacagagtcttgct

SEQ ID NO: 28972 - DNA, 1054 bp, Homo sapiens
ttctataccgagaaaaccctaaagactctgccaaagactccaggaattgataaacgacttcaggaagtttcaggatacaaaatcaatgtacagaaatcagtagcatttctatacaccaataacgttcaagctgagagccaaattaaaatgcagtcccatttacagtagctgcacacccacaaaatacttaggaatacatcaaattactttttgtgtgtagtattagacaaccagccacattctttgagctaaaaataaaaacatgcaagatattaaaaatacaaatagggactgaatagtacagtgaagaaaattacaagtagaacataagggaatagtcaagaattgtaggaaaaaataaaaatataagtacagactagatttctcatgtttaggaaattagactttttaaataaataaaaaattgccaggcatggtggcttgcaccaataattccagccacttgggaggctgaggtgggaggatctcttgaggccaagaatttaagaccagtctgggcaacatagtgagactctgtctccaaaaaaaaaaataataattactgggtgtggtggtgtgcacttacagtttctgctactcaggaggctgaggtgggaggatggcttgagctcaggagtttgaggccgcagtgagctatgatcacaccactgtactccagcctggatgacagagcgagacccgctttgtatgtatgtgtgtatatgtaatacacatgtatacgtgtatatatatgtataaaatgttctacttcaaggaagatgattacatgaaggtatataagaaccaccaccaccaaccaccctctacaagaagggaagagtaaaaatcatatcatggtaggaattgtatggaaaaactggaaagtcagaatggaataggtagtacattgctaaatttgttgattgttttagaatgcttctggaacacttcttcaagagtattcatggggaaaaatgagagtcgtgggtaggtaggtgaaaaaccagttgtcattcatgaaatgttggatgaatcaaataaatgagggctttta

SEQ ID NO: 28973 - DNA, 1037 bp, Homo sapiens
ttagaccatatttgtgtttacacaaaagcgaaaacttttaaacttgtgaaagaaaatatagcttacagtcttcatgaccttgaggcatgaaagacttcttaggacagactgtccatcaaagaaatgtcaataaattggaactcatcaactaagcacctctgctctaagaaggactccctgaagaaaatgaagagctgaggtgctcactgggagaaaatcttagcatcacataaatctgacataggacttatttctggactaaataaagaagttgtacaactgaataatacaactcaattaaaaggtagaaaaaacatttgtctacacacctctaaaaagaagagaggaggattccaataatcatgtacaaacatgctcaacgtcattattcattagggaaatgcaaattaaaatacaaagtacaataaaatactactacacacccaacagagtggccaaaatttaaaaagacttacaacccaagtgttgacaaggatgtggaacaactggaactatcatacattgttggtgggattgtaaaatggtagaaccagtttgtaatatagttcatcagtttttaataatgttaaatatgattttccatatgaccaacaatttcacttcctggtgtttacctgtgaaaaatgaaaacgcatgcccataaaaagacttatacatagatatttaaagcacctttatttatagaaacaacccaaatgtctgtcaacagatggctgggtaaacaaattgtggaatattcatacaatggcatgctgtttggcattagaaaggaacgaaatacttatgcacatagcaatatggatgaagctgtctcatgtcaaacaaaagaagccagacacaacagacaacatagtgtgtaattttattttatataaaattctagaactggagcatgaatctatgttattagaaagcaggtcaatagttgcctggattctagaatatggggagattgattttaaaggggtgctttttggggcaatggaaatatcctgtatcttaagatagtagttaca

SEQ ID NO: 28974 - DNA, 1047 bp, Homo sapiens
cctcccgagtagctaggactacaggcacaggcatgcgccaacatgcctggctaatttttgtattttttgtagagataaggatttgccatgttgcccaggctgatcttggactcctgggctcaagagatccacccacctcagcctcccaaagtgtcgggattataggtgtgagccactgtgctcggccatctattatctgctaaatttttactgcttaattttcccagagctcttctgagtgtgtgattggaatactattagtccataattggatttactattagtttaagacagtgatgctacctgtgtactagacacttcagtgagtattttatgtgctggtaaaatatgatcaagcttgcacaactcccaggtggcagagccagagttggaagtcatgtgctttttctgcctataaccagcaaaatttagtgtggaaattagcatgcatatgaagttctttaaaaaaatgacatatcaactgtataatttttatttcctatataataatactaaaatccaggatttggcagctgtgcacaaagatctctctgtagctggtctactttatgtgctttgctgaaggggacattcaatcaaatatatttgagtccttcactgggaatgtctctttaaacaaaaaggcacatggagaagactaagacagaaggctcccatccctaaccagctcaccctgcaaaagatggacagcaaaatgtgtgtggaagtgcacagacctctgacattccagtactgaacagttgttaagtgtgtttactatcgccaagcagcccctgagattcccagaagagcctactggtcattttcctgaggcacgaatttaaatcctaaagcaaacgtggggaagttattctcttagccaagaggtaagccttgctgatcagccagcctctgcagctaaactcaactttgtagctctctctctgccagtgtccacgtattttcggaaaaaaaaattatatgctctgtcaatattagcaaatgtgggatcttaatttatgttgctagagaatgccaaggacctat

SEQ ID NO: 28975 - DNA, 1048 bp, Homo sapiens
catctatgaagtggttggtttcttcctgaggtagctacttgttgccaggagaaagcattatgattcatttctcacagaaagtggttccctctcccccttctctcttcctttactctctcctgctcctcacattccttcctttactcttcctttcctttgtcttttttgtgtgtgtgtgtgtgtgtgtgtgtgtgtgtgtgtgtgtgtgtgtgtgtgtggttttaaggagtggagagtttaataggcaagaaggaagggagaaggaagaagctcccctgtacagagacagagggaggggcgcttcaaagccaagagagggaaccccaaatggggcggaaaccagccaggtgtatatatagagaggctggagaaggcagtgtctgttttgcacagggctcgggattggtttgaccaggcctgtctttcacatagcccgcgaaaaagctggccctcccaccctagccttttaatatgcaaatgcagggcaccatgatgttctgcacacgtggggatatgtgagggccattaggttgccaggaacatgttgggcaagggcaagaagtcccgcagggattgtggggattgtcgtgttgggtggacctagtttctaattgcctgcatttgcatatcaaaggttgccagcccggctctaagagcaggggctttacaagaagcttttcccaagaggctttaaaaaatgaaaacttcccaaaacttttcctccttgtctgcctaaaatactttcttaataactcctacaacattcctcccagtggagacgccccactagctgctgttaggaggttttgggcgacaactctttctggctacttcctgcagaaaaggggtgttgaatggggaacagcagctaggcctcctcctggagtccatctaagggtcctcagaagaatggcgtgtccttgtgtggttcagttgacagcaccgtttggagtttgattgctgctaggcaagaagaaacaatttgagttgtagtattgagtatacagagtccaaatatcaatacaagacatatcagtaagagggggct

SEQ ID NO: 28976 - DNA, 1035 bp, Homo sapiens
aaaagcccaaagttaaagaacacacttttggtatggcagtgggtttcaaaatgggcactcctatccattgctggtggtagtaaaaatagatactactccagcagaggctagtgtggccatgtctattgaaataacaaagtgtccatatgacgtttaacttacaagtttttctctgaggaaggtatcctgcaagtgtactgaatacatgataaaaagtggatgtagagggttatttattgcagcagttttgtaaaagcaaaatatttggcacaacccaaatattcattggagagcaagttatgtaaattatgagatggaatgccatgcggttataaaagagaatcaagtagctcctcctgactggtataggaagatctccaaggcatagtgttttggaaaaaaggctgatgttgacagtgtgtatagagtacagtggaaaattagagttcatgtttgcacttgcttttatattgtattcgaaggtaatacaaacacttgtaacaaggaaaccccagaatgtcagggactgtacacagggaatgttctttctcatttggtaacagtgcttgtcacaggttgtcacaagcctgtaacatttgtaacaggttgttacagatcagcatgaggcttttctccatgcacttccatcttgtggcactggtgtcccttaggacttgggagtcccttgcagagagctgtcacatcgatttcttaacagccgtggcccagaggtgacataccccacttccctgaaaagatggaagaaactaataacagcaggtgccttgggggtggtgatggtggtacgtgactgggcaggaagatgaagggcaggaaagaggggaaaacttttaaaatatattttagcaattttgaactatattattcatttataaaataaaaacaaatcattgtaataaagccagatcatgctctgaaaatggtaagaacccagtgctgtgggggcatagaaggggcagctctgccttgcctcggggagcggacttccaagtgtgctgctttctgtggtgctcg

SEQ ID NO: 28977 - DNA, 1038 bp, Homo sapiens
tttattaggagtctaataaataggatttgctggttttgatttcaaagctgtgaaagccgtactataaggtaaaaggtaacctttatttctatttagtttgtgaaaggaagtcatatgtactaatcagtcattatagtgaagatctttgtgacagtttccctccgagcttcatatttcatgtatgttttcattctcttcttgtcttttggattaaaagtatttctgtaaataaattgggaacaattctgaggtccaggaccttctgttatcaggttagagcattgggagccatttccacataaggcaaatatttctaaagcacagtttcattatttagtcatttttaacaccaaccaggttacctttgctgaatacagcaaaatacacgatttgaagtcaccagtcacctgtctgttaatacttttatagtgcagctgaggttccaacctgaaaagccaatgctttcatctgtgggttaattcctttctataatacttatttgctttagttgatttttgaaaaatctctttgcaggaattctggcagtatatttttttcctccttgtagttttggaacactgcagttgagtgagaacattccctatcctaactcctagaactgaattacagccaaattgaaatgatttgtgctttgaagaggagaattggcaaggatgcatggtctatggctcgtgtattgtaagataattgtaaccatggcagtgtgtgtttcctaatattatgtttctacatttaagtgatgagagtcatcatagggaaaaaatccacttgtatgtttctagttgaatttaaattattccaacttcattattacaacattagaagtagctgtttcctgtggaatagccggttcagtaatttgctttatctcatgtgcaagtggtttctgcctgggccagtaatatattttaataaggcaagtttccaggaagatacaacctaacaatgataactttaaaaaacctagataaaggaatatgaaaaacttgataatgaggaagaccgcctttgcagaag

SEQ ID NO: 28978 - DNA, 1071 bp, Homo sapiens
cagctacttggaaggctgagacaggagaatggtgtgaacccggaaggtggagcttgaagtgagctggatcgtgccactgcactccagcctgggcaacagagtgagactctgtctcaaaaaaaaacaaaaaacaaaaaacaaacaattgaccattgctgaattcacaattcctagctgctaaatatatacatatgcccttattagtcataataaaattatttatgtccatctactttatcatttatttaactgggacttctatccatttaatgatacaaatatcttttaagtattgcttgattttgttttcacaatacatgcaaaataaaaatacttcttgcatggcgcttgggtattactctgcttcttttaaacatggcctaaatgttcagaaacttgccccagagtgacatatattgtttaaattagtctagatatatttacggcatagatttttcaataaatttatgtttctaggtatgcaatgaaatgcttagataagaagaggatcaaaatgaaacaaggagaaacattagccttaaatgaaagaatcatgttgtctcttgtcagcacaggagtaagtattcaatttccagcatttcttttaaaaatgttttgtttgtttcatagcaggatgatttattatttttccttctagctgattgcaaggccagtgagttcttgggtgggttagaatctgatagtatctctttatttgattttgcaagttagaagaacaccagccacctccattatgcacacccatggcttctccgtttagtgcctatttatttgtccttgacttccttctttgcagaatatggtagtagagatggcagaaaataatgatagccagaaaaatcactggaatatagtcaagacctgactaaacgactggcaagaaggactaacctagaggggaaaagtaagagaaaagtggcttctgtccttcagaagcgaatcgagagaagcgacttggattactcacatccgaattgtccttttgagattgtccctagtcagcgtttcactggaaggtgatcttacctgcctctcactacctgctactct

SEQ ID NO: 28979 - DNA, 1064 bp, Homo sapiens
taattatagtaaagttatttggaattgtttttgctaatcaggggatactttctatagtttttaataaaacttagttgaaaataccctcattaagtgaagcttttgatcagactgtatcggcaggctttcccgtattgtggacatgtaactgaaatgcattcactcaccacagttttctttttactggaaggtttttttttttttttaatctcaacttgagtattcctacccatctccccaaaagacagtaggaagtactgttcccggttttcttctgtaattctcagatggcaaaaaaggaaatatgcatgttggagaaccagcataagcgtgtccacagctgtgaagagcagtcagcaattcatccagtcagtcatttaagttcctcagaagcgtgactcatttattccctgaaccacagttgaggatttaggttgaaccaggcactctgcggcaagctgggactgtggtcccagttcttagttctcatacagctgcatggaaagggaaaagatgtattattcaaatgatgacggaaatgtatggacaactgggacctgtggcaagagctatggaagacaggcacacagtgctcggaaggcctttcgcagggtggagatggggtcagcgaatgcctttctgaagttgggggttacctggagaggagccagtgcacgtggctcctctgagcccaggcacgtgaggttgggggaatcagatgaggggccagggtctgcggtggtggggggagtcgtgcaagacaaagctggagagagacatgaaggccaggccagaccgtgaagggcatcgccggccgatcttgaggagcctaaatgatctgactgcagttagaaaccaagtgttttaactagagagagaccataatcagccttgcagttcacaaagattgctccggctgcagtgtggaggattttcttcaacaacgacttcatggtcctgttttatcacagtttttttatggcgagttcctgcaaaatgtaagctattttgttgacttttagtaggaaatcaaagtagacagttccttgctcaagagttttact

SEQ ID NO: 28980 - DNA, 1023 bp, Homo sapiens
tacactgttaaggaatcaaaaatgttgttcattacaaggcttttacttagcctggtaataaaccttaagttagtcatatatatacatatatagtatgatctctctctctctctctcaaaaaagaatatgatagttgtggactttgtttttccatgatgtttctttcgggaaggactcagcctgcagctgcaatgaaaaagaggtgctctatttctgctgattggcatcatctcacccaacacttccctttccagtcttctggactgaatctgccattcacttgattccctgcctcctgctatatttaggctagatatagaattctaaggaagtaataattttcccccagagctttgaaactcttactttattgtgtacaagcaagcagtcaatgcaggtcatggagctaggttaccactcgcgatggcagacaggtagcatcccttgtgctcggagactcgtgttcttcagcttggagaccaccctttatttatttgacatttatcctcctctgtttctcatagaactcttattagctggatgctgggattcctttctagatttgggcctctgcacttctgatcttgtatattacctgcatctttgctttaattctttgttttacttgccgatagcacaaattttcaaccctttcgttgatttctttctaaaaatctttagcaggtttaatttcttaaaagtagaacctttcaggggttttaccccatgttaaacaccttgctgcaggtgttctggagttgggtgtcagggaagaagtacggcgggtatgggtgtgcatttgtgtgcaagtgtgcagctcaatgcccaggcctgtgtctcatcccccagccacacacactgtggtgagctggagctcagcatgctggctccgtccccagggcagtagctctgccctgctttgctgtcagtcactgcccctgtgtcagcaccccctcttgtctgctgatggccctctctctctcgtggtggatttatttttttaatatttatttttacttttta

SEQ ID NO: 28981 - DNA, 1940 bp, Homo sapiens
ttttatatcagcatgatttcctttccttattttaagcttcattatatttgcgttgatacaggaaacaccccaaattcaatttttagaaaaatgttgattatcagctttaaacttgctttgcgtgaactcaagctgcagagaaatgacgattttctgtagtaaagaaagactgatctgtcagtcctactgaattagagtccgacctctgggtcagttaacacataccttggagcgtttgcagatgtgccctgctccctccaggccccattgtctgttgtggctccggcaacccaaaggtggtgttgcgtcctctcagagaatgtgctttcttaagctgagctggacggatatgcagtcctgagattttgttatatttgaaaattattgaaggctttggacatgaatcctatttttctttaatttgtctaaaatatagggccttcctttggggctattgagtgcagtggcttttctacaaaatatgaaatgtgatttgttacaagtttgaatgacatgctgcgcagtggagcatgcggatatctcgcactgtgctgtctttgtagaatgttaggttgggacagggccatacgatcatctgaaaactgtaccatgcttgtttggatcttccagtacccaccacccttgattcctccccggggagaagtcaatgctgctgatgcctttgatattggctcatttgatgaagaggataccaaagggattaaggtacacatgtgatcatttatttctttatttttatttttggatgggatgatttctgttggaaatcaaacttagtggttgttttaatattgggctgtttatagtatttaacttacaaatgagtatcaacatatttgaagaatgtgtaagttaaggatctaaattaaaggctttgaaagctttcttcagactaataattttatttttgaggaactacatggtaaaatattattgatttggaatatttgtgattgaaataaaacttgaattatacctgaagcaggaaaaacagctgtgtgatatcaaacatacttccctagtgcaaaagagccagctgtctcaattcttctaagtttttagatctccccgtgttaggatgaaagagcaaacagcatgaatcattttgcatttgtcaatcaaaggtgaaataatcactgttttttttaatacaatcctctgcatttttcgaacttttgttcatatcgttattcccccaagtagagacaagacataattagagatggtgagtcatgagagaagatcattctgtttaagatgctgggtcaaagtgtatcactacatcaagctctcacctacccccatgctggcagcttgccccaggctctaccccctgcccccgggccttccctgtttcttctcagctgcccccatttacacccttctgacacaaacccgcgttgccttccccaccaagtagcttccttctccagaaggctgcagcactattaaaacacacacctgtgaggtgtaaataaaagagtgacaagtaaaatgcaagggcctagcaggagctataactggagacacgtaggactgggaccagctagactgtgggacagaaaagccagtaaatggctggaggaagatgggaggattgtggggaaggagagcagcatgtacacgccaagtgcacctggggaacccagtggcagctggtcagagctaggggccccaggagatgaggggctgggccatgatggtgattggggtgttcatgggaccagcttttctggtgttggaggttaggtgaaggcaaagtgcagagggcccaggtcacagggctgtgaggattgctgaccaactgagggacacccttctgtggtctggagcagtggctggggtcagcattgagaccgatgcctagacctgtgcacaaccaggcatcgtctgtagccggaaccattgatacctgtcag

SEQ ID NO: 28982 - DNA, 1757 bp, Homo sapiens
tcgtaaggtattttgcagtcgagaagaaagcaatgccataaatcgctttagtttgctctggcttggaagagctcagtctaatatttcaaagtcttcaggcagcacacaaataagtctatggagacaggtggccgggtttctttagtatgcccttttatcttggagtgcttggggactggtttggacgttttttccttccagattgagtatgacagtgtctggagtggggttggtgtcattggtgtgtgccctgtgcggtcatctgggcacctgactcagtttagtcctctgttgtcatcaccttgagactcttagtcatttttgaacaaggggcctgccttttcattttgcactggggcccgagaagtatgtagctggtcctggcgaggaacttagcacgacatgtcacttgtcaagagaggtaaatgtctcccattcaagtactaaccaggcccaaccctgcttagcttccaagatcagatgacatcgggtgtgttaagggttgtatggccatagacaaaagagttaaatatataaagacatttatattacaaacagcattttaaaaattgccaaatcaggccaggtgcagtggctcatgtctgtaatcccagcacctcgggaggccgaggcaggaggatcacttgagtccagaagtccaagaccagcctgggcaacatggtgaaaccccatctctacaaaaaataagaattagccaggtgtggtggcatgcacctgtagtcccagggactggggggccgagacaggaagatcacttgagaccaggaggtcgtctgcagtgagctgagattgtgccactgcactctagcctgggtgacacagcgagaagctgtctcaaaaaaaaaaaaattgccaaactgtatttttatgtaaataattcaatgccctactaaacataacatcaagtaggaaacataagttttaaataaatcagtcattctcatttcactgaatatggttactcttgatttttctaagatttcatgaattgtggataattaaatttattgtagtcgatgattatgttaagatgtaatttcatcttccctctgagcaaagacccttgcaaggttaaccttatgtaacaagaatggccagaaactctttcactctattaataggttactttggtagcagcatcttggtataggattccttggtcttatctgatgattttcctgtggcatttaaagtgtcttcaattctggatgacttactctttatataaacgttgccagaatacaccaagggaatcctgcattcttttaactctgtttacctcaattctgcagggacacatagcctttatttgtaagctcttctttttttttctagatggagtctcacactgtcacccaggttggagtgcagtggcgcgatctcggctcactgcaacctccgcctcccaggttcaagtgattctcctgcctcagcctcccaagcagctgggattacaggcgcccaccaccacgcctggctatttttttttgtatttttagtagagatgggatttcactatgttggccaggctggtcttgaactcctgacctcatgatccgcctgccttggcctcccaaagtgctgggattacaggcgtgagccactgcgcccggccataagctcttctttagagaaccggtccattgtgatcacactggggtgtgtttgccacagcagattttacacaggaaattgaatcaatgtcgacttgctcaagggggggtcatggtgtcact

SEQ ID NO: 28983 - DNA, 1028 bp, Homo sapiens
atccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaacgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttc

SEQ ID NO: 28984 - DNA, 1014 bp, Homo sapiens
accaaaagtctaaccagcttcttgcttcatggtggccgggaaacactaggttggaaatggcaaatacttggcacaggttccatccctagccattcctatacccgtgccagacattgctagtcaatcacagcatgctgtcttgttcagcccaggcacagctcagaatgtttctcaatacaacactctgggcagcccccaactacagatcagttggtgctggcaggtgaaagaaacattattggccatcctggcactcagccacgaggcccatctgtgaggtccagcatctcatcagcctgtaggagtggcctgatgactcaccgggtggccaggagtgtgtggccagcctaggtcagtggagcaaccatgatacagagaggggagagccaatgggctggaggagctgagattttttttttctaatttctcatagaaacacccactgcatgatttagcaatggaggctggcagggtggggtgaggctactggctggtcagccactgatatgcaaagcatttgaagattttaatctgcctgggactgaatctgagtcaaccggggacatagctgctgccaaggacatggtaataacgtcagaaatggctcacaggcctacggagcatctagtactcaaaccgctccgtgaagtgggtgagaaaaactgcatccccatttgacagacagaggagttggtgacctgagaggtttgacaacaggcatagtgaggcccactcttagatctaagacttccagggctgctgtggacccatggaaatgcaggaagcctgctgtgtgtaccctcatcaaccctttgcagagtgaaatgtccacttctgcggcagaaggcaggttagagaagtcccaggagactgagcattgttctgaagaaactaggagccatgtcccctgagaaaaggctgaaggtgacagatgagaaaactgggggcggattccatcatttcagttggaaaaggggttaacctcgttgtctgttgttccagagagtggaactg

SEQ ID NO: 28985 - DNA, 1488 bp, Homo sapiens
ccattctcctgcctcagcctcctgagtagctgggactacaggcacccaccaccacgcccggctaattttttgtatttttagtagagacggggtttcaccgtgttagccaggatggtctcgatctcctgacctcgtgatctgcccgcctcggcctcccaaagtgctgggtttacaggcttgagccaccgcgcatggcctgccagggatcttatacttcactggggagtcaaagagttccttggtgacagagaaaaagatagagtttagtgtgtgatcgtgaaggactggcaaatataagccacacacatcgccactcttcccttcagcatccttgacagacattgcaagttgattgcctatctctctttgggaacttgggtgcattttcaggctctttctcagaacagtgttctgggtagccaagttttaaaagaactttggagtcagtcttaggattgagactactgataatcctcagtttgaatcccagctttgccacacacctgctgttagatcttggggatgattgcccttccctgagcctccatcggctctgtagaatggggagaccactcccacctcatagggccattgtgaaggttcccaagcgttcttgcagagctaagacagcgcttgatgccctgcaagtgttccctgaaacctcattctgtgttagcaccagatgatgagattgggggccagaggtgctctgttggaaagaaggtcaggaggaggtggggtgagggtgggggcagtaagggatggctttctgggagaatcaaaacttgaggggaaccttgaaggatggggaatagtcaataaatcaggagaaaatagtgatggtgcagggcatttcaggatggcttctccaagattcattggactggttcggtaggagatgaggatattgataggatattggggtgggggcagggtggacacttcagaggaggttacagattgagctaagaagtggaggctggtctgtgcagcagtgttcaaggcgtggtaagaagagttgggaatctcccacggctggcagaacttgtgagcccccctgccctcaaaggactacaagacccctaatgagaagagagcttcctcccagtcctcctttctcttcctcctctccctccctctattcacccagcagctgtttactgagtccttcttttatagtgggcactgccctagcctctgggatgccaggttgctggcctttctgttaccagtgcacctatttgctctcgcctgggtacctacttttgcactggcttttcccgtcacttagaatgtatgtccctctggttttcacgtggctgacttcttgttggcgctcagctgaacatcacttgttcagagaagcctcccctgaccaccctgtccacagtactctatcactgcagttctcaaacattttggcttcaggctctttacactcttgccatatgacgcacagtgctagctgattgcctgcctatctttggg

SEQ ID NO: 28986 - DNA, 1091 bp, Homo sapiens
taatgggtcatatgacaaatttgtttaactttttaataaactgctaaaaattttccaaaatggttgtaccattttgtacttccactcactatagatgagcattccagttcctcctcatccctgccaacgttcggtggtgtcagttccttccactttagccattcagctgtgtgtataatggtgagtgggagtttgatggatggggaaataagatgcctggagtgtcagacaaatccattgagtgtaatacccaaacaacattacagttactaaatatgggtaatttatttgacagtttcaaggaaccacaaatcccccctgtggagggccaactctaaactcatttcccactccatgctggcagtagacaacatgtccctcatgctcatgctctcaggggtaagcaggttcttttttgttttgtattattttggctttaaacattttttctttctgcttctattggaccaggggagtcagattatttacaaagtgcaggtaattttatgagaagtcaaactccttctgtgctgagccatgacatgcatgcagaatgaaaagtcagctccaacagtgaccaatcctgcattctgatctttctgcgtgactgagcctgctttgtgaaagctcattctctggcttgaagccatctattgactcttgtcaccagaagaataaaatgcatgctccacaaagccttgagtgccgaccatcatggacctctccacctcatctccacatgcttcctctctatgttccacttctgctgactttgttaggtgtctcaaatgctcaagagctaactcctgtctcaggcctttgctgtttttcgttttttgtttctgggacagggtgtgattctgtcacccaggctggagtgcacttgctgtttcttgtgtctgtaatgttctttttcctgctctctctctttttaattttatttttgctatttacttatttattagagacagggtctcactctgtcacgtaggttggaatgcagtggcgagatcacagttcactgcagcctcaacctcctgggttcaaatgatcctcccaccttagcctcctgagtagctgggaccacagga

SEQ ID NO: 28987 - DNA, 1046 bp, Homo sapiens
aaaatactgtaggtcgaatattgtaagtgcatttttgattttgcactattgtaaactcagacaaattctaagtccaaccattgctaagttggggaccatttgtaatggtttttaaataatagaagaatgtttcctcagctgtctgtaccattcacaatataatggccacagacacataatacctttaagtttaacctgtcttattaacactctgtacatcactttcttaaatccagacaatcaacaaaatgatcaaaccctgatttgcagcactggccattatccctggtgtaaatattcccattgtggcttatttcaagctaccagtgtgacgtcattgaatgtggagttggggagagatgcatagataccattatatgtgtttcaaccatataggtacaattcatgctaataactagtgtactccatacaattgtaagcttatataatttaattttatgattgcatttcacaagctgctcataaaattcctgaaaatttaatgattagctcttgtgggctggtatgagctgcacccagcacactgctataaatcactgtggccatgtacttcctgctcagtgggtaataaatggcaaagaccccatgccatagttcagatggccttttgtcttcttcctgggaagttctttttacactggaggctccttctaagggcatccttcctgtccggataaagcaggactttacctttcttctcttccaaaagcctctcttttttcccttcatagcacatagtcacagttggcagcaacgtctccttttgggtgtggatttatttgttccccaatgcaactgtgagcaccatgagtgcaggaaagtgcctgtttctgatcatggtatttcctgggtgtgacttcatgtacagtcaagaggagaaactctgagtgggagcactagggaatagttgaagcttaatcttcattttggagaagagggagtgttattatccacgttcattattcacagtagcaaatttcacagtagcaaaaaggtgacagacactcaattgtccatcgacagat

SEQ ID NO: 28988 - DNA, 1018 bp, Homo sapiens
ctctccgtcatcttagcacagagggaagcacaaagtaggggctgtgctcagtgccctgtcagtgtctagcaaaggcctaagcactcagtaggtgctatgctcagtgtcacccaaggtgctttgcagtgtcaggcacaatagtggatgttattctctgtaccatcggcaatgcccatcccagtaccaagcacatagtgtgctctttctttgctgtttcctttccctgagtgtttctagcagtgtgtctccaggaagttatgccccaagacacttcctccaggtcctcagcctcttgcacgttgggacttggaatgtgccacctggagctgctatcagggtgcagtcggctgaaataggtggggtgaggcaagcagtccttgaaaagatggtccagggctgtccttccctgtgggggtcatctggggtcagtgagcagcgacttggcttatgcatttcctcccagggccccagacaaagagagagtccttggcaatgcggttaccttgacaactctttgtgttggagagtgagagagagagggggaggaaggcagctcagggaagcggggtggctgctgggggagggggaaggagcagggaggagctggaggagaaatccacctttaaaagggaagagagaaatgactccacttctgggcagagggaaggaagtgtctttatggtgcaggatggaggctggtctgggtgggacatcctgcctctccttctcaccccatctagaaattctgccagcagtcttaacatccagagaactaggtctgagtcccagcccttcttctaactttctatgtgactttgtgcaagttactttccctccctgaatctgaatttcctcttgtataaaatagggataataatccacaaggtgactgtgagcattagctgagcatttcaggtaaatgaatagtagtgggcccctagtgagtgttaactccctgggggccattattcatttggtattttcttagtggtaacctgggcttagtcaagtgactccc

SEQ ID NO: 28989 - DNA, 1047 bp, Homo sapiens
tgtcaacacttgctactatctgcctttttgattctagccaccctagggggtaggaagtgtatctcatcgtggttttgagttgcacttccctgatgaccaaggatgtcagacatcttttcatttgcttactggccattcgtatatcttctttggagagaaatacttattcatatcctttgctcattttttaaaaaatgggttgattggccaggtgcggtggctcacacctgtaatcccagcactttgggaggccaaggtgggcggatcacctgaggtcaggagttcaagaccagcctaggcaacacggtgaaaccccatctctactaaaaatacaaaaattagctgggaacggtgggacatgcctgtaatcctagctactcgggaggctgaggcaggagaatcacgtgagccctggaggtggaggttgcagtaagccaggattgcgccattgcactccagcctgggcgacagagtgagattccgtctgaagaaaaaaaagttgggttgtcttttgattgttgaattgtaagcattctttatatattctggatacaaatcagttatctgatataagaatcgggaatattttctcccgttctatggagggtctttttactatatggttttgtttgcagcacaaaagttttaagttttggtggaagtccaacacacccgtgtttctcttttggtgcttgtgtttctggtattgtctttcagaactaagctctgtgggactctaaaattggtcctctttttactccactgaagtgacaggtatttgctcccccatagggattgtggaaggagctggtcaggacttggtggttgtctcaggctggtcgggcatggagctgtggggaagaacaatgaccctggaataaacaatctgggttccaatcctggttgggctattgctttccttggttcactgccactgagactcagttttttcatctgtacaatggagataatcgcacgtacccttgaggtggctgtgagattaaacgagggggtccgaacacatggaagatgcttgataaacacagc

SEQ ID NO: 28990 - DNA, 1027 bp, Homo sapiens
catacctgatgctgttcccttatacgttttttttctttttgctcttctgcagacagtgactgaacccttagactttttctgctatttcagcctataagctccttttattggcttaaggtggtttttttgaattggacttatatcaagagttgccaagagtccttactattacactcattaggcatgtaatttctcctccctggacctttcttatctgtaaaatgggaatgacaaaaacatagatctattatgtagcttaaataaaataacacaaataaagcacttatcagtgtttggctagaatacatgctcaattcagctgcgattaatccacactcatccttcaagtttcaaaaagttctttctccttcacttgttctcgtataaacggttcctgtgaagtttaaatgaggtatcatgagggcaaaatgcctgccatgtagtctggcacatttataatgtagctgttaaatggttttctgattagaaagttatggaagcccaggtaagggaggactgcagggccaagaatggaaggcagggagaggtggtttgagtagtatgactgtccactctgtggaatggtggtgaggctatctcaactggcagctcagcacttagcacagtgctggagccactggcatgagtgaatgtgtgtccacatgagagaaccaatgaatagttcaaccacagccaggactttgacttgatctcgtagggagctgtgcaagttcccaaactgggcgctgacaaaaaagcatcctttacaaaggacccctctgtagcctacaggggctggagaggaggtggggaatctggagctgagtgtgcaagagttgcctggggttggggttgagatggaaacatcaggggcatggatgaaaacgagagatctgatgtagagagctctgaccacacttgacacaagaccatgtgcatgtgagtgtgtgtgtgtggggtcttgctggtgagcttatgtgtgtggagtgtgcaagtgtgtttgagtgtgtcgagtgggtggagatag

SEQ ID NO: 28991 - DNA, 1025 bp, Homo sapiens
ccaaaggcctttgcttggcaaagaagggtccatatgacctggttttggctcttttttcggctccatcatagatccctttgttcttgctccaacctcaaggcctcttttcatgtcttcagatacagcatcctcatggagcatcctcatggtcatctttgggcctccccagtgctcatccttctgcctgggcatcacgtgctcaacctctcatcattcaggtcttgatctgaagcgcacctcttcccagaagcctcccctgcatcccctagctgggtcagttcccacccccatacgtgactcttcctcattgcctgttcattccagcatcacacatgacaccagtggcactaatagatttattcttctgcctctttgatgaatgtctcctactttcaacagtatgaaagcccccatgtctattcttcttcccaattggaccctcagtacccggtaggtattcagtaactatgttttgaatggttgaactgtaaatgggtgagtttgggtgtggaatgtgtgagggctgagaaacgactgtggctcccatgggactgacttatgtatcaggtgtgtgactctgagaggacaaattgctcatcttgagatgaccagaaccatagcctaaaacaaacaattgaagaaactgtaagagtttaacctggaaaggacaagacttggggaatgtggcaagtaccagtgtgccactgaagacaaggactgttcctgtttaccatcctgtccccagaatctagcccagtgtctgacacacacaatatagactttaggaaatatgtccccagtgaattttgaaagagagaagaacacctaagataggtgaagctctcaaggttcaggaacacagatcttgcctcaatcaaagaaaaccattctcatgtttagagttgtccagagctagcacaagtttagggtgggtagggggtgacctacactgggggttcttcaagttccttcgtgctctgagacttttttttttttttgcaatggagtttggctctttttgccca

SEQ ID NO: 28992 - DNA, 1101 bp, Homo sapiens
aagatcaacctaatttaggcctattaaaatggaaagcatattatctctcattcaaaggaatttgtatttgatgcaaatagaacaagttcctaaactttagaaatgttcttggatttttcatctccgtagttaaccaacgaagaatgggtcccccatttaaaaacaggggaacataaggaacaataattagttatgtaaataatgtggcattcttgtttataattagttcaagaataaaataaaattcacgcatgtcacaggactaattttcgtatgcaaatgaacaatcaaaattataaatggtaataatgcagtttgggagatgtgacattctcaatttattagcaggggtgccagttacagctgatgatggctgacgttgggagatttcaaaggtgcctgggtctggaaaattctcacccatcaagaggagaaaatctaactaaaatattttcacccattttatgtcactgatggctgcaaagtgaacccagggcgcctctgtggctggagagacaggtgctgcaccagggagacaggagtccaagtgaatttttgaaaagaacgctctgaaatttggctggtgaaaaaagcaaagaccaggcattgcaacctgggctctgacctcaacaacgtgtgtcaccttgggcaggccccctttgctgcctcctaatttccccatctagggtggaagttttattaaagaggaggagggagttttgaaatcaaactgacttggaatcttggttctaccacttgctaactgcagggctttccttaacctttctaccttacctatctggactcatgtagcctcatctggtaagtgacagcgatattctatatctttaggcagtgccaaattaccttaaagaagggctaagcacatgtttggggcactagaaaagtagagtaccaggggaagaaaaagtgtgagataatcaggaggtctagaatcaaaagctgcttaaattttggcattatgagagcgtcgtgtcattctgaaaaataatttaaaagtacttaatatatttaattgaaaattatatatggaatgtatgggtgtgcattatatatagaatatgctttgctccttggaat

SEQ ID NO: 28993 - DNA, 1028 bp, Homo sapiens
cctcctgagctcaagtgatcctcccaccacaacctcccaagtagctgggactacaggcgcacatcaccatgcctagctagtttttatatatatatatttttgtagatatatgattttgtcatatttcccaggctggtcttgaactcctgggctccagcaatttacccacctgggcctcccagagtgctggtattacaggcatgagccatcgtgcccggctactcctaagtattttagcttttctttttgggactattgtgagtgcgttagatttcttaatttctttttcagatagttgattgttggtgtaaagaaatgctgctgatttttgtgtattgattttgcacactgcaaatttactgagtttgtttgtcagctctaacaatttttttcatggagtctttggagttttctgcatataagatcatgtcattagcaaacagactatttcccttcttcctttcctatttgattgcctcctatttctttttcttgtctaattgctctggctagaacatccagtgttgtgttgactagaagtgttgagagtgggcattcttgtcttgttcctgatcttagaggaaaagttttcaacttttcaccattgtgtattatgttattggtgggtttttcatctatgggctttgttgtgttgcagtacattcctcctattcctaaaaaaggatgctgaattttgtcaaatgtatttctgcatccatgaagatgacaacatgatttttatcctcctcttaatatgccatatcacatttatggatttgcatatgttgagccaaggatcaatatattatgagcatttactatgggatcagtgtctgtgttgaaggttttctgtttgtgacatcacttgaccttcatgaccattctctgagccaatgaatactccattctgcaaatgatgagactgaatctcagagaagttaatcatcctgacagtagtgggaagcctgtgtttgtccacttttctgcagtgccaaaaagggagagtgatgtctttctcttctctgtgt

SEQ ID NO: 28994 - DNA, 1042 bp, Homo sapiens
ctttttatatagttatgtttaaagtatgtctcttataagcagcgtatacttttctttttaattgagcctaacaatctttgccttctatttgaaatatttcctttacatttaaataattactctgttaaattacatgaaactataaatgtttaaaacaaattacataattttataagtttcataaagttttacttttatagtttatatattaatgttatatgattttagagtgtaagttttacatagatatattacatttattcttaaatattttacatatttatgtaatattgtaaataaaatttcatttttaaaatttatgttctagttgttcagtgatagtgtgtaaaaatactattgatttttgctaaattcacttattacaaggacagcaaataaaaacagcttttcttctccctttccagtttgtatgccttttatttctttttcttgtcttatttcagtggctgtgatagctcagacaatgttaaattacaaagtggtaagagtggacattcttgtcttttttctaatcttagagaaaatgataactattccggcattacttttgttagttgtggatttttttacatgctctttgtaaatttgagaaagcttttttctatctacagtttgttggaagtttttatcacaagtggctgctaaatttgaaaataattttctgtatcagttgagacaatcatatgaagttttttcctttattctcataaaatcatgaattgcgttgtttaattttcagacattaagtcactttgcattcctgggttaaacctcacttggttatgatgtattatcttctcgtacattgctgcattcacttttataatattttgttcagaatcattgcaccaatgtccataatgaataatggcatgcattattctctttctgtatttttttcatctacttttgatatcagggtaatactggcctcataaaatgatgttctatttgtttcttctaaccttcattttctgaaagagtttatgtagaactggtattatttctttcttaaatgtat

SEQ ID NO: 28995 - DNA, 1035 bp, Homo sapiens
gtgggggcacagagggagggaggagagggaagaagctggttccagtctcgtagaagtctagaaagagaagactccagcttttgccatcagtgcctgcaggtgtgatgtgggtaggactttagctgggtgtggacctagaaggagaagcaggttgaaagaggactgtttaagattggccgtagggtgggtggcgctgcttctgctgctgctccagcctttggcgtctacacttttcaaaataaaacacgaaccccagacgtgggcatgcaaggcttgctgtgaagttctgacaagaaaatggacatccttgaaaaacaatggccacacacacaaaaaaacagggagcatgaagtccaacaactcgggatcagatcttgcagacatcatggaagctctggatctccatttgctcatctggatgctggaatgataaccactgattccaatcatccgactataaatcagcaagcagaggaccctttggtttaaccaacactcctatgaaatagagcctggtattggggaagaaagtcccaaaatggggtctatggggacattagttctaactcagattggctcctgatttcatgtgtgatatttgggaagccattttccctcagagtgaaatccaaagccctggcctggtctctagcagccctatgacctcattttcgagccctgttgctctcactcaggaagcacgatgcccagttcccttctgtttctttcttaagtttgttcccagttcgcagccttttcacttgcagtctccccttcttggagggctcttcctcagatcttcagatggttcactcctttgtttctttcaggccctgctcaaatgtcactaagtcaccatccccggcccctctactaaagaggcacatgtggccttcctaggttttctgacatgtttgttcactttacctctgtttccccacaaagataagtatgtcatctgcctccttcaacagccatatccctgaggcctagaagagttgatacttgattaaccatatggtgaattaatgaatg

SEQ ID NO: 28996 - DNA, 1027 bp, Homo sapiens
aaccttagccagtcatcatttatgttattttttttttccattggtcagctgtgatgttaggataggtttgctcaatagttcaggaaattaaaatgatgaagctgagacagatttatgaatagtactgattttaatttcaaataatagatgaatggcttattagctggcttaaaatgaagatggcctatgtaagatatatcactaattttatttgagaagtcttcttaaagcacttatttttgagtagataagacaatcacatttcataattcaaattgtataaaggaatgtatacagtgatacccctcttccattcctatctcgacacctccagaaaccaatattaccagtttttttgtcctggagattttgcatatataagcaaatatatttattttctttgtccctctttaaaaaaaaaaagaacatgaattgcagtatacacgctattctgcatcctgcagtttttcttgatcttgaggaatgtatgagacaaggttcagtcagagaagtggagctactatgtgtgttaagacatatggcattcatcaaatgaattggcctttactcagttggagttgctgaagaaatgaaggtccagaagggaaaggtggagaatgagaggagtcactaaccaggctttctgaaggattagtgtggtgaacaagtcagagcttgttagggaaatctgggaaacagtcacatccagctgctgaggtgagattgcagaaaggatagtatgctttcaggaagagcgggatgtgaaatggaggagagtggggacaacctaaagctttccacatacctttgtgagtgtccatcactatcctaatcctgaaatcttcattgagtcacgtctgttgcattgttcctgccttctaaaatcttgtgcaaattcctcttggccaaatcttactcagagccatacaaggaaggggattctggaaaacagttccaagcttaactttactaacccagcacagttcagcaccaagagcatgctgtattgatatgtaaaggcagcttt

SEQ ID NO: 28997 - DNA, 1082 bp, Homo sapiens
tgtggccgtcaggcgccgcctcaatgcctcctgggagttgtagtttagaagggagagcggaacttagaacccgggttcccctcgggtgatcccgccccctcgactccccagccaatcagcaacattagtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactggtacgagcgacggtttcgggaaacgggcccgggcgagagacacgtcgaggtctggcctgcgagaggggaggacggatctggctggcggaagagaaggcgggactgatgggggggcggaggtctagagagcaggcgtgagagaagtgtcttgatttctcaggaggaaattgagaggcggggactgagggaagcaacgttgaggtgtggagaagggagacgaacgggactggaggggcgggcgctgaagttagaggaaataggggggccgaggctagaggggagggagatttgaggggcggtacctacgggaaagggaaggagaagtcgaggggcggaacttgaggaaagggtacttgaggggcagggcctgggagactggaagacttgaatgaatagggtgagtaaggtttaaagttgggttgatgtatttaagaaaggactgcagaagtgtgatccgagattagggagtaaagcatgaaaagcttaatattgtgggcgaggcctgagggaaaagtgagaattggagggagagggtccaataaatggtttttccccctgagactgaggttcttggagagacggggcagtgtggatagagctgaactggtaaggaaataggacagactctgggagtagaatgtgaaaggggctgaa

SEQ ID NO: 28998 - DNA, 1030 bp, Homo sapiens
ttcaattttagtttttcgttccatttctaaagtttgtactatgagcgtgcatttttttaaatttagttttattttattttttaaatagaaacgaggtctcactgtgttgcccaggctgatctcgaacttctgagctcaagtgaacctcccgcttcggcctctattatttttattttatttttttttcttattttttgagacggagtcaggctctgtcaccaggctggagtgcagtggcgagatctcagctcactgcaaccttcgcctccgggttcaagcaattctcctgcctcagcctcccgagtagctgggactacaggcgcccgccaccacacccggctaattttttgtagtttagtagaggcggggtttcaccgtgttggccaggatggtctccatctcctgacctcgtgatcgcccgcctcggcctcccaaagtgctgggattacaggcgtaagccactgcgcccagcctcttgttattttaaatgaggggacaggaaaacgtcacatgtagagactgagaccccggggttgaccctgagccccctctccgaggggaggtcgaggttcctgcctggccattgtggcgtgagggtggccaggtgtttgtgaaagaggggcccccagagagcagcacgggagcgatttatacacacgaatattaacatggagaagtccgagaaacccccgtaaatatgcctgtccactttttttaaagcaaattacaaaatgtgaaattccccagaaatgcacagcaataccttctctaacaagtaattattgcttcctcctctgcgggcagcactattccaggttctaggggtgcaaacagtagtaagactgctacctggtatttggaggatatgcaaaaagtgaaatgttaagatagcaggttcctaagtaattctttagtgttattaagtcggattagctggtcaattttattttggtagggagggaacaggatgggaaaaagaactaaaagcaagtccatctcttgatatctaagccctctaaagggacatagt

SEQ ID NO: 28999 - DNA, 1058 bp, Homo sapiens
acaagtttgaaaccagcctgggcaacatagtgaaaccccgtctctataaaaatacaaaaattaggttgggtgtggtggctcacccctgtaatcccagcactttgggaggctgaggtgggcgaatcacaaggtgaggaattcgagaccagcctgaccaacatggtgaaaccccgtctctacaaaaaatacaaaaactagctgggcatgctggcatgcacctgtaatttcagctacttgggaggctgaggcaggagaattacttgaacccggaggcagaggttgcagtgagctgagacagcgccattgcactccagcctgggcgacagagcaagactccatctccataacaacaacaaaaaaaattagctgccatggtggtgcacacccacagtcccagctatttgggaggctgatgtgggaagatggcttgaggccaggaggtggaggttgcagtgaactaaggttgcagtgagcctgggaggcagagtttgcagcactgcacgccagctcggacgacggagccagaccttgtctcaaaaaaaataccccatctctagaaaaaaatttaaaaaattagccaggtgtgttggcgcatgcccatagtcctagctacttgggaggctgaggtgggaggattgctttggccccagaaatttgaggctgaagtaaacagtgatcatgtcactgaattatagcttaggcaacagaataagactgtctcaaaaaaaaaaagagagagaaagagaaaggaaggaagggagggagggagggagggaaggaaggaaggaaggaaggaaaagaaaagaaaaacatccccaaactgcagaaaacccctgtgtgctcttcaatcacttatttttcccctcccccaagtaaatactattctaagcttgatgtttattattctcatgtaattctttataattttattacatccatacgtatggcctaacaagaagtggtattgttttgcatgtttgtacagcttatttatttatttatttatttgagacagagtgagactctcgcccaggctggaggcagtggctctatcttgg

SEQ ID NO: 29000 - DNA, 1032 bp, Homo sapiens
ggctgggaccacaggcacacaccaccacgcctggctaattttttgtatttttcgtagagagggggttttgctgtgttacccaggctgctcttggactcctaagctcgggtgatctatgcacctcggcctcccaaagtgctgggattacaggcgtgagccactgtgcccagccaagacttgtttttttgagggagaattttctgtgattgtcgcaactatttgcaagcagctttcagacatggtgtgtcctgattattccaaatagttgggatagtccagactctcaaaataatttcaccttgcctgtgcttcctggaggtctggagaaaggagacagtaggaggtgacaccctctggctccttccagtctggcgtgtgcctgccctgggaacattgttcagaacatgctggagaagagaatatcacagcctgactgtagacttttggggatgtgttttatttaaatatgtaaaatataatattttggtgtcacttaaaacaccgggacttttggaggcgtagtagaagttctatgtagcttcagaatgacccatcagaaacaaatgtatatgagtctttacttacatttgtgccatattgcttccccctatatttttttccctttggaagctctggcatgggccttgatcctgtgtttaagcgctgtgtgggaagcagaatttaaaaggactgtagtagtatttctaaagagacttaacaggctacatgtgagagaattttagatttcaatttagcaaacgtttgattttctagtctttatggggctgactgtaagcatttgggaaattattgaattattgcttagttctgtataagttgacatgctgaggttttttttttttttttttttttttaactgtttttgtgggacagtggtgattacatgggcattgggactttcaggaatattccagaatctatgatatgttgtatttcacttgtgctagagggttttcaggctgccttttcatggcatgttcactccagaaatgctctaatgcccatcaataa

SEQ ID NO: 29001 - DNA, 1052 bp, Homo sapiens
ggagccaactccccattagattgtaacctccttccgggcagggttggtgtttcaatctatttaacatttttcagctgggtgcggtggcttacacctataataccagctttaggaggctgaggtgggatgatcgcttgaggccaggagtttaagaccagcttgggcgacatagcgagactgttcctacaacaaattttttttaaaaaaattagccaggtatggtggtgcacatctgtagtcttagccacttgggaggctgaggtgataggatcacttgagccctggaggttgaggctgcagtgagctgtggtagtgccactgcattccagcctgggtgacacagcgagacctgtctctacaaaaataaataaataaataaataatttttttttaaatgcagaaaacatttcccagttcaactcaaagagcctctttgtttgaatttggaagagctgtcccttcctgaagatacctgaattctattttctgctcatcggtcataatgtgaatctaggatgagcacagatgtgaacggcacctcctagagttgtgcggtgcataaggccaacgcccagaaggcactcttccatctccctgttggctgacgtggcacctgagttgttcccccttctctaatgcttctccttcagcaattgtgatttgctgcttctgatttctgtagtcctaggaaaccagggaaccatgtttgttagaattatgtgtaaagttaggggacagagacatcaagggggtgtgtaagtagtttagtatgtggctgctttggctgcttttctgctttttgctggctcctctttagagatcagctgactggcgcatggagtcctcaaattttgggggcatgtaataaatgatggatggacctttttttttttttttttttttgagacagagtcttgctctctcactcagactagagtgtgtagtggcacgatctcggctcactgcaacctctgcctcctgggttcaagcgattctcctgcttcagtctcctgagtagccacgattacacgtgcgcaataccacgcctggct

SEQ ID NO: 29002 - DNA, 1051 bp, Homo sapiens
ggtggggctcagtatttgagaaatactgttgatcctagttttctcttagagatatattctgcacagtagtgaattaatggctctgagaaattctgttgaagagcggtctttcactttatttaatctggtacttcccaaatgtacttgatcacagaactttttctcaaaggactcaaggtgctaggggatatggagtggcgggtagccagtattaggttagtttagggtctgcactggttcagttggtgtcctgttagattatgaggatggaaggccaacaccaagttaactaccagctttccacagggccctgggatagagtcatcaccacctagaatgaatggcctgaacacctttgaactgtggtaggactatttcttccatttcagcttagatttgtggtcttctctataattgggtgatggggtatagggagttgtagtataaaagaaccaagaaacagtgcttctctttgaagaatttaatttctactggaatgggaagattcatgaaggagttaaacagtaccaccgtccaagtaggtatgaaataatgtcaagtagcctgtcttgtaggcattttgtagcctgtcttgtaggcaggtgggggccacaggaagcaggggcagcctttattgtgacttgacttaccaaactttgggtactgtgatggcgggcagataagatagaggagtccccccgacccctgcagccctaaatgcctcttcgtttgccccgcctctgtgtgtaatgtactatgtgtgaaagtctcttagactccccgcaaggtagacattttagagttggatgaaatgcatgataagaactccttctggtactttccagatgtatttgatcccagaactcctttttctcaaaggacccaaagtactggggaacatttggttccttctggaaggagaactccctctggctgatctgcaggcccccactgctgggttggcatcctggatttcgaggtggccaccttctgtgactcttaggccttgagcttggctatctggttttggagacctggtgccttggaagtg

SEQ ID NO: 29003 - DNA, 1060 bp, Homo sapiens
cccatataaccttttccttcttagcatttttttcttttcttactcctgagttaaacgtgtagcagaagaggtgtaaagacacagggccagcatgaatagtgctccctttttaaaatgtggaaaccggcttggagaagttaagtgacttatccaaggctgtacatccagtaaggagaaaaactggccttgtgacatagccccagggatgtgctgtgccccgtgatggccccatatgttggtgttgggagttcagtggctcatcaagtgcctgtagctcttaaaggaaaggagttgataaaatgaagcaacctggggcgcttactccaggggccatttctaatctgatttctgtaagtagtggatttttgagagtgggttcttgtatttcctcctggtctgctgtgttcatgggtatttttctggagagatggactctacatcccaaaactggtgaagatcccctgatagaggtgccgctaatgcccctccccatgcagggattgtactggagaagctgtgtctgtggcctgcacccctctggaagctccagtgagtgtcctggggacacattaggaaagtcagatgtgatctaccctcacacccgccagtctcaaacggctttttttccttcttaaaagtaagcaaggaataaactttaaaaatagcaaagggtcagaagttcctttttttttcaagcttttattataggaaatgttacatgtagactccaatagatagaacatgttatgtacacaccgtccctccatatactcaccatcacccaaaatagttgtcaacacctggccccgcttgtttcacttacacccccatgccaccctcatgttattttgaagcaaagccagccatatcatttccctgcccgtaaatatttctaaaatatctataaaagcttctttttaaaaaacatgatctcaaggctgttcccacaaatgttaagctagtgatgtcccctcccaaggggcaaccccacactccctgagagatggtgtatgtgtttcactgctcatgcactggcagccacgtctagaggctgggtctg

SEQ ID NO: 29004 - DNA, 1964 bp, Homo sapiens
acatcaccctgcctggctttttttttttttttaattttattttttaaagtcaataaaataggccaggcatggtggcgcacacctgtaatcccagcactttcggaagctgaggtgggcggatcgcctgaggtcaggagttcgagaccagcctggccagtgaaaccccatctctactaaaaatacagaaattagctgggcatgggcatgcctgtaatcccagctactcgggaggctgaggcaggagaatcgcttgaacctgggaggcggaggttacagtgagccaagattgcaccactgcactccagcttgggcaatgagcgaaactccatctcaaaaaaaaaaaaaaaagaaaagaaaaggtgaataaaacaagtggctgggcgcggtagctcacacctgtaattccaatactttgggaggctgaggcgggaggatcacttgaggtcaggagtttgagaccagcctggtcaacatggtgaaaccctgtctctactaaaaatacaaaaattagctgggtgtgggcacatgcctgtagtcccagctactcaagaggctgaggtgggagaatcacttgaacctgggaggcagaggttgcagtgagctgagatcatttcactgcaacagagtgagacttcatctcaaaaaaaaaaaaaagtgaataaaacaagttacttttcttgagattatcaatgtaaacttgagttttggctgagtaggggcattccattggacttggcaaagtcagcttatctgaaatgttaacgctttcatagaaaggctttagcttttcttgtaaacctgctcaaagcaccgggcgtggtggctcacgcctgtaatcccagcactttgggaggccaaggcaggcgaatcacaaggtcaggagattgagaccatcctggctaacacagtgaaaccctgtctctaccaaaacaaacaaacaaacaaaaaaaacctgctcaaaggatccgggaagcccagaaaaatttgatttatatattaaatgagcatgttttgcaaagttaagatgagctacaacttgttgcacttagaatggctttatatgaactattttcttttgctttgctctgtatcccctccaaaacaaattaatatgtgattctgtgtgtgtttgtatgtgtgtgtaaggtcttttagagtagaagcagcattcatcatcttcgctgttgtgaacaggagctggacaggtctacaagctaacctgattcttagaacagactagattcacagaatagataagctctttatcacatggcagcatattttaattccagcctgtggcttccctccttacgggagctcagatagatttctcttttactgtgtgtgtatgtgtgtctatatgtgtgcatgcatgagtgtgcatctttagaagcatgatctgactttgcattgggctcctatggcttccaggatgccaagagctgtgactttagctacctgggtagtggatctgctgactgtgccttttgtgccagtgttgtgcctgttgtattttgctgtagctatagaaggcagctgcacaggctttaaataatgaagtcaagaccaccatctccagtttgattttgtttagagaccatttttggtacagtttagagccagtggataattgcaagttgattagtgtctcccaaccttctcttttggtctgtatttaatttttgcccaatcttttttaaattttatttttaaagtttttaagcccatagaaaagttgaatgaatagttagttgtgtgtggcaaaatgttaacagttgcttgatttgtgaattctctcttacatacacttagttttgattttttttacccgcgtttttactcactttttaaaaccacctttttaggccagactatttgaaagttgccaacataatggcatttcacaccttagtactccaacatatatacatctgctgagaccaaggatgtactcctaactgctg

SEQ ID NO: 29005 - DNA, 1029 bp, Homo sapiens
ttaaattgagattgactgtgttactgataaatttctgcggagggacattttcttttataataagccccatcccaatctgaaaatccagaagtgtctagatgtccactggccaagggattgaaatcagttggcagatgacaactgagtgtgtgccttttcacgattttcacactttagcagaagccttgttatctgatactgttgggacctgtaggtggttgggtaattgaaaaaggtcagttaaattgaagcagggaatgatttaaaaagaatcatcttaagttttaattaaagcttataaaagggattcaagctcaggcctttgtgaataggaccacagatatgcactccttacattaacctcagccttgatgtatcgtttaaaacatttctctcagtttgagaaaaaatagaaataaaaaacatttaaaaagaaaaaatgaaaatgtacatttctgatgggttttttatttgtttgttttttcaaagcagaacaaatacgtataaacacttgtaaagctatcaggaactatctagaattttgcttttttttgtcttccaaagttgcacttagctctcaggtgcttttttttggtttttgttttttttgtagttatttgccttcatttagtctttctatccaaagtatattcaacttattttcatagaataaaatagtatattttgcattgtttaatattaaaatcagttacataattataggaggtgagtctgcataaacagatctagaaacacatatagctcagctggtgggagcagtggtgtgtggaggtactagagagtagtttcccagccaggagtctgcagtgcatgcaggctgaagttataggtctgctaatagcccctgccatattctgaaattcatggaaagggccccagaggatggttccgatttgagagttggaagattgggttcaagccccggttctgttgctttctccatggttttgggacaagcccatcagtaggcacaagcctcaggttgcttatctgtcaaatgggaatgat

SEQ ID NO: 29006 - DNA, 1091 bp, Homo sapiens
ccacacacacacacacacactcactctctctctctctctctctctctctcccctccctcctccctcctccccctccccctcatctgggtctgaggaagagggctgcagtgattatttcattgtatcatggtgagtggtacctcttttcttatttgggatactcattagagttgctcggtggagatggaatgatggtggggtgcagttaaacatggctgagtgctttctgcttaaggacctgatgtattaatgctctccaggtcattcatatttgggggaaggaacaaagagggtactgctctactgcagatgtgttcatttgcttattaacaaaaggctgggtgacccagaaacttaaaccctgagaacaaaagtactttccagcttccaaatgggaagatcttggagactcttgagtggctcctctggagtgctttctttaccacctagctgtttggagctgtcgtgcctaatagcttctcagcctagagggccccataaaattttagtctgtttctgtatagagtgctttggagtggccgtttctctctgcctcttatttactctcaaataccctttggaaaaagagctgatgaggtgcattgagacttggcatcaaaagccattcattgatagccatcgctcaactctcttggacttaaattttgttaaacaacaatcacaaaaagtcttaaagaattacccctgtttcccctgaatgttgaagtaagaaagaaaagaattactcctgtaatgcaagaagacatactcattaaaatctaaacagcgaaaaagtatatcgattaggttgggcgcggtggctcattcctgtaatcccagcattttgggaggctgaggcaggcagatcacttggggtcaggagttcgagaccagcctggccaacgtggtgaaaccccgtctctactaaaagtacaaatattagccaggtgtggtggcagatgcctgtagtctgagctactccagaggctgaagcacaagaatctcttgaacctgggagatggaggctgcagtgagccgagatagtgccactgcactctagcctgggtgacagagcaagactctgtctcaaa

SEQ ID NO: 29007 - DNA, 1101 bp, Homo sapiens
cttataatatatatatatatatatatatatatatatatatatatatatttttttttttttttttttttttaacaaaaggaaagaaaaaaactcatgccagacttgtttgtctgagatttatcactgtagggatcccagagacccccatggaagctggctttagtggtggctgcggctggggactggacagaacaggtcagtgtgagcttgaactagactgcgcctgcctcctggtgcacgtactgtgtttgggcatgtgttggctcttaaaatgctgttcatccatcaacatactgaccccttttgcaagtttcattgttctattattgtgactataaaagtggcacttgttacaaaaccagtttctgtgatctagaaccgtgttctcaaacttgcatctatcagaatcatctgccccacctctagagtgtctgatcagtagctttggggtggggcctgagaatctgcatttctaacaagttcccagatgctgctgctactgcagctgacctggcaaccaccctttgagaaccactgatctagaaggtacaaggaaatgaacatcgtcttcagtcttaccactcgggagagaaccactgttaacattttagggtataatgaatatattcatacatatgtggacatatttttaaaaacaatgatagttttgtgctgtacatagcgttgctttttaaaaaaacaaccttctttcttttggaatagttttagatttgtggaaaagttgcaaagatagaacagagggctcctgtatacccagcacccagtttctcttactgttaatatcttacactattatggaacatttgtcagaacaaaggagccaacattgatacattactgttaactccacattgttactgcttttattgaaaatacatgaatgtattttcataggattcaaatatcagaaatacataatgacagagtgcctcttcactcctaccatcccacttcctatatatttcagagtattttttatatatttatatacacatgtaattatgcacacacacccatccatcttattttaagacatgcttttttcatttaaatatgtcttgaaagcttttttttttcagt

SEQ ID NO: 29008 - DNA, 1023 bp, Homo sapiens
ttcatttaagaatggttaaaaacacattacatgttaacaaaaataacttttttttttgagatggagtattgctctgtcaccaggttggagtgcagtggcgtgatctcgactcactgcaatctccgcctcctgggtccaagtgattctcctgcctcagcctaccaagtagctgggactacaggcgtgtgccaccacacccagctaatttttgtatttttagtagagacggggtttcaccgtgttggtcaggatggtctcaatctcttgaccttctgatccgcccaccttggcctcccaaagtgctgggattacaggtgtgagccactgcgcctggctacaaataacgttttttatttaaaaaaaaatttttttaaaaaagatgtggtcctgctctgtcgcctagactggagtgcagtggcacaatcatagctccatgcagccttgaattcctgggctcaagtgatcctgctgccttagcctcccaagtagctgggactacaggcatgtgccaccatgcctggctatttaaaaaaaatttttgtagagaccgagtcttgctttgctgcctagggtggtctcgaactcttggcttcaagtgatcctcccaccttggcctcccaaagtgctgggattacaggtgttggcccagcaagcctggcctaaaatatctttttgttttagaaaatatagtgagaaaaatggccttgttttatatatttgcaaatctctttaatgcctggcttagtaagacagttggattcttgcatccacttccgtacctagtctgttgcaatatgctttggttgaagtataactaagaaaatctagccttacacagatatgtagttggaaaagggaggagtattttatagcctgttaagatattagtaattatgagtattctttgatactatatctaaactggacaagaggtagtttctgaaagattagttgcaatgtagaatctgaaaccatgtcaatgaactattcctactgtttcactttgaaatctattggtctctg

SEQ ID NO: 29009 - DNA, 1030 bp, Homo sapiens
aggccaggcccagcctcagaccaggcatgggcgcatctctccagctttctgagcctctctcctgtacttaatgtggagaggctgttgtgggttccttgttcttctaatattttgagcttctgtatcatatttaaaatctttctttgatattctagttcggagagattctagttacagcattgaaaaacaggctctgttacctgtggcagtttaagtcctaagaagttaaaatagaataaaattgacatttcttagagtttgctattaagtaagggtcttggccaggcacggtggctcacacttgtaatcccagcactttgggaggccgtgccgggcagatcacttgaggccaggagtttgaaaccagcctggccaatatggcgaaatcccatctctactaaaaatacaaaattagctgggagtggtggcatgcacctgtagttccatctgcttgggagtctgaggcaggagaattgctggaggtggaggttggagtgtgctgtgatcgcaccactgtactctaggctgggcgacagaggaagaccctgtctccagtcaatcaatcagtcaatcagtcaatcaatgtaagggtcttaaaccatccccaaagcaaaggagtctatgtttatgtcccgggcatcttaaccctccaattcaatcagtgtttattaagcatcttatagagctaagaattttgaaggttgactttaatagctttacctgtggagagtctcatggcagggaacatgagaggtgctggcgtttctagcaaagcctggttggccctgattctgtaactcaaggcagaataaatgccccataaccaccaccccatgttagagaagattcttagggagaggtttggaaaacagcatgggccaggcgtggtggctcacgcctgtaatcctagtactgtgggaggctgaggcgcgccgattgcatgagctcagggatttgagaccagcctgggcaacatggcaaaacaccatctctacaaaaaacacaaaaattagccagtcatggtggtgca

SEQ ID NO: 29010 - DNA, 1066 bp, Homo sapiens
gctcctatgcaagaccctgggactcctgtggcatggaggccaaaggcctggacccaaaagtcaggaggacttctgccacaaaccccaaaagcttgccccgtataaatggttgctcttgtgcccatggctgtgtccacccagcatttttgtgcctgctgggttccaggtgccatgccaagacctggtgaccagaggatgtctgtgatcattgttgtttggaggcttttgattgtgagggacccagacttctgctttgggggtatctttccccagacatcacaaaaagctcaattgtttattgcctcgaagacacattttctcttcaacaagcgctttccttaagtctgaggtagagtagcataagtgggtttcttgaaaaccagaaatgtagctgagaaagcagttgggccattctaggagggaaagaacaagggcttgatgagttaggttaagaagcacattcccagctcaccatctctccctctcttacctccttagcatcttggtctgtggttacgcatcttggctgcacctaagagttggcctgaggagctttcaaacctacaaaggctagatctacctccagcccggttcccattagtcaatctccaggaaggagtctacccctctattttttatttaattttatttatttatttatttatttttgagatgaagtctcactcttgtcccccaggctggagtgcaatggcgcgatcttggctcactgcaacctccgcctcccgggttcaagtgattctcctgcctcagcctcccgagtagttgggattacaggtgcctgccaccatgcccagctaatttttgtatttgtagtagagacggggtttcaccatgttggccaggctggtctcgaactcctgacctcaggttatctgcccgcctcggcctcttgaagtgctgggattacaggcgtgagccaccatgcctggccccctctattatttaataagctcccccaggcattccgacataccactgggctgacagccactgaccaccctctgccagactcatgctgtgtcatcatttcttggcctaaactggg

SEQ ID NO: 29011 - DNA, 1046 bp, Homo sapiens
tagaaggctgggtttgccttctatacatacacacattagaagtgtcttacttccctaacaagattcaggctcctaaaagccaggacatgcatgtatgtatgtatgtatatattttgtggagacagggtcttgctctgtcactcaggctagaatgaagtggtgcaatcacaacccaacctctacctcttgggctcaatcaaacctcctacctcagcctcccgagtagctgagactacagttacgtcctgccacacccagctaatttttctgttattttttagataatggggtcttgctatgttacctagactggtctcgaactccagccatgctatatcttaagtcttgtttttccacagcttctgccttgctgtccccttagctggacatggaattagaaggttctttgggatggaaaggaatccttcccccacctcccccaaaaagaatcccgtcacttctcatttgttcctaaaacattctaatctcatccctctgatcagtagttccccaagtagttgaatcatctgaatcccccagaaagcatacacaactcagtttcctgggcctgactccagccctgctcaatcagtctctgtggtttgagccaggaaacctgctttacaaacttcccaagtggcttttgatgtgtagccaggtctggcagccaactgcttcaaaaccccatttacaattatttttcacagctcccaccaccgacagtgtctccagaggtcttcagcttgtgtcacttattaaaattaaccattttgagactcattcagaaatactcaatatattcttctaactgggtgacatgggaaggaaaaaggaaccgcatgagatggaccaaaggcacttgctttggttgccaatggctctgaaacaggaaatactgaaaccaatacctctgtactgactgggcaggttgttgatgtgtaggttgttttcagtatttgggctggataggaagacaaaagtttgttaagttatcaattatgtattttcccctattataagtcatctgacctcatgattaccataca

SEQ ID NO: 29012 - DNA, 1005 bp, Homo sapiens
ggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggt

SEQ ID NO: 29013 - DNA, 1021 bp, Homo sapiens
tattagatggctgtacatgtgccttagtgtcctaaagttggaggaaaacatggcaaccaagtagttctcttctagactagtagggattgctaaccaatcccatcacagtatgtaaattacttgctgttgttcaatctataaaaattcatcttcaaagaaaattattgggctggtaaaaatatttttaataatgaccacagaagccatatttgtttttctttgatgttcttccgaagacccttctggttctaatcagattgttcccacataaaatacagtggaaatctacaataataaaatccctattcctatgtctatggggaaataaacaggatggggactgtccttttaaggggctttccccttccctttccccagactcaaagcctctattactggtgggtgttttggcatcagttaagggccttcaatccttccctccctccatgttttgctctttcattaaagtgtttctgttgtctaattatatcctttcaatcaaattagagactgtagcatctggtgagggctgtaactgctgccatctgcacctcgtctatacaggccttttcagctgagaatcactcaacttccaaatggcaggaagagatttggaaaaagtttagttggaggggagattaacttaaaaggagtgtcttcaaaggctgggtgcgatgccctgcttgctgtgatgtgtgcatggccaatgcagagcttcactggcctggctcaccaaagattcttccctagcgcttctggcagatgaagggtttttggttgtcttagctgaaatgactaggccttctttgttaggggcttggagggggccaggggctgagctgagaaagtctcccttgagaacaatctttagttatatgaccactggttaatgggtgtgacactttctgtttatttgaccatttcttctaactcagtgatttcaactggaggagattttgcccccaggggacattttgcaatacttggagacattttggctgtcacaactaaagaggtacta

SEQ ID NO: 29014 - DNA, 1026 bp, Homo sapiens
actggtagtcccagctactcgggaggctgagatgggaagatcacttgagctcaggagttcaagactgcagtgagtatgattgtatcactgcactccagcctgggcaacagagtgagaccctgtctctattaaaaaaaaaaaaaaaaattaggccgggtgcggtggctcacgcctgtaatcccagcactttgggaggccgaggcgggcggatcatgaggtcaggagatcgagaccatcctggctaacacagtgaaaccccgtctctactaaaaaaatacaaaaaattagccgggcgtggtggcgggcgcctgtagtcccagctacgcgggaggctgaggcaggagaatggcgtgaacccgggaggcagagcttgcagtgagctgagatcgcgccactgcactccagcctgggcgacagagcgagactccgtctcaaaaaaaaaaaaaaaaaaaaaaaattagcagaggagttacatcatttctgaagaagcagattttacttaggaaaaaaaaaaaaggagctctgcagagccttggaaagagttttttagttttttaagacataggacaagaacttagcatctggtttcttaaagcaaatatcccagatctggtgagagcagtggaatagaaaacataataatagtcagggctgcttcttagtgaattaccagctgaagatttagattcaaactgagcctttactatgatggccgtgccttctgtcttcgataatgatttggttaccaggactagaactcattcaagctaacttgagcaaaagaaatcaatttgaagaccattgggatgtatcacagaacccaaaccctgtatcccaagaaactagaaagaaagcagggactttcactatctgtctctgtggccacttcatctcccttctctgcctctctctcagcttgttatccatccttcttcctcttcgtggaccagcagaattggctcattcatccactcacgtggctcaaacttgagtttggttgcctcaactcctacttgacaaatccct

SEQ ID NO: 29015 - DNA, 1054 bp, Homo sapiens
agccaggcagtgatgatggcctggatgggtcaaagttggagaggagagaagttggggagcgagagctcaggggaagatggcccgcttccatctttcccctgccattcattcctcaagacctactgagaactctctgcacagccccacccctagggccatgacattcacccctcagccacagggactccccccagccatttgggcccaaatgactttgcaagctcagggcttctcgctgcctggggattcagggctcttgaagagaacacggacgtcctcacccatcctcctggagtccccagcaggggaccctgtgtggtacctgagtttcctctctttgggtctgtttcaggaactggtgctcctatgtggtgacccgcaccatctcatgccatgtgcagaatggcacctaccttcagcgagtgctgcagaactgcccctggcccatgagctgtccggggagcaggtaaatgaggtggagaaggaactgatggcattccaggtggaggcacagtttgggcaaaggcctggttgggggactgcatggggagtgtgggggaagactggaccccagggtgggcggagcaaaggtagcatcagccgacaccattctcagcctatcccctgtgctgttgaagcaccctggagggcttcctgagggatggatacaccatttgcctgcattcctttactcagtgagtattcacgctgggctcaggccagcccagcctgcagggtcttcttgtccagctggtatccaatctccaatccctgtggcaaggtggtggggggatggaagggctgaatcccaaaatgcaggagagagcctccaaagggacctggaggcagcagaggatcctggaagctctaggtttgtccccatgggtgtccagggcagtgggagaggtcatggaggaccctgtctcagctgggccacctggggactctttcagctacagaactgtggtgagacccacatacaaggtgatgtacaagatagtgaccgcccgtgagtggaggtgctgccctgggcactcaggagtgagctgcgagg

SEQ ID NO: 29016 - DNA, 1029 bp, Homo sapiens
ggtggtacgcacctgtagtcctagctattcaggaggctgaggcaggggaatcgcttgaacccaggaggcagaggttgcagtgagcagagatcgcgccactgcactccagcctgggcgacggaacgagactctgtctcaaaaaaaaaaaaagaaaagaaaagaaaatagaaaccttcacaatcattgaaaatcattgcaggggagggattttcgggttaggacctagaaatctactcacccaagagacgtgggggaaagacgaggaccctaaaacataccatacccaaaagccccacgacacagggatctggaaaccatcactgacaggggagacatctggaaaatggacagagtggaggcagacactccttcaggagagagagacaactaggaagctctttttggcggtgggggggattgtgactccccctccacatgcagtctggctgggacaccctacttcctggcagtcacaagttagtgaggatgtgggtggcacccagtgcctgccttgccctcttagttcttgattgtggggtcagtgatggatacagccgtgggagccccctaccctgcacgagtcttcccctgtgtctgcccatgacttctggtgccctgctacctctccagttagcctctcctggcccctgctgtcctgaatctcctcctaccccatacccatcctccgtagctccagagtctcttaatactgccagtatggacatgagctgagctgggatcagatagacccatgcaagcctggctctctgcctcccctaggctaattactggcctctcccagaggcccttggtctgggaacacatttaccacccagtccaggaggggtgggagagattgggcagtcctgtcccttcatgagaatccccggcaggatgccctggccaccctagaccagtccttgaacccagaaccacctgtgggctccccgcaagaggtagcagggcccctgcccacccaccttcctgcccctcttctacctgcacttctgcccctgcttgctgcttgcc

SEQ ID NO: 29017 - DNA, 1052 bp, Homo sapiens
cacctggttccaggccttagagacagtgggagaagatgagaaggaagacaggaaaagttctgggcactccagagtttttggagtccagaatccagcaacttaaggacagtttaagaattctccccatctgtggtcaataaacaggtaagtgttggctgttcgtgccgggataccaaagagtggataccaaagagtgccggtagaagagaggactgaaataccacagctaacctcccggtgggaagtggtttcctaggtgccctatccaccctcttctgctctgcaaaagcctgaaaaggcaaaacgtgtgcgttgacatttttgcgtggctggacgtgccttttttcagtcaactttgttcaaaccttgttcaccagtaactaccatgtgctgtactgtattagaattacagttgtggtttctgttgacacaaagtaaacacattaggcctggctgggggggccttcagagagtcacataagtaatctggtccttagtttcctttcctgtaaaatacagaagttaggctagacctcttaagcttttgagcccttctgaccttccagcataagcattccacaaatttgtcctatgctgacttcagctcaggtactgtgaagctcaactcaggtagtgtgaagcagcttccatagtgactgctctaaagtgttaaaccgttgccttgggttaataatagaagttttctctcctcgtatgttatctcatgtagaaaagtacgtaaagcatatatatccagtgcaacaaagaattggaatgcagactcgcagcaatctagaacccccagcgctcaatcacagtgaagtgatttttagtgaagtcagtggctcacttttgggggttaaaaacgaacacggttgctgaataatctgaccagtttgtaattgtattaggttggtgcaaaagtaattacgtttgcatcaacctaatagcttgcttgagggcctgtgatgtttgtgtgctctaggaagataaatgtaagttcatgaaacaaatttgctaccttctatagcccaccagttagtatagggccg

SEQ ID NO: 29018 - DNA, 1602 bp, Homo sapiens
gaaaaaatgatctgcatttagttttaatgtcagagagagtatgacttgtagtgctattgaaaatgcctttaagattgtcatgaacagattatttttttcattataggttagcctttgggcagttgatttgttcctcttggtgattcagggttttgagttaagagtgtgtacaaaggaaagaaagtagtccagtaaagtacagagaggtaggcagataagccaacgtgaagagatggattcagcaaagctctctcaggccgccgagggattgtgaggctggctttggattccatgaagtggatgccatgaagagctgtcaattgttggttttggatgagggactactttctgattggaaaataaaggaccccttttttccgtcctaatggcagtactgtcttcagacagaacaagatatgtgttcttgtggagaagaaagaattgggcagaattttcaaaaataattactttaactgcctttaaaaaaaaactaaatttatctaactttaatgcagtagcgctctgaaaactattttccgtttgtttttactacttgtagacacctcagtggaccagtttttggtccctttggatgcatgttataaatttcataggaaaaggaaaattatagggaggtttacttagataagggatgaaaattcatgtcttttttttaagttgaaatcattttgagttgtatgaaagacaatggtgttaccaaatttttcccagaaagactaaatgctttttcttctttgccagtcttcagggttctgccttagctctgcttcaccagggtttataatatatctagcttttaagttgctgcacaaatatagttctgacacagcaaaccctttaaaacactggagtgtggtgactgccttcttgtctgccattccgtttcactgtcgttgagctagggaatgatggtttgtctaacttgctaaagtgaggggagtgaaaactaatttttgaggagaggtaggttctaacgtaaccaatctagtgttaaactttgtattattgttgcatgcctccgttttatatgagggtagaaacttctgatcctgttagtagatcttgttgtcagtctgtgatattgatgatcatcctgtattttaaatgacagttgggattgggatgggttttgtggtcatgggaacataaaaagtatacctgccaaatcagctgatcttgacctcattagctagtcccacagtcaaatgttgagtttaactggtttagacttttttttctgttagatgttgagaggtaagggggactcatttggacctgtgttggcaggtctccctacagtttaaagaattcttcctgccacgtgaattctttcccccttttttctcttctccttgtttctgctaactttacactatttttcctccttgttttcctctagattacagtacctatagccaagctgcagcgcagcaggggtaagtcagtcttttataaccgtattttgtgtgtgattaatattttttgaatatggagccttctataattgtagaggtggtatttgaatgttctctattcaagttattgcatttaattcttttgcagctacagtgcttacaccgc

SEQ ID NO: 29019 - DNA, 1047 bp, Homo sapiens
ggttatttattaacccagtgtctattgctgtaatctttagcatgacaaggccctaactgttgctgcatagttttatgacatgagttattgccctgatcacttttagttttttgtttttttaattgccctccttgtaaatcttatagacgtgtcatgtagtggggtgtaatcggtatatgaacggtagggtagatggtattagattctaatttaaataaatgaatgccttatgtggttgaccttaggactctgcaaaaacttaagcagttcagatgaacaacatgccaactcaaaaacttttattgcttggggcttcctgttttctggaactatgtatactttcatacacattttaactcagcagttttgacaaggacattactatctctgtgtataatttcagaatttccttttaatatttgaggtagagaagaaagagtattattatattctgtgctacaaatggtgattgtacaaaaggaagctgatacttgtttctggccagtacatgaggacactttaaggccctaaatcttaactaaaatgggcagtcttgattcaggatttattttaaatatggaagctttttctttagtgagatgtagactttttttttggatataaatgccagcacctagaccaaagttttgttttgttttgtttttttaagatagggtctctgttgcctaggctggatcttactgcagccttgacctcccagcctcaagcagtccacccacctcagcctcccaagtagctgggactgaaggctcacgccaccatgcccagctaagtttgtttattttttgtagaggcgaggtctcactatattgcccagggtggtctctaactcctaaactcaagcagtcctcccacctcagcctcccaaagtgtaaaccaaactttttattgcatggcttaattgtacccattgaccatgaggaagaagagtccagcaccaggaatggttgtaacacctcctacaggaaaggtactctagttaggagctgcagactttcgtggttttggtcatgctccacgccgaag

SEQ ID NO: 29020 - DNA, 1031 bp, Homo sapiens
tctgcctcctgggttcaagcgattctcctgcctcagcctccctagtagctgggattagatacagacgccaccacaaccggctaattttgtatttttagtagagacggggtttctccatgttggtcaggctggtcttgaactcccatcctcaggtgatccgcctgcctcggcctcccaaagtgctgggaatacaggcatgagccactgcgcctggcccagtttttgtatttttagtagatacagggtttcacaatgttggccaggctggtcttgaactcctggcctcaagtgatccgcccaccttggcctcccaaagtgctgggattatgggattacaggtgtgagccaccatgcccagcctgcaagttttcttaacccatgtttaattagatgtgggttttcaaattgtttgaattgtgccctgaaagttttgctagaagtagcggttcccttttttgcactcatttcattgttttgcagcagatgtgaacaggtttaggaacaagtagaattgattgggtgtctctccatacagccagcttggagcaaaagtgggtagggcttacaacccttcttccacagagcaggttcgtacctattgcattgagagcagttaatagcagttaatctggcaagttggataggtacacagtgagagattattgaattcatacagcaatggtgagggatgtggtgtgttagaagctttgtttgtttgtttatttttggagaccgggtctcactctgttgtccaggctggggtacagtgacacagtcgtagccccctgtagcctcgaacttcctggcctagtttaatcggactttaaaatatgtgtccttactgtttctcatcatgatttgtaaagcttaataccagatgggtttttttgtttttgtgtgtgttttgttttgtttttttgagacggagtttcactcctgttacctaggctggagtgcaatggtgcgatcttggctcaccgcaaccctcgcctcccaggttaaagtgattctcctacgtcagcctcccaagt

SEQ ID NO: 29021 - DNA, 1038 bp, Homo sapiens
gcactttgggaggccgaggtgggcggatcatgaggtcaggagatggagaccatcctggctaacaagatgaaaccctgtctctactaaaaacaaaaaaactagccaggcgtggtggtgggcacctgtagtcccagctactcgggaggctgcggcaggagaatggcatgaacccgggaggcagagcttgcagtgaccggagatcacgccactgcattccagcctaggcaacagagcaacactctgtctcaaaaaaaaaaaaaaaaaaaaaaaaaatttttttgttttaccctcccatttaatgttttattctgaacacaaaagtatttgctgagttgaaattcaaattgttgatgtgtagaaagtaactactgttttatggatgtctgtgtcacatggtgtgaatgtctcttttattcaggggatttgaaataacaagcctctttctaaaaaagcttttttttttttctcttctctctctttcagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagtgagttgctaagagagaaaaccaaataagaatgaatgtgtttagagtttttttgtggggttgattttttttgttggtttgtttttcttttgagatggagtttcactcttggggctgaggctggagtacagtggtgccatctcagctcactgcagcctccgcctcctggttcaagcaattctcctgccccagcctcccgagtagctgagatgataggcgcctgccactatgcccagctattttttgtatttttcgtagagacggggtttcaccatgttggtcaggctggtctcgaactcctgacctcaggtgatcctcccgcctcagccacccagagtgttgg

SEQ ID NO: 29022 - DNA, 2942 bp, Homo sapiens
cagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggtaagagcaaaccttttctccttttacctaattttgtttcatccataggattttcagtggaaagaagggactgaaagacataagaaattaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtatatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaacagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaaatactccagaagttataatcctactaattgtgctagactttgctagtagagggggcccctctttctggatgagaagtctctcttgcagccatagaagagaccatggctttccccataggtttttcaacagactgtgaagcagtctgtcggatcctgtggggatagacgggcatttccctcgttgcccccctttttattgtggtgtggtgatggttttcagtgtcttgtacaggtaaggcactcaatgttgttaacatgccctttttcattgcctcagtattttgatattttcattggctgttaaacgtggaaactttttaacatgctttgtcgcatttatatgctacaggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcagttaacccccacttgctcctcccctctataccaagctcttctggtttttcacctgacggggtgggtgtttgggatctattttttcttgctaatttgccaagtattgcactattaataccagcccccgaaatgaaaggaaccaaccacactggtgtgtacaatcagacaagcaaggttgtatattgaggaaatttgagcaagctgccctgaagaaaggcatagtgacaagatgagagagatgcattgtttggagatgtgtttagccagtgcccttcttccccacgagcccccccaaggctcagagcggtactggcttttaaagggaaaggccttcatttcttcgtttatccccccagcagcgctg

SEQ ID NO: 29023 - DNA, 1031 bp, Homo sapiens
aaatggtggtatagtagatagctatgtgtgtttgtaaggtttgtagcttgcaagacgtgcactaataatattttatatgatctttcctggttggcaggacccatggatgaaggaccagatcttgatctaggtaattttgaattctagttgtgcttcatatcgtgctttgtaaattaatggtacagaggtaaatgcatgcgtagagttcagcagccttatagaccagtgtgatattcttgctgtcaaggacagtttgggaaatcctatgtgagcatctactcataattgccttaagtgaagtaaaccaaaagtttgatagcattcttcttagtatgcttggtagttttcttagatttatgatgaatatccttgggcagtagtgatcaggtagttaagaaacccctatagatacatgataataattctcctgtcttgttgtctctgaaaggcccacctgtagatccagatgaagactctgacaacagtgcaatttatgtacaaggattaaatgacagtgtgactctagatgatctggcagacttctttaagcagtgtggggttgttaaggtcagtaaaagcataaccaggtcatctggcagaactttaaaccacagagcattttaaagagattgaattgatgttgagagttgttttctaaggttgcctttgcctgacttctttctaggtatcttatggtttgttcctttttaaaaaagattagcctttttttttttttttttttgagacggagtttccttcttggtgcccaggctggagtgcaatggcgcaagtcttggctcactgcaacctctgttcaagcgaatctcctgcctcagcctcccaagtagctgggattacaggtgtgcgccaccagctaattgtgtctttttagtaaagatggggtttcaccgtgttgggcaggcgggtctcaaactcctgacctcaggtgatctgcccaccttggcgcctcccaaagtgctgggattacaggtgtgatcccctacgcccggccttccctcctccacccctag

SEQ ID NO: 29024 - DNA, 1096 bp, Homo sapiens
tagctcacgcctgtaatcctagcactttgggaggccgaggcgggtggatcacgaggtcaggagatcgagaccatcctggctaacacgatgaaaccccgtctctactataaatacaaaaaattagccaggcttggtggcgggcacctgtagtcccagctactcggaggctgaggcgggagaatggcatgaacctgggaggcggagcttgcagtgagctgagatggcgccactgcattccagcctgggtgactgagtgagactccgcctcaaaaaaaaaaaaaaaatacagttgattttgggcgggcgtggtggctcatgcctgtaatcccggcactatgggaggccgaggtgggtggatcacgaagtcaagagatcgagaccatcctggccaacgtggtgaaaccccgtatctactaaaaatacagaaattagccgggtgtggtgacacgcgcctgtagttgagctacttgggagtctgaggcaggagaatcagttgatcccaggatgcagaggttgcagtgagctgagatggcgccactgcactccagcctggcgacagagcaagactccatctcaaaaaaaaaaaggaaatacagttgattttggtaaatcttatataaggtgatttctccctgcttgtaggtgtgtgtgtgcacagatatcacacacacctcaaaagtaaaatgcttttagtgtctactgtcacattctaccctgtgcaagactccttgtttgcttttttgttttgagatggagtcttgctctgttgcccagactggagtgcagtggcacaatttcagctcactgcaacctccgcctcctgggttcaagcctcaagcctcttgagtagctgggagtacaggcttgagcatattaaaaagactgctttttaatatgtatataacatgtagtttattgaggaatgtggagtttatcctggttaagaaagtagtatttaccatcaaaattttggaaataaagatgttaaaatagatttccaagctggatacagtggctcacatgtgtaatcccagcactttgggaggccaaggcaggaggatcccaaggattgcttgagcccaggagtttgagacca

SEQ ID NO: 29025 - DNA, 1048 bp, Homo sapiens
agaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataagtaagtgctggtgaaaagcagctgtgggccgccaggcacagtaagaggacagcccttcccagcttggttggcgcaagtcctcatgtctctaggaagcttgtgatagtggttgggaggagccaggaaggggcacctgggggctctggaagggcttcctcaccccttcccattctaaccgattgggaggagccaggaaggggcacctgggggctctggaagggcttcctcaccccttcccattctaaccgaagggccctctttaccttgcagaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtattt

SEQ ID NO: 29026 - DNA, 1031 bp, Homo sapiens
ccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaccggccggcagccccgactgctgcggtgacagtcgaggtggaagctcgagaggttctctttatatcatcttatgggtgtagctagagacgggcagaaccggaagggccaactaggcccaaaacctcatgttaaagatgattgctgctttttttcataggacttttgggttttggcatttcctgaaggttattttcattcattgttattggaagaagctggatgctcctgtgatagaaaattcaggatttcagtgtcaggcttaagttaggcttacgcttaaaagcttgaaagtttattctttcattaggtaatattgttatgtacccaggtattagaagttgcgtcttgtttattggaaagccaatacttgtttcccttttctaaagcttgcatattctgggaaaaaaaaccctttgaagaacgatataacatctcatacttactttccacatagtttccaacatgatgataacagctatcaattgttcagtattttcaaagtgctagacatttgcacatttaatcctcagaacaaacccatttatctagtaaatggcaaggtggggttttgaaccaagctcacagcccgtacagtactgcttctc

SEQ ID NO: 29027 - DNA, 1015 bp, Homo sapiens
catttccagaaccttccaggtaaagaaagtacacaaaggaaaagcaagaacttaaataaaattccaacacccaaatctgtttgagggtagaagataacataccacacactcttgttgaattacttgagatgagtttactgtttaccaagggcaaggtgggaaactaaggccaagaaactccgtgatgagtctgttctctgactatcttttgatggggatgggaaattctgcttgacctcagtgtgtttaatagactcagggccgggcagagctttgctggtgtctgctgtggcttttgtcttctggcagcgacgtggctctagaggaatggcagggtcagaatgcttgatttggtgcccacccgctctccacccatctcacttagctccaatgacagtgtcttccgttctccccacagggatgaagctgaaatggaatatctgaagatagctcaggacctggagatgtacggtgtgaactactttgcaatccgggtgtgttgaaacctctctgagctccttgtgtagtagacagagactgagtgagggccagactgctaaaatggttacttcttcattccaaggcgatagactcttttatggttctgtggtaaagaaggaaagaggaaggaaagagaggtcttagtgcctaactttctatttttggacttcaattagatcataggtaattaagtgtcacttgagccttgggggacttggacctggttctgctctcagcagaaacctgtttgaatgctctgagtgtaagatttgattatttctggctctgtgagatctccgtccacagggagcacttgtaagtacttctccccccaacacacaccccacccccatccccacccccacccccaccccaggcactagtagagtagatctgcctttatagattactgatttgtttgggattctcactatgaggctaattggttttctattcagactattaatagtctgctgtctgctgggaacccactgcttctgcagggagaggcatt

SEQ ID NO: 29028 - DNA, 1050 bp, Homo sapiens
cccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcct

SEQ ID NO: 29029 - DNA, 1025 bp, Homo sapiens
tgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgc

SEQ ID NO: 29030 - DNA, 1023 bp, Homo sapiens
catcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggc

SEQ ID NO: 29031 - DNA, 1034 bp, Homo sapiens
taaaataaaaataaagtatacaatgtaatgattttgggcatgttcagagttgcatggtcataactgctatttaatttcagaatccctaacagagacctcatgccctgtagcagttattccactttcccactcctctttagaccttcgcaactgctagttgattttctctttcaatgcatttacctattttgatattttatttaaatagaaccgtacatgtggccttttgtgctggctgctttcatttagcatgaaagcattttcattttcatctgtgttgtagcacattatcagtacttaattccttttaatggctgaataatactccattgtgtgtatggatataccacattttgttcatccgtcagtgatcatttgggtttttattattttactattgtgaatactggtgcttttaatctttatgtacagatttttgtggggacacacgttttcagttttcttgggtatatacctaggagtgaaatggctgaatcatttggtaactgtatgtttaactttttgaagaactaccacactgtttcccacagtggagctataccatgtcacattcctatcagcaattattaggattttaatttctccacattcttgattacatttgtgattatctgcccttttgattttagtcatgctagtgggtttaaagtggtatctcattgtggctttgatttgtaattccttgatgcctaatgatgctgggcatcttttgtgtacttattggtcatttgtgtatcttctttggaaaaatgtttatttagattctttgcctatttttaatttggaacttaaattattgtcatgggagttctttatgtattctggatagaagttccttatccttgggttgtcctgattgtgccctttaaagcacaaaaatgtttaattttgatgaaatcccatttatttcatttttctttagccactaaatgcttttggttttatatctcagaaaccattgcctaatctaaggttatgaagatttactcctgtgttttcatatagaagtttaa

SEQ ID NO: 29032 - DNA, 1044 bp, Homo sapiens
caaagcagttataaatattgaagtacctctggcacttagataaaatgattctgcgtggctttaaactcagttaatttctaatgcttgaatgtctggattttctatgatttctgaacaactcagatttaagtatgtcttttgttttctgtgaaattataagggttttttccttaggagatagggaacatttctgttttttatttttttatttatttttttattttttgagatggaatttcactctgtcgcccaggctggagtgcagtggcgtgatctcagctcactgcaacctccgcctcctgggttcaagcaattctgctgcctcagcctcctgagtagctgggattacagatgcacaccaccatgcccagataatttttgtatttttagtagagacggggtttcaccatgttagtcaggccggtctcaaactcctcaccgcgtgatctgcccatctcagcctcccagagtactgggattataggcatgggccaccaccacgactggctgggaacatttctttcagatggtaaacctaaatgctgccttataaaattagattttaaactcttaatttctatagtaaaataatgcctaccttgtgatatttcatagaggacatagattcagaaaataactttacagattacttacagaacttccttaccatcttgttaatgatatatcagtatatctgagttaaaagtataaagtgggccgggcgcagtggcttacgcctgtaatcctagcacgttgggaggccgaggcaggtggatcacgaggtcaagagatggagaccatcctggcccacgtggtgaaaccccgtctctactgaaaatacaaaaattagctgggcgtggtggcatgagcttgtaatctcagctacttgggaggctgaggcaggagaattgcttgaacccaggaggcagaggttgcagtgagccaagatcgcgccattgcactccagcctggccatagagtgagactcagtctcaaaaaaaaagtataaagtgaatgtgttctgcatgtagaagggaatataag

SEQ ID NO: 29033 - DNA, 1049 bp, Homo sapiens
tcagggctgcctcctcttccctgttgagatgtataaagcaataaggtgcatgtgaaatgcaaccagcctgttgtctaaaaatgttagtgtgtaattactttgcttttcatttctcacatttttgggtttacatctggaaacgccactaaatgaagacgagtgatttttaagcattaatcactaatctactgtttcagattctgtctattgcagaacttcttttgaagaatgtatttagaacctttcccacattaaaaaggtcaatttatgtaaatgaagaataaacaacatactctgtacctcgtatgtagttacatacttacacatgattgatcttttggtcattatctattgaaacagagttttcacttgttaatagtggaaattatcttaagtgttgctggttcaagtgatttattacaagtaaaggttttttttttttttttttgagacagtctctcactctatcaagtggagtgtcgtgtagtggctcgatcatggctcactgcaacctctgcctcctgggctgaagtaatccgcccacctcagcctcctagtagctgggactacaagcatgtgccaccacgcccagctaatttttgtgggtttttttgtagatgatggtttcatcatgttgccgaggctggtctcgaactcctaggctgaagccatctacccgccttgagtaaaggttttttgatacaagaaatgattataacttggagttcagcttggattctgacaacttactagatttttttccccctcgggagaggatggttgtttcttgcttaggaaatgataatattttagcagcttatctgtgccccacagctggcagagtaatgcagtatgctgatcatgaagttgcatctggaaccctgaaaacttccagaccttaatgtttccaaagagatagaaaagacacatagcttctggtgtgtgtgtgtgtttttttttttaaaatcatgttagttggaggtctcattgaaccaggacaatgacagaattttatatttatatttgttttatctttttcaatgcatggt

SEQ ID NO: 29034 - DNA, 1077 bp, Homo sapiens
cactaatctgctttctaagattttcctgttctggacatttcatataaatgatatcataacaatatgtggtcttttgtgactcgcttcatcatttagcataatgtttttaaggttcattcacgttgaagcatgtatcagtacttcattcctttctctcttttttcttttttttttttttttgagacagggtctcactctgttgcctaggcttctggtgtgccgtggcatgaagatctgggctcactgaaacctcgccactgcatcctgggctcaagtgatcctcccactttcagcctcccgagtagctgggactacaggcacatgccagcacgtccagctagtttttgtattttttatctttttttcttttattattattttatagagatggtgttttgccatgttgcccgggctggtcccgaactcctggccttgagtgatccacctccctggacttcccaaagtgctgggattacaggcatgagccaccatgcctggctcaatttttgtgttttttgtagaggtggggtttcaccatattgcccaggctggtctcaaacacctgggtaaaagcagtgtgctgactacatcttttcaaagtgttgggattataggcatgagccactgtgtctggccacttaattcctttttttttttttttttgagatgagtcttgctctgtcaccaggctggagggcaatggtgcgatctcggctcactgcaacctctgtctctcgggttcaagtgattctcctgcgtcagcctcccaagtagctgggactataggcatgcactgccatgcccagctaatttttgtacttttagtagagatggggtttcaccgttggccgggatggtctcgatctcttgaccttgtgatctgccctcttcagcctcccaaaatgctgggattacaggtgtgagccactgtgcccagcccacttaattcctttctatggccaaataatttgccattgtttagatatgccacattctgtttattcatccatctgttgatggacatttggtttcagtgagcctagatcttcacgccactgcacaccagtagcctgggtg

SEQ ID NO: 29035 - DNA, 1030 bp, Homo sapiens
ttggttttaattaaaaacaaaccaaaaaaaaaaaaaaaaaaacacctcgaggacatccagtcaacctgtttcttttgtcattacctcatgttgttgagcagtggcggtgtatatagcattactcatcaaatattagcataccagacaaccacatacttataagtcatctttaggatgagacaacacttgggatatttcaaagtcatgcctttttataatctgccccagtacatgatatcacaagtgtagactctgaggggtggaagttagtttaatcttatagcagttaataaagccttttatggagtcttctctacctagcctgctagaagtagaatgtatcagagaggagagaaatgagaaaattacataattgtcttagtattcatataaatcttagtttctggctgttgaaccggtcatagttaagccggctgtactgtggtcacagctctaaggcttaatcagctttggaagaagtttcaacattgctgttggagtttacctgtgaaacctgcagaagcctttgccaaattcttgacccttctcttagcccctcaaactctaaaaaagtggactgaaagctaaaagcttctctcccatgtccttaacttcctgctcctcattgcaattgacttgttggtgatggctctgtactagagtgttaatctggaggcctgacagatgactgggcagcttagctgccagtttagtagcatcaggcctacctctctaacctctctcatgtgaaatgtcccttaagcccatcttgtttatccacgactagcatatgactctgggtcttaacactgctgtgaagctgcctatttatctgtcttccgggtttgaatgcagtccaggaagttgcatctagaggatttactgtgacctttgtacatagaaaagcataattcctttctccgtatttgaaaatctgctaagaggtagttcttaccttctctgactctggtattggtctgcttcctcacctgccaggtaaaggcctgtcccttctgtcccaggcctttta

SEQ ID NO: 29036 - DNA, 1060 bp, Homo sapiens
tttgggaggccgaggcgggcagatcacatgaggccaggagttcgagaccagcctggcccatgtggtaaaaccccatctctactgaaagtgcaaaaattagccagtcatggtggcatgcacctgtaatcccagctatttgggtggctgaggcacaagaatcacttgaacctgggaggcggaagtttcagtgagctgagatcacaccactgcactccggcctatgtgacagagtggaatcctgtctcaaaaaatatatatatatttacatatatgtaacatatgtatatttctttgtttttattccacctgttttgcaaaatggtattcatttcttcctttctgctgtttatctttggcctctaggggagcatgtaacttcaaggtttaaaaacgaggtggagaggatgggttttgatatgaacaacgcctggaggatttccaacatcaatgagaagtacaagtgagttatatgggtccctgtggactgtttcacagccagtgcctttgcagaaaccgcaattctcatgtggcagaacatttgaacttagactttttatttgaaatggttttatttattaaatctaaaggcatgatcttcagagtatttattgaatcttctgttcccgttgctatcattggagtggaaagtgatccttacttaacaggatcctagaaccttcccttttaccccctctaggcctctgttttttctggtacatgcatgtctaaataatattgtatttgcctgtaggcaggcagttaccatttttctcatcaccacttggcatcacattagagagaggatcagtggtctcataagcagtgacagaacatttatgaactagtttttatgactgtaattttactccaggtggtgtgaaatagacataagtacagttgagtatcccttatctgaaattcttgggactgtaaatatttcagattttggatttttttcaggttttggaatatttgcatgaacataatgagattatcttgggcctgggacccaagtctaaacacaaaattatttgtctcatatacacattatacagctgga

SEQ ID NO: 29037 - DNA, 1055 bp, Homo sapiens
ggttaatagcttagtcacattactaacctggttcaatgggactgaggctgtgtatgcagatagactggcttgtgttggttttgcatacccatggctgcacctgttacctataaggatgacaccctgtttggttcaaatcaaagaatgagttaatcctgtgaagtctctggaaacttgcaattgtgggcttttttccttccctgagggtctggtagaactgacacggactctcagttctgtaattggactgggcgctcatgtagttagaaataacctatgtacttgttacagcagaagagttgtaatggagtataaagagctgaccctcgactcccctttttttcattgatagttaagattgccagattcccaaaaggtagcatcaagtggaacaattcaagatagtatcatttgttgtatacacataagtaaacatttaaggcaacaaaacaaaacaaaacacacttatggtaacccattctgttgaggagtccaaaactcgaataaagcgcctcattgcctttaactggttctgtggcagtgagatcatcatccttatgctggctcacctagtgtctctctctctctcccgttttctctctccctctcttatccccttgactctccccacttctcatcttctctttagattatgtggtagctatcctcaagagctcatagtgcctgcctggatcactgacaaagaactggaaagtgtatcaagtttcaggtcctggaagcgcatccctgccgtcatctacaggtaagttaaactggaccagtcccagcttgggctggtgctgctgcctgctgcatatggtctgctgcctctgctgctgctaacctgggaagggtggggagagttcagagaactttctaggcaaggctgtacttccttattgttaaagcttctcctccagtaacacatcagtactgactgcattcagaacactagctggttgttcatttgaaacagataagaaagttttagttgtaaagtggctggacttgctatttcaatatccttcttacattctgtgagaagataatgtgct

SEQ ID NO: 29038 - DNA, 1049 bp, Homo sapiens
gaggaggaggaggctactgcatggcttactgggttccccgtcctgacagagtaaattgaagtgttctcagggatgttaggataaggtggctcagctgagctgacttatcagagtgtgcatgcctgattgcttaatttgtgcttcattggacttccataggtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtatgtatccttcagcctttccactgtggtcagcagaaggaatttggggttggttacatatgagagcctttttgagtagtgactgtttttgtgaagacatctctactgtctctggatggactggttccatttttcccccatgattctgtcctgaggaaggcctgcttctgatggtgctctgatctgtttctgatgactacttgctgagggtggtttggtttaacacagatctctactttgccaccctagacatgaatcttttttggcactgcctccagagcttatttctagcatattctgtcttacgggagaggcacttaagttgcttcctgatgcactgatagctcagaatgagctgccaccaggcccccagcaccctcccagtgtcaataagcaatgatacccaccaaagcttctgtctcagaacagtaaactgtgtttgacattggtatgtgtgtctgtctgattctctgctcacatgaagagctggcaggccctttaagactttgttccccgaaggaatgaataccttctgttaagcagagaaaaggaggcacatagacctatgtgtcagtttcatagtaatactagctttgtcagaatgcatcttagaccctaaagaagtcaaaaggaggctaatcagagttcatactgatttcctggactattaatatggttctcattacatttaagtaatcacagaaaagatttaagctgac

SEQ ID NO: 29039 - DNA, 1029 bp, Homo sapiens
ggtaactgactcaccacctttagtgagttgtcttggttttgttttttaaaaatactctgcaacaaagctttacttgtttttgttgtctgttacagagtaaaccgtggtgtagattcttctgccagaaattctcacacttttggagttagagaacagaaatggttcagtaagtgacaaaatgacagccagaatagatggtctagggctttgtcccacatccaccatggccttagcctttttctttcaaccttgtttggctggctccttcctctatccctaaagctgtccagtcctccagcctgcaaagcaaattctttcaagtcagagcaaattctttcaagtctctgcctccagcaagtatcctgtcttgctccttcccttcactgtgaaacgaatagaaagagtggccagctctatatcgtctttgctccaccaccccttcctcttcctcctgcttctgctgccccccaccaccccaacactgggtgtccccaaggactagccacacactctagacccactccaaagcattctttcttgcaaccattctgcaacctgccaccttgctaaccctcctgccagttcttctgcctctgtagttggcctgtgagactttgcaggcagccctctcacctacttccttggcattactgctctgaggctcagctctctgccctccttccacgcatgcttccttggacatgcagaaattaaagtgctgaaaatggaggcctgttatataccacagttctaagtctctagaggcctccttcaggcacctggggagactgcgagagcatcaggtgtccccatctggacgtgtctatgtggccatgcttcacctgcacccccacgcagttcgatggcattaacctggggactagttctgggcctgaaaactgagctcagccttgtcagccagagatgcctcggggcttcccctgaactgagaggccacgacgtctgctcttcgcttttatcctctgttgcaggatgcagtcagcacctagtgcaggggtgaacgccgat

SEQ ID NO: 29040 - DNA, 1043 bp, Homo sapiens
ggggcaggctggctggttgtgagggaggaggaaggcatgagccatggacatgcttctgtcttcagagaacacctgagagagcaaagcacagctgggctgggagggcggacgggggatttgctttagatttgacagcaacattggtgatacaggtggcattccaggcaggttgggggtggtttactcattgtcagcagcaatggaagtcacagtccgcctgccagaatgagcatgtgtagtggcaaggtcaaagagtagggccggagccgtggggcagaaggtagaagacaacctggggcagtagtgtcttccggcctttgtgtgtgagaatcagtggtatgtattccagttctttggcttttccagaacccagaaaagaatggagtaactgaactgtgatttaaaatcttgctgtgtggcttgggttgtttgtgttggttccaaaccctgaatcttttggggtcttcaatttgtgggcatgtcagtggaaattctaagctttgttttaatggtgtgtgtgtgtctgtctgtctctgtgtgagtgtgtttagaaattggcttctctgggttcctcgctcgtcttctggaaggtggggttatagacatgctggtgaattctgaatgttttataaattagactattaacggagttaaattgaagaaaccttctgtcataagaccttccaggaattccattccaaatgaggaaatgcataaagacttgtccacttggcaaacattgggtgtttgggaggtgattgtgtaccctgtccccacatttaatacctgcaaccattgcaacaggaagcccatgtaacctggtgctcgtgattactgatttgtttcttgtcattgagttttgacagtatgttacttaataaaaaagagaagaaagaaaaataagctcttggaagtaattttcaagtagaggtagtggttttgtttatttttttaaggtaccatatgtggcatgtgcttcctttctttgatgtgaaatctgaaggaacccttgcctccttcctagcacacttcctaaatgataa

SEQ ID NO: 29041 - DNA, 1035 bp, Homo sapiens
ctcaggagtttgaggctgcagtgaactatgaatgcagccaactatgaacaatgcaatgaaccatcgcacttcagtctgggcgacagagcaaggccctgtctcaaaaacaaaacaaaacaaaccctctattactaacaacttaacaatcattgagccttcagccagttttttttcttggtggagggccttgccttgatgttgatggctggtgactgatcagcgtggtgattgctgaaggttggggtggttgcagcaatttctgaaaataagacaacactgaagtttgccacatcagtcaactctccctttcacaaacgatttctctgtgccatgtttgatagcattttatcctcagtagaacttctttcaaaattggaatcaatcctctcaaaccctgccactgctttttcaactaagttgatgtaatattctgaatcctttgttatcatttcaacagtgttcacagcatcttcaccaggattagatttcatctcaagaaaccactctgctcatccgtaagaagcaactctttattcgttcaagttttgtcatgagatttcagcaattcagttcgttctttctttctttctttctttttttgaaggagtctggctctgtcatccagccaggctggagtgcagtgacgcaatctcggctcactgcaacctccatctcctgggttcaagcgattctcctgcctcagcttcctgagcagctgggattacaggagtgtgccaccacacctggctaatttttatttttatttttagtagagacgaggtttcaccacgttggccaggctggtctcaaactccttacctcaagtgatccacccacctcagcctcccaaagtgctgggattacaggtgtgagccaccgcacccggcctgcaattcagttatatcttgaggctccacttctaattctgattctcttgctatttctactacatttgcagttacttcctccactgaagtcttgaacccctcaaagtcatcctggagggttggaatcaacttcttccaaacttctgtt

SEQ ID NO: 29042 - DNA, 1034 bp, Homo sapiens
tggctcactacagccttcacctccctgggctcaggtgatcctcccacctcagcctcctgggtagctgggaccatcagcatatgccactatgcccggctaatttttctattttttgtagaagacagacttttgtcatgttgcccaggctcttttggcagagtttggacagaaggtggcattgggctggccctcaaaggggtgggtggggcaggacctctggtgggggcagatatgagaaggttccatgcagtggggacatggcgggaaaggccccaaacaggagcgctcaggcctttgcagggaacaggggacagattggtgtggctgggggatgggcatgagcagagagcaaagtgaggttgactggacgggggtgattggcttggggtaggcctgcgatgctgagaaaggagcccaggctccattctgggggcctctgtgcccagagagcagtctccacctctccacccagcagagcccatccttccctgcacaccacaatgtagggagctggcgccctgcatgcaggtgggtgcctgtaggcctgccgcctccaaagcccagtcccggccctgccattcaatctgggctctctttacagtccttcccactgactcaggtgggcccttgcccaccccaccctgggaaggctgggccaggatggggcaggcacctcaccccggccaggaacaggaacgggcaccatctcggggactgatgttttttgaatggcgctatccaccctgccctgctcggcctggctgtgcaggcctcttggtaccacgtctgttcgtaatgaccgtaacaactctattttcttccacagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaa

SEQ ID NO: 29043 - DNA, 1028 bp, Homo sapiens
aaaaaaaaaaaaacgaaaaaaaaaaaaccaaaaaaaaaaaacagagggtcccacggcagtactggtggccatggttcccgtagccagaaggagtcgctcacagagccccacacacagcatatgtagggaatctaccttttaatatggttcagggcgacatagatgctatctttaaggatctcagcataaggagtgtacgggtagtcagagacaaagacacagataaatttaaaggattctgctatatagaattcgatgaagtggattcccttaaggaagcttgacatacgatggtgcactgttgggcaatcagtcacttcatgtggacattgcagaaggcagaaaacaagataaaggtggctttggattcagaaaaggtgtaccagatgacgaagcttcagggatgacttcttaggaggcaggggaggtagtcacccaggtgactgggaaacaggcccccaactgggcagccacttcagagatggtcctcccttccacgatccaacatggatttcaaagaaccgacagaggagggaagagcacaaagaccacgactccagcttaaacctcgaatgttgtgacgcccctcaatgaagtagccgatcccaactctgctatcttcaggggtgccagacccagagtggaattcgttcacaaggagcaagaatgagcctgcggttgggagggaatggaacatggggggttggagcaggaccacagcctggtgaacccctgggccatgttcctgcagcttccactcccatacctgccactggcctccccacagtggaaacacagcttgttgtgagtgcatgccagctgtcaacaagtggtttttagtacattctgggctttgctgtatctatctagtgcctgtttgtgcgtttttttctttctaccactgcttccccattttccttctgtccttttcctcccagctcgttttcctagcagcacatggggttccccagaggatcggaggtggccatgtgggggagtcgtttgggctgcggtactgcatcattttt

SEQ ID NO: 29044 - DNA, 1465 bp, Homo sapiens
aagatgaaaggacagctttttaaaaggagaaggtcataagacagtttgaggaaggcattggaagaggaagaggggcaatgtctcctttgttttattgttggtatataaacttaaaatctcagttctttttatggcacttgtggagccacttcctctcctcaccaaaaaatgcccagtaccctgaatccgatcaaattactctcctaaagtataaggcttagtttctgtgtgctgcttcgcgagacagttcccacaaatcgagagtgttaatcagacttttgtgttttcttttttggattgctgttgtttgttttcatttatcatttgtctttgcctaagccaggctcatcaagaattaacagccatcaggctgccgatgtgctgacagcagacccacttagagtcctgtgtttgtaattccatgcatttgttattttacctgttttgtccctgccccttctagtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatggtaaatccctctgtttataatgcactttacagtttcaaagcacttgtacgtacatttatctcaattatcaaaataacagtgaattataatccctttttggaaatgagggaatgtaaattttaaaagttaagcaattatccaaggtgacacagctgtgaaagtggtagaggccaggctttctgacacccagtccagtactctccttggaattagcctccattttacccacagtgttaaaatggctgggtattggga

SEQ ID NO: 29045 - DNA, 1052 bp, Homo sapiens
atctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctacta

SEQ ID NO: 29046 - DNA, 1030 bp, Homo sapiens
caaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgt

SEQ ID NO: 29047 - DNA, 1028 bp, Homo sapiens
agctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactccgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccagtaaggggccaaatggggccggcccagggctcagggtgggaacacatcctcccccagccccctgtgcctttcacatccttctcatcccctgcccctgcagatgatggcacacggacggcccgcaccaccacagtggagtcgagtttcgtgaggcgctcggagagtaaggccacctggtgtcgccctgtgcctgcctgcctgtccgcccacctcctccggctcttccttgagctctctctccgtgtcttcaactgtgccgtcactttctcttctctgcctgcggctatcaccacccctccatacagcctcccatcccatctcctgatgtccagcccaggccctcacctggtgccccttccccttttttgcag

SEQ ID NO: 29048 - DNA, 1041 bp, Homo sapiens
tcaaatgccacagcctctacattctgctccttgagttcagacaaataacctgacctcccaagatctgccaacgagagaggcagacctcgggaggtcaggcctcagtggctgggttggggagcagggcgccccagtgaccagcatttcccccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctcactctcggctctttcctacttgttagtagtcttgggatggtggtagtcagaggcagggactgaagaggtgagggaatgacagaaccgacatttaccaggcacca

SEQ ID NO: 29049 - DNA, 1063 bp, Homo sapiens
aggctccatattatgacccagttctgctgacttgctcccccgccgccacaaaagttagggttgagccaaaacttcctgccagttatcgacttgtgtttcccaagattaaaaaataaaaaagttgtgaaatgcttattcagatgttatccaggtactgggtaaaatgatcttaatttgttggagtttttagaacttctcgatctaaaagtttccttttaaagaagtgtctgaattgacattctcataagtatgttcttcaggccactggtctgaagaagtggctctgaaaaaaggatttgatgctaataataagtttgagaaagccacataccattattctttcttggagcttctcaatgtgtaataccacattaaaaccactgagaggtcctgcaataaggaaatgtgccttataagccaagataataacttgttccatttgtttaatctacttgatgtcaaatcttttttttttttttaattgaagcacacgttagcaaattctgacctagagtggggatctgcatactatatataggctgtgaaccaaacctggacctactgcttgtttatatggtctgtgagctaagggtgctttttacatttttctttcttttttttttttttttaagacggagtctcgctctgttgcccaggctggaatgcagtggctccatctcagctcactgcaagctccgcctcctgggttcatgccattctcctgcctcagcctcccgaatagctgggactacaggcgcccaccccgatgactggctaattttttgtatttttagtagaggtagggtttcactgtgttagccaggatggtcttgatctcctgacctcgtgatctgcccgcctcagcctcccaaggtgctgggattacaggcgtgagccaccacgtctggcctgctttttacatttttaaatgatgggaaataaaagaagaataatattacataggtgacaattacaggaagataaaatttcagtgttcatttcagtcacacccatttatttatattcatatatatttacatattgtctttgggtgctttaatgc

SEQ ID NO: 29050 - DNA, 1014 bp, Homo sapiens
tccaatttgtctactttttcttttgttacctgtacttttggtgtcattccaagaaatcattgccagaaatatagtttttaaagtcatgaccaagtggctcctggtttaaaattctcagaggcggccctaattgctgcctggttatcataccctacttctctttttttaatttttagttttttaaagacagggtctctctgtcgccgaggctggagtgcagtggcgtgatctcagctcactgcaacctctgcctcccggactcaagcagtcctcccacctttgcctcttgagtagttgggaccacaggcatgcgccactgctcttggctaatttttgtatttttttgtagagatggggttttgccatgttacccaggctggtctcaaacttctgggctcaagtgatctgcctgcctccaccttccaaagtgctgggattactggctgagccaccacacccagccttcaaaccgtacttctctactctgcatctgctgtagatgacaggagtccatctcttcatttcattggtcgttgggaacaaagctcccgagtgttggatccttgtcttccagctggcctaaggacatgcaaagattagaagcagcacttctatgttcattgagccagattgtgtctgcttctgtggaaatggcctaggggactcactggccattctgtcctgggtccagttgccaggttaattcctgtgatagtttctatagcacctgactctgatactcgctctcttaattgctcctcagaagtgccttgtgatgtaacagtgatgtggttttttgttttttttttttgtttgtttgtttgagacagagtcttgttcagtcgcccaggctggagtgcagtggtgcaatctctgctcactgcaagctccgcctcccgggttcatgccattctcctgcctcagccccccgagtagctgggactacatttgcctgccaccaggcctggctaatttttttcgtatttttagtagagacgaggtttcaccatgtta

SEQ ID NO: 29051 - DNA, 1038 bp, Homo sapiens
agaccagcctgaccaacatggtgaaaccccgtctctactaaaaatacaaaaattagccaggcttggtggcgcacacctgtaatcccagctacttaggaggctgaggcaggagaatcgcttgaacctgggaagcggaggttgcagtgagctgagatcgtgccactgcactctagcctgggcaacagagcgagactacatttcaaaaaaaaaaaaaagaaatctttttgtgtgtaggattctgatgttgtaaagagataaagattgatgctgtcaacttctggcctgagtgggcagtgtgcatagctgcagtgttctaatagcctgttttctcctttctgtctctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtc

SEQ ID NO: 29052 - DNA, 1047 bp, Homo sapiens
atgctaaccttctgtgtctcagtccaattttaatgtatgtgctgctgaagcgagagtaccagaggtttttttgatggcagtgacttgaacttatttaaaagataaggaggagccagtgagggagaggggtgctgtaaagataactaaaagtgcacttcttctaagaagtaagatggaatgggatccagaacaggggtgtcataccgagtagcccagcctttgttccgtggacactggggagtctaacccagagctgagatagcttgcagtgtggatgagccagctgagtacagcagatagggaaaagaagccaaaaatctgaagtagggctggggtgaaggacagggaagggctagagagacatttggaaagtgaaaccaggtggatatgagaggagagagtagagggtcttgatttcgggtctttcatgcttaacccaaagcaggtactaaagtatgtgttgattgaatgtctttgggtttctcaagactggagaaagcagggcaagctctggagggtatggcaataacaagttatcttgaatatcctcatggtggaaagtcctgatcctgtttgaattttggaaatagaaatcattcagagccaagagattgaattgttgagtaagtgggtggtcaggttacagacttaattttgggttaaaaagtaaaaacaagaaacaaggtgtggctctaaaataatgagatgtgctgggggtggggcatggcagctcataaactgaccctgaaagctcttacatgtaagagttccaaaaatatttccaaaacttggaagattcatttggatgtttgtgttcattaaaatctctcactaattcattgtcttgtccactgtccgtaacccaacctgggattggtttgagtgagtctctcagactttctgccttggagtttgtgagagagatggcatactctgtgaccactgtcaccctaaaaccaaaaaggcccctcttgacaaggagtctgaggattttagacccaggaagaatgagtgatgggcatatatatatcctattactgaggcatg

SEQ ID NO: 29053 - DNA, 1051 bp, Homo sapiens
tcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaatatggagagtgaaaacatgattggctcagggacataaatgtagagggtctgctagccaccttctggcctagcccacacaaactccc

SEQ ID NO: 29054 - DNA, 1057 bp, Homo sapiens
tgcgcgcctgtagtcccaagctgctcgggaggctgaggcaggagaatcgcttaaacctgggaggcagaggttgcagtgagccgagattgcaccactgcactccagcctggcgacagagcaagactctgtgtcaaaaaataataataataaaaataaaatcatggctgcttggtggctcatgcctgtaattgcagcactctgggaggctgaggggggtggatcacttgagatcaggagtttgagaccagtctggctatcatggtgaaaccctgtctgtactaaaaatacaaaaagtagctgggcatggtgatgcatgcctgtagtcccagctacttgggaggctgaggcaggagaatagcttgaacccaggaggcggaggttgcagtgagccgagatcacgccattgcactccagcctgcatgacagagcaagactccatctcaaaaaaataaaataaataaaataaaatcaggctgggcatggtggtacatgcatgtaatcccagcactttaggaggctgaggcgagcggatcacctgaggttgaaagtttgagaccagcctgactaacatggagaaaccctgtctctattaaaaatgcaaaattagctaggagtggtggtccatgcctgtaatcccagctacttgggaggctgagtcaggagaattgcttgaacccaggaggcagaggttgtgagctgaggtcgcaccaatgcactccagcctgggcaacaagagtgaaactccatctcaaaaaaaaaaaaaaagtctaccactgaggctgggcatggtggctcacgcctgtaatcccaacactttgggaggccgaggtgggcagatcatgaggtcaggagttcaagaccagcctgaacaacatggtgaaatgctgtctctactgcatctcaaaaaaagaatgaggggtcagggtcaggtgcaatggctcatacctgtaatcccagcactttgggaggctgaggcaggaggatcacttgaggccaggagttcgagaccaacctgggcaacattgcaagaccctgtctctacaaaaataaaaattaa

SEQ ID NO: 29055 - DNA, 1030 bp, Homo sapiens
ggcgcagtggctcatgcctgtaatcctagcactttgggaggctgaggtgggcggattgcctgagctcaggagttcgagaccagcccaggcaacatggtgaggaaacctcgtctctactaaaatacaattagccaggcatggtggcatgtgcctgtagtcccagctactggggtggctgagggaggagaatcgcttgaacccgggaggcagaggttgcagtaagccaagattgtgccactgcactccagcctgggcaacagaaaatgtgtcaactcttgggcaaataggtgctgatttcatggcatacaaagcaaattgacttctggtataaatcttctgtagctataagaacttcacgtatgcatgtatgtattacagaaaaatcctttgacacttaaatgtagggggaaaaaacacctctacttgagtatttgggttagttaaggctttattgaactttcttgcgtatgtttttttcttactcttcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccactgtaagtggggaatatgacatggggcaggctgctgcaggaattggaatggggagtggattggggtgcatggaccctgacattggaaaatttcctggcttttccctgcactaattgagataacacaatgactttataatgactgacaagaaaaacttcaagattaggataggagccagtctcagacttacctttgctacttatttcctcttttggattatctattgggaatgatatgggcgtgtggaccaatattatgcttgcataaagtagatggccgccaatatcttctgttttcattcatttaacacaaatttatagagtgcctaccacgggccaagcattattttaggctctgggcaggaatggaagag

SEQ ID NO: 29056 - DNA, 1084 bp, Homo sapiens
aattctaaacagagggtctatttctgaagctgaggaatcacatggagtgaatagcatgggggaaggggattactaatgaggctgaaagaaaagtaccaggaagagactgacttcatgcataatccataaagccaggttttcttgaaaggtgacctgctttcttgtattcctgcaagtacacggcagggtgggcagttccaggcttatagtcattattccctaacaaacggtcaagacttaggctgcccaagactctactacccttgtagtcaaaaatccaaccaccttgacctttacctcattatctgaccctttagcatggagtcctaaaatggtcctgaatggacaaatatctagaactctggtaaattaacttgagtagcatgggaaataagtatcacctcatagcaggactgaaaaacctccagttaggaaaggggactcagaactgtactgtattctgtagaatctttatccgtaagtgctatgtatatactaatagttaaggtgaataataaaacaattgtgagctaaggaatgtgatacagaacacaaggagtcaattaatgcatgagtcttaagggaaattcttagacttcagtgggtctaagctcagaactctgagcttagagaaacaggatgccccagtaaacatgatttgtttgagagaaactaccatatgtaatagatgattcctcaataaactgttttcactaggtcagtttaatcttggaaattacactatagatatcctggtattagccacaaggctatgctatctatagggtcagtccagtataaactgacctgttggggtctttaaagctcaaggaaaaaggccatagttgatttctcctaaatcaagatagagtccaattaacttttttttttttttaagatggagtctcactctgtcgccaggctggactgcagtggcgtgatctcagctcactgcaacctctgcctcccaggttcaggcgattcttctgtctcagcctcccgagtagctgggactacaagtgtgggccaccatgcccagctagttttgtatttttagtagagatgggatttcaccatcttggct

SEQ ID NO: 29057 - DNA, 1031 bp, Homo sapiens
aaaactaaaaatttctagaacaaaatataggaggaaatccttgtggcactgggttaggcaaagttttcttaggcatgacaccaaaagcatgatccatttaaaaaacactgatagactgggcttgatcaaaatttaaaacttctactctttgaaagacactgtttagagaatgcaaagacaagccacagactgagacaaaatatttcaaagcatttttctgataaaggacttaaattcagaacacataaaatctcttaataaaccaacccagtggctcacgcctgtaatcccagcactttgggaggctgaggtaggtggatcacctgaggttaggagttcgagactagcctgaccaacatggtgaaacctcgtctctactaaaaatacaaaattagccaggcgtggtggtaggcacctgtaatcccagctacttgggaggctgaggcaggagaatcgcttaaacctgggaagtggaggttgcagtgagctgagactgcaccactgcactgtagcctgggcaccaagagccagactctgtctcaaaaaaaaaaaaaaaaaaccaacacaattgaaaaatagacaaatggtttgaacagacacttcaccaaagaggttatgtggaaggcaaataagcatatgaaaagatactcaacataattagtcattagggaaatgcaaattaaaccatgtgatactactacacgcctattacaatggctaaaatttaaatgaccattccaagtgcagatgaggatgttggagcaagtgcaactctcatacaccactggtggaaacgtaaaatggtacaactactttggaaaacagtttggcaatttcccagaaggttaaacatacatctgctatacaacccagccattttaatcctaggtttttacccaagagaaaagaaagcttatgtccagagacttgtacatgaatgttcattgcagctttggttatttaacagtcaaaaactggaaacaacccaaatgtacatcaacagataaacggatcaactgctaaatccatac

SEQ ID NO: 29058 - DNA, 1031 bp, Homo sapiens
agcattagagagtccatcatttccttcttctagaatacctttcttctcccaggttctagttaccatcctcttgtgttttttctcctacctgtttgactgccccttctaactctcctttgttgattcttcctcatctgaatatcccaacacctagtctttgcactgcttctctagctgcctcacaaccaaaatctcattaaatctcacagtgattctcagatgtgtatgcccagccaagacctctgccttgaaactctggacttttacgtacgtgacaactccactgggtgtcacaccatagtatgcccgaaactgaaatcgtcatcctccccctctcagtgagtggaaactccatccttccaagtgctcaggtcagaaatggtgaagtcatccttcacacctcttgttctttcacaccccaatttaaaatgccatatgccaaaatcatgttgcttcaaccttcaaaatgcattcagaatccagccacttttcagacctccagtagctaccacccagtccaagccatcagcatctctcccccgagtgactccaatggcccctcattggtctcctgcttcctgtcttgcccctagtcagtatcttctcaggaggtagtctgagtaaatcaagtcacatcattctgtcaaacttccagtggcttcctgctgaaagtaaaagcccagagtccttactgtggtctataagaccaaccaactttttgtgtcacctattgagtttgtttttcatttctgctgtcatatttttaatttccgagagcttgttcttgttctctgcatgttccctttttaatttccaaaagcttcttttgttctctgcatgtttcctttctttttaatagtatcctggaggctcaaaattttttgaggataatgtggtttaagatttttatctgcttacactgtgtttcttctaagatccttttttctttgtatttttggtcactctgtcatgttggagcctttcctcaaatgtcaagagattctttattgtctgtttatatttaagagcag

SEQ ID NO: 29059 - DNA, 1051 bp, Homo sapiens
ccatgttggccaggccggtctcggactgccctcaagtgatccacccaccttggcctcccaaagtgctgggattatagacatgacactgcatccagctgaaggtgttaattataagcttggctgcaagcagggaaagggatggtgggtgtcattgttcagtttgtagacttttggtctaggaccatctcccaagctttgcctagtattctggagtccagttctcctctggctcgcctctccggagatatacctgagtctttgcttgagtgaatatgagtgaataatgggatccaggggcctaaccacttctgacacataggcttgcaaacagtcctgtgttttcatctcagtccacagctcctcgcctcctgatgcgtctcatttccacccctttctggggcctgtgccaccagctgggtgcttcttgtctcccttctccccctacaagaagacacttagttctctcctttatctggtgattcatctgccactctcttgcctaaaattgactaaaatttgttgacggctcttgtctgtcaccctttctcctattctcttggtctttttaggcttacacctttttgaatacatttgctgttatttaatgcggcgtggggaatggaaggaggtaaatggttatgttcatttcaccatgtgcaaacggttcctttttattacaattttttagaattgtaggccaggcgtggttgcttgcgcctgtaatcccagcactttgggaggccgtggaagtggatcacaaggtcaagagttcaagaccagcctggccaacatagtgaaaccccgtttgtactaaaaatacaaaaattagccaggtgtgcctgtaattccagttactcaggaggctgaggcaggagaattgcttgaactcaggaggcagaggttgcagtgagccgaggtggtgccactgcactccagcctaggtaacagaacaagactccatctcaaaaaaaaaaaaaaaaaaaagaattgtgaataaatctgttcaacagtctttcaaatattatagaaatgtacagtttaggctgggcat

SEQ ID NO: 29060 - DNA, 1383 bp, Homo sapiens
gcctccggagtaggtgggattatagacgtgtgccaccacacccggcacacggtatttttagttgagatggggtttcaccatatcggccaggctggtcttgaactccttgccttggcctcccaaagtgctagggttacaggtgtgagccaccgcgcccggcctgttattttgaagaaatgccatttactttttttggctcctcaggtattacctgtacaacctgatgttccagacgtggaagacctatgtgcgtcagcagcaggagatgaggaacaagtacattagagccgaggttcatggtgagaaaaagaagtccatgtctgaagaagatgcccacatttactttgcagaaggtcataggaaggacaaacacattgtctcagagagagaggaactctaggccaaaggaagatttgtttgattctctttcatatttttcagaaagtgtgatctctgagtgggcacctgtatgattgatccctatggttttctccatatggcatggtttgagcccttaaaactcatttaatcagaatttgtgtgaactggctgttcctggcctgctggttcagtgggctggctgtgactctcctgtggcacctggggctgccatctatcttgctgcgtcaagttgcccagagactctggagcagagctgcagtgctcttttctgatctgctttgctcaagttgtcccttagtgatactgtggccactttaggtctggtcagagtctggtttctcttgtgaattgagcccagaaacacatggagagtctaagggaaaaagacctagagtttcaaaatgataatacaggctgcattagcagcagaatgtcctaaaggtagctcaaactctgcaagtcacaagtacaacctgtcaactcccctaccacttacacctgctgttcctttgactcttctgtctaggaagacttacttaggaatggtgtccattcctcatgcctcatgtcatcacttacctaatcttttaagaaggccctctgaggcatcacttgcaatcatcgttgcattgctactgcctgagagtaatcctcatctttttcccagagtgttgtaagtgccacttcattaatctccctcatttattttttcgtgcttctcattgtacacatagctgcaagagtggtaagacatagataagatcatgacactcctttacgtaaagttaaccctgcttggtatgtcgtacaaggtcttcatttcttctgctttgcaccctctgcccttgacacactggatgtgcacttctttatctttccatctttgtccctgtagttcttccttcaggcccatttaaatgtgtagctttccttgatctcccccagcccagtgatctttcccctgtctgtattcccaaagta

SEQ ID NO: 29061 - DNA, 1605 bp, Homo sapiens
tcaccgcaagctccacctcccggattcacgccattctcctacctcagcctcccaattagctgggactacaggtgcccaccaccccgcccggctaattttttgtatttttaatagagacgggatttcacagtgttagccaggatggtcttgatctcctgacctcgtgatccgcccacctcggcctcccaaagtgctgggattacaggcttgagccactgcgcccagcctttttttttttttttcagatggagcctcactttgtcacccaggatggagtgcagagtggcgtgatctcggctcactgcagcctctgcctcctgggttcaagcaattatcttgcctcagactactgagtagctgggagtaaaggtacctgccaccacgcccggctaattttttttttgtatttttagtagagacatttactgctataaagttctcttaaacactaactatattacacgaattttaataagttatatttctgttttcattcagtaaaaacttgttttctgattttccctgagacctcatctttgccccacagattatttagaagtgtgtttagttttctaatatttgggagtttcccaatatctttctgttaaggatttctagtttattctattattgtcagagaacaagacttagtatgatttcagttcctttatttttgttaaggtttgttctgtggccccaaatatgctctatcttgtaaatgttctatatttacttgaagaatgtacattctgctgtcttatttatagttacagtgaatctagctagatattatggaatagaaggaaaaagtcacttggatgacttttttataggcggtggctcacgcctataatcccagcactttgggaggctgaggtgggaagattgcttgggcccaggagttcgagaccagcccaagcaacatggcaaaacctcatctctacaaaaaaatacaaaaattagccaggtgtggtggtgcatgcctgcagtcccagctactcaagaggcaagagttatttctgacataagacaagttatttcaggccattcccctagacctcagggagtgtccattcactcttggactgttaaatgaaaagtttgcaagtacttttaggccttaaggaagcatggttctcagttgtcacgtgcatcagaatcatggcagagacagttaatgagattcctgtgttccatactctggaaagagcagttagtgtttattttagatatttttcatagttaaatcatctcatttacactttccaaacataactctgagagaggcaccattttacagatgaggaacttgtatgagattaggtgtgtaataaatgaaagggccagtaagtctggcttgtcttactcaggatcccaaactctaaaccacagcactatactagtcctgattacctgaagtatgctgattcctgaggtccacagtgaaaccaaggaagatacatgttaaattctccttcgtatgttgatttgtcttgtcaacaactgtgaaatatatagttatagtcctgtcgactacatcttggaggctgtcctaaaaatgatttatataattttattttctcctttgtcttctaaaaagaagag

SEQ ID NO: 29062 - DNA, 1034 bp, Homo sapiens
ccaggctggtctcgaactcttgacttcaggtgatccacccacctcagcctcccgaagtgctgggattacaggcatgagccagcgtacccagcctcttttttttttttgagacagagtctcgctctgtcacccaggctggattgcagtggtgccatctcagcttaccgcaacctctgcctcccgggttcaagtgattgtcctgtctcagcctcctgagtagctgggattacaggcggccaccaccatgcccagctaatttttgtgcttttagtagacatggggtttctccatgttggccaggctggtctcgaactcctgacccaaagtgatccacttgcctcggcctcttaaagtactgggattaccggcgtgagccaccgcgtccagctctatgtataaactcttttttttccctttttttttttgagatggagtttcgctcttgtagcccaagctggagtgcaatggcccaatcttggctcaccacaacctctgccttccgggttcaagcgattctccggcctcagccccacgagtagctgggattacaggcatgcaccaccatgtccggctaatttttttgtatttttagtagagacagggtttctccatgttagtcaggctggtctcaaactcctgacgacctcaggtgatctgcccgcctcggccttccaaagtgctgtgattacaggcctgagccaccgcacccagccatattcttaatcactacccctaccatactgtgtgcccaagtgtgagaatttggactgcctaggatgttcatccacacattttatttgttcatcaaagtcttgctttgtataaactcctgcttaaattctgggatatgaggaagctcagactaatgatagttcattgtctagtgggggaaatagacatgaaaatatgtctttaaatatggcatgataattcctatcataaagatttgtatgaagtcctgtgagagcgactgtggagattcagccaaggaggtaatgtttgtgcagagtctaagtcataggagatgagaagtt

SEQ ID NO: 29063 - DNA, 1048 bp, Homo sapiens
caggtgcctgccaccacacccagctaattttttgtatgtttaatagagacggggtttcaccatgttagccaagatggtctcgatctcctgacctcgtgatccgcccgcctcggcctcccaaagtgctgggattacaggcgtgagccaccacgcccggcctaattttttagtttttttatacagacggagtctccttctgttggccaggctggtcttgaactcctgtgctcaagcagtcctcctgcctcagcatcctaaagtgttgggattacaggtgtgagccactgcacctggccttttaggcattattgatggagctggatccaggtccatcctggcccaactccaacccttcctttcactaaagattccttcttccattttagcagcactgcatttataatcatacaaatgtatgcactgagcccacatggtaaaaaaacaaaaaccaccacagacaaaaagtctgtcttctcctgagaggcaacagttgatgtttaccttggtctgtagaattgtcatgtgggtcatggggttctttcctggtgtgggtgtgtttgttcttgtgcagtatagatggacagcagggagggttcagcaaatatttattaagtgcctgctgtgcaggctggcttgtgttaggctcccagttgaatctcaaagcagagaaacactcagggagatggaacagctacaagaagctgtgaccaagcttctccccgctgatttgaggcactgtttgccttcctctactcttagtttacagactctactgatcccagtccttgtaatcagttgtgtcctttctttgcacagtatttttgctttagagccctaaaagacaatgtgacccacgctcatctccagcaaataagaaggaatcttgctcaccagcagcatggtgtcacggtgagggttgtcttctgtatcaagggacctcttctgaaggccattctctctcgctctttttttcagtcttgccaaattaagcagaactctttttaaaaaaactttttgtgcttcaagatttgtccagactgtcaactgt

SEQ ID NO: 29064 - DNA, 1088 bp, Homo sapiens
aaagctgcaggagcctttctgggcgtttggtggagcctagcgagtagccagccccagaatccagtgtctcccagggaagacggctcagcggaaaaacccggttcatgctgacccgtggcttatcagtgctgggggacctacagagtgagtcctctaggcggcactccctgcctatgcaggagacccctggcaccatccaggactcctagcaatgggaggacattcagctgggcagaggctgggttagatcaggacccaccccaggctgtctaggctgggtcaggacgccactctctgtgcacttgctctcccccagctcctgcacaggcagagcacccaactgctggcacagagactcagccggacctgcttccgccagtggagacaacaggtgggaacccaggagatgtcccctctgcacttccttctccatcctctggcctgtgaggcctgggcagtgaatgaccttcagcctacacctctagttcagtatttttactatcaccctccccagggccacctcctctaccaccttcctgtcatttccaggcacatcagcttccttccgtctgcagtctgcataagaacagttacttcaaggccagtttctctctctacagtgttgtattaaaaaatacatcagtggaggccgggcgcagtggctcacgcctgtaatcccagcactttgggaggccgaggcaggcggatcatgaggtcaggagatcgagaccatcctggctaacacggtgaaaccccgtctctactaaaaatacaaaaaaaatcagccaggcgtggtggtgggcgcctgtagtcccagctactcgggaggctgaggcaggagaatggcgtgaacctgggaggcagagcttgcagtgagctgagatagcaccactgcactccagcccgggcaacagagcgagactctgtctaaaaaaaaaaaaaaaaaaaaatatatatatatatatatatatatatataatcagtgggccgggcatgatggctcacgcctataatcccaggattttgggaggccgaggcaggaggatcacttgagcccagaagttcaagaccagcctgggcaacatagt

SEQ ID NO: 29065 - DNA, 1368 bp, Homo sapiens
tgggagcctcgactagagagggagccaagagggacgagctgggcagggccccgtgatcaccacggcctccttgaaggggctatagggaaatgatctggtctttctggccctagctggcagccaggaggcaggagcagcgggcgacagtgcgggccctgtggttctgggccttctcgctgcaggcaaaggtaattggggctctgcatcctaccatccctgcctctccctcaggccttagccctgccttgggtggagggagggcacctggtctgtgggggagctctaagcagggagacctgggcctcacctcctgccctccctggaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggccttgtcacagctgagctgctgggaaccccctcttctccagccagatcccatccctcccacggcaagagggagagaatggagtgggatttccaaaccctctctcctttgcctgccaaagctcaggaaataggtgtcccctcctctgcaacaccttcctaccctctctcccgtcctgctgacacgatcttttccggagtcatacacgtagttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttg

SEQ ID NO: 29066 - DNA, 1035 bp, Homo sapiens
ggaacaagtctacagcccaaagtgtgtccctctgtcttaacaggaagaaggaggataccctgagcaccaacagggattttcagatgcaggtctgcgatgtcactgtcacctgggcctgagctgcagacacagggtctgcagcccccacaggtccagccagcactcttgagggcctggatgcagccagtctgagaagcccagccctgctgagccccaccttggccccacggcaggacttgtgttcaacgttctactgtgactgagccaggccataaagccatctgcacctggggttcctcccaggaggcaaagagaagtcatcccctcaggcccctctgttctctcttccttcagggaagcctggagcacctaagacagacgatggcctggggacaagcactgggtcccactagatggtcccagagctctccggcagggccaggtacccaggaaggggcagcctcttaaacttcaggtgctgctgccactgtagaagctgcctgtaattggtggctgctgcttctctaaacacaaccaagacaccaactccccaaggtgtaaaactgatttcattccaactttcaacacctctccaaggtaaggtaagctcccagagagctgctcttatcccttccagctgatgcccagtcacacagaagggctatgtgagcccaggcccttcccaggcacaggtgggagcctgggctaatgtccagggtgcctcagtgcccctgagctctgatgacacccatgtgactgtcaaaggcccaggaacagggtttcctccttggggtcaacctgcctgggaagccaagggcaagagcaagccctctagggaccaggagaggacaagccagttcccttgcccattcctggggcatgcctctgggttccttaagggtgtcctcaccctaagggacccaaacaggatccatccatcctgaaccacccctttggcatcccggaattaatttggcttctgttcaaaatcacctataagctcttttttgcttgaacacagaaaaatcagagaca

SEQ ID NO: 29067 - DNA, 1030 bp, Homo sapiens
catacacacagttctagatggagaaaagaaaaccctgacagattgtcactttttaactttatttttatatatttatttctgagatgggcttcctctatcgcccaggctggaatgcagttgtgccatcatgcctcactacagcctcaacctcctaggcccaagcaatactcccacctcagcctcctgagtagctaggactacaagtgcgtgccagcatgcctggctctttttttgtttttgtttttgtttcattatggtagagacagggtctcactatgttcctcaggctggtttccaactcctgggctcaaacgatcctcttggctcagccccctagagtgctgggattacaggtatgagccaccgcagctggcctcttttagacttttaaagatctgtcctgatattttgctcaggcttggttaaatgtaaactacagtcttctatcttttctccagaagacttacagtatttctacactggatcaaaggttactttcttttgctgacttcgtgaatgcctgagaaaaaagatgctgtgggcctcctgtgagaaaaataaagtatagtcatttgtatagttaaagtcattacaaatggtcaaataatttccctgcaatttaactttcaatctggtaatagttacatagttaagaacacatgagccgggtgtggtggctcacgcctataatcccagcactttgggaggccaaggtgggtggattacctgaggtcaggggttcatgaccagcctggcgaacatggtgaaaccctgtctctactaaaaatacaaaattagctgagcatgatggcaggctcctgtaatcccagctactcgggaggctgaggcaggagaattgcttgaacctgggaggcagaggttgtggtgagccgagatcgtgccattgcactccaccctgggcaacaagaacgaaaccctgtctcaaaaaaacaaaacaaaacaacaacaacaacaaaaaatatatatatagtagcaaaatcttgtctcctgttgactaacattttgcttt

SEQ ID NO: 29068 - DNA, 1015 bp, Homo sapiens
ttagatataacaccaaaagcacggcatccaaattaaaagcagttgaatcagacttcaaaattaaaaacttttgtgcatcaacggacattgtcaagaaagtaaagaggccagacctgctggctcacacctttaatcccagcactttgggaggctgaggtgggagaatcgtgtgaagccaaaagttcgagtaacccagacaacaaaacgagaccctgtctctacaaaaataaaaatagaaaaaaattagctggctgcattggcaaatgcctctagtctcagctactcaagaggctgaggcaagaggatcccttgatcacaggaatttgaggttacagtatgattgtaccactgcactccaacctgggtgataggacagagcaagaccctgtctctttaaaaaaaaaaaaaaaagaagaagaaaaaagaagacaacccacagaatgggagaaaatattatttgcaaattattttctgataaaagtctgttatccagaaaatatgtagaacttctgtaactcaagaacgaaaagaaaaaaccctaattgacaaatgggcaaaggctgccccattcaccatgatgtgattatttcacattacatgcctgtatcaaaacatctcatgtaccccacagatattaaacacctactatgtacccataaaaattaaaaaataattaaaataattaaaaaaacaaatgggcaaaggacttgaatcaacatttctctaaagaatatacatgaatgtccaacaagtacatgaaaagatgctcaagatcattagtcattaggaaaatgcaacctaataccacaatgaaatgccacttcacacccactaggatgactgtatttttttttttttttttttttttttttgagacagagtctcgccatgttgcccaggctagagtgcagtggcgcaatcatagctcactgcagccttgatcgcctgggctcaagccatcctccctcctcagcctcctatagtagctaggactacaggcatgtgccactatgcc

SEQ ID NO: 29069 - DNA, 2075 bp, Homo sapiens
aaaattaattgtattactcgacagtcaataaattgcatttcaaagaatcttccggtttttcctttcagcccagttataggtaaaatcattgtttttatgttaaagtagtgagttttgatgtcctgtgtcatattgtagaaagccatgatttggggaagaaaattccagaagataaggatggctgatgagtggattaaatttaaataggtcattttgttttattttatatattttttagagataaggtctctctcactctgtcgtcgcccaggttggagtgcagtggcacgatcaaagctcactgtcaaaaataggccatttatattcactaaagattgctctaattagttgaaatgactttgaaatgtgtccgttttcttaaaataagtggcaggttgctcgtgtttgtgtgatctcttttagcaaagaatgataccagtaacctcagagtaaagttctggctcattcccaattttagattgatcatttttctttgatcgattcttttgtactgtttgaaatactcagcacagaatttgcacttggtttacatttttatttttagctccagtttgcctttttcaaccataactggtcagaactcttttgcagagtgagccttcttaagacaagctgtttttatctttccataggtatgaatcctaggacccagaataaggattctctagaggacagtgtttctacctctccagacccaagtaagagggggcagctgactggggaaaggggtagacagggagtgtggggtggtcagagcatgaggaaacaagaggaagccctgtgggaagtgagtggtcctgaggtacacatacctctggggtatgggaaggcgatgtggtgagggaggactctctggactctgtgatggaaagtgagggggtgtgtgactgaatgacctgttttggaaggtgattcaggggcacctgggaaaggtagcagattccctataaggcccccatgctggtccagagctggccttcacccttaactgcctaatgatatctccatgaaaaagttggaaagacataataggctgttaactggaatcatttacctgcctgtagttgaaatatttggctgaattgcattccttttgattgtctttttgaatagctatgcagtaagagaatgtctaaatatctgtaataataaaatagcagagaaaatcctaccatttgataaactttacttagctgtgaccaatggatgtatatcactgagtctttttgtccccacttttttttttttttttgagacagtgtcttgctctgtcacccaggctggagtgcagtgacgtgatctcggctcactgccacctctgcctcccaggttcaagtgattcttctgcctcagcctcttgagtagctgggattataggcgcgcgccaccacgcctggctaatttttgtatttttagtagagacggggtttcaccatgttggttaggctggtctcaaactcctaacctcgtgatcctgacctcgtgatccgcccgccttggcctcccaaagtgctgtgattacagccgtgagccacctcgcccagcctttgtccccacttaataatccttttactatttgttcaggtccctcctagcagtcatttgtaatggcaacattaagcatattactgtatcttggtttgagtagtcatttcttattcatgaccatttggatggctttctgctttttagccatagcatataatgcagctatgataatacctggtgggctgagcatggtggctcatgccagtaatcacagaactttgggaggctgaggtgggtgcttcacttgagcccaggagtttgagaccagcccgggcaatatagtgagaccctgtctctattaaattagaagttaataataatacataatacatggtgcagcaggtgtattttttcttttggttaatgtctttggattacactccccaaagtatggttggcagattgactattttccagaaagctaccagcagtgaatagatgattctatttctctacaaccctgtcaccggagtttgttacctttgctcatcattgttattttagtg

SEQ ID NO: 29070 - DNA, 1091 bp, Homo sapiens
tcagcctcccaaagtgctgggattacaggtgtgagccaccatgcccggcctaacttagatttgctgagataagactcagcttggtgcttcacctcagcaccctgccttaagctactcagggcagttcaggagctgtgggtcagaggggagaatccgacagtgactgccacttcttgctgtgccatctcaccacgtggagttcatcacaagctctgttgatttgcctcctcaatggctttgcatccattctcttcttcccaggccctgagctgccactcagtccagccttcctttgtctttctcttagatccccaggaaaaccttctaatttgtctctgctttcactccacttgtcagtcagtctttttataaaaccactgtgattttgcccaccacttaactagaactttttggtgacttgaacttcaaaaatcttagatgcagcccacatggtcctgcacagtctggtctggtgggctgtttgtacagccaccctggccatcacacagtccctggaacatcacaaactctgcaccagctcagacgctttgcacttgctgttccctctgttccatctgcctggaacatgcctccctccatgcccgctctgtctcactaactcctggtggtcagccatcagctcttagctcaactgtcacttctccagagaagcagagttggccctgttacatcctcccacagcactttgtacttctccagcatggtactcaacatgtttacactctaccatggcagaagcttctttttttttctttctttcttttttttttttttttttttttgagacatagtccggctctgtcacccaggctggaatacagtggtgcgatctcagctcactgcaagctccgcctccaggttcatgccattctcctgcctcagcctcccgagtagctgggactataggcgcccgccaccatgcccggctaattttttgtatttttagtagagacggggtttcaccgtgttagccaggatggtctcgatctcttgaccttgtgatccacccgcctcggccttccaaagtgctgggattacaggcgtgagccaccgtgcccagccaaagcttc

SEQ ID NO: 29071 - DNA, 1033 bp, Homo sapiens
ccgctatgaaggcggtgagcgcgccgggagcccgggcggctggccggggggggcctggcgttggggagggacggggatggccgcgggcgcgttcccctcccggccatgggcgacccggcgacccggctgggcgtggccgcccgcccgcccttagcccgcgcttcccgctcccgctgggcgccccgccacttcctgaggctgggcccagggtgggggatccgggagggtgcagttcgggatcgcgaaggcagccccggaaggggggcgggccggtcggggtcgccacatcttagttcggaacccggccgggggcagagggtgccctaggggacgcgaaggagccgcatttctcctagagcgtttcaccggacccgggggctccccctctcgtcttcctccgttccccaacttggaataaagaatcacctagtaagtggcgccctgtctcagctggttttctctgccacgacctgaagtctgcaattccgatctgttttgctctgctcgttcgaattgttctggttccatcttcccacgcctgggggtctggctttgtgtgcgaagacccctttcctgcagtctaggcgtggacgggggcgggagagtgggcggagggtgtggggccccactccacagccccaggtttgctgctgcgctgtctgcttggagattaaaatgaaacgtgacttctaggtgagacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcactctctctccacgttattttacgttttctgtaaatgaatatttcctctccctgcgtcaaggtcacacagtggtagaacaactgcgaccaccaacctatgttcagtgtacaacctcctgagacctgggaggatccccttgaactccgccttagacctatacattcagaaattcgggcggtgagactcagac

SEQ ID NO: 29072 - DNA, 1092 bp, Homo sapiens
ggtttgtagcccaggagcaacaggctataccatacagcctaggtgtgtaggctatcccatctagtttgtgtaaagacactctgtgatgttcccacaagggtgaaacttcctatgacgcatttctcagaacatatcctgttgttaagtgacacgtgactgtatgctaatcgatagcctgcttctctgggctttccacaactgaactcccaatgagaaaaagggaaagagctcttttaccaaggacccgccaacatgtgccgcgtttgcaccaaaaccgtgaagaaggcggcccgggtcatcatagaaaagtactacacacgcctgggcaacgacttccacacgaacaagcgcgtgtgcaaggagatcgccattatccccagcaagaagctccgcaacaagatagcaggctatgtcacgcatctgatgaaatggattcagagaggcccagtaagaggtatctccatcaagctgcaggaggaggagagagaaaggagagacaattatgttcctgaggtctcagccttggatcaggagataattgaagtagatcctgacactaaggaaatgctgaagcttttggacttcggcagtctgtccaacctgcaggtcactcagcctacagttgggatgaacttcaaaatgcctcggggacctgtttgaattttttctgcagtgctgtattattttcaataaatctggcacaacagcaaaaaaaaaaaaaaaaaaaaagggaaagaagaaaaaattatagcagctctcttcatccctcatctttgctggtgtctcattgtcaatgaggccccttcacacccatcatttgagagagtcattgctgtcaatgctgtattacagatgttcaaagagagggttgcaaatgccaagtgagctgtcaatggtctactgcttgttggtagctgagctgagaatcaaactagccaagtaggttctctcttcagccccttacttcccaaaactcacagactctgcacttaggctgttgatttctttgtgtggcaagagttcaggagctggccattccactgtggggtcctttgccaagaagcacagtttagccagtgagaggtggacatt

SEQ ID NO: 29073 - DNA, 1046 bp, Homo sapiens
gctgctggatgctcttattacctgcagttatgtccccacttccacagatgcaagagaagatctgtttgccttctgagaagacttgatatacctcctgagaggctaacggacatgctcaggctcagccagcttgtgacacaataaacatatccacattggtgagaggacaagaagagcccagtggacacagagctctgtggagaaggataccaaggtcaggtcaggatggggagccttcccatggtcaataatgtgtctggggccacctcctgtgctcatgacagtggggaaacaattcttgctgtctcacacatacactgtgcacgtggtaacacatgcactcacttaatcacggcatctactgggcctgactaagaggcagcagccacagccacaacaccagatggccacatgactgtgcttgcaggagctgagatggtgcagaaaccctgttgccaagacttctggaggtacaggattgtctcagccttgaagagtagagaagacacaaaatgaacaggactgtggccagagagtctcccagctcaagtatgaagccacaaagaaaaggaagaatgggccgggcgtggtggctcacgcctgtaatcccagtacttgggaggccaaggcaggcagatcacgaggtcaggagattgagaccatcctggccaacatggtgaaaccctgtctctactcaaaatacaaaaattagctgggcgtggtggcatgctcctgtagtcccagctactcgggaggctgaggcaggagaatcacttgaacctgggagttggaggttgcagtgagccaagatggcgccactgcactccagcctgacaccgagctagactccgtctcaaaaaaaaaaaaacaaaaaaaaacaaccaaacagctgcctgaggccgggtgcgagtggctcatgcctgtaattccagcaacttgggaggctgaggcaggcagatcacctgaggtcaggaattcgagaccagctactagaaagggcccactaagtcctggccaacatggcgaaaccccatctctactaaaaa

SEQ ID NO: 29074 - DNA, 1050 bp, Homo sapiens
ctgtagtgttgaacaacaacaacaacaaaaatccaaacccaacttctttttcagttctagactaactaggctctcagtctagttagtcaccagcacctgcaacaagatattccctttatgagagtgtcatgagaaaataagatgaatcctgaacacagaagactcatgcccttattgctcccttattctgaaacacatgctctgtgaaagttgtctgtaccaaaatagagacacttatgccaaaccctaacaaaatggggctgggagaccatgcaggtagagccctcatacacctatgccggtaacaggaactgttggaagacattatcatgaagactgtctcctagcaacagccagtaccaccaatgaacaaacaccagcacctgcaacaagcaggtgaagcaatcatctttgtttcaaaacagcttacatggactctccctctctgtctttaaaagcctctccttgccccaacccccttggaagtcctgtggtctgccatagcacatgtatcctggtttgcaatccctcactattcccgaagaaactcctcattttggagagttggtctctctgtcgcttattttaggttgacagctcaaatgcacgaaaatggccccaaaactgttttgactgttctagctggtatttttccttacgtcttccaactcagctggtatactttaatttttatgttagtatgcatgagaagcatatcaacatacctggttcatgagagcctgcttggactattgtcacagatcgtctcccgccagcaacccactgctccagttctcctctcccaactgcaccattcatggccatggccatgccctggcatcctgtgttcatttgaaccttgcctttcatttgctagtctcctatctgagctgctacttcctcccaaccgtctgtgtggatgatatgctgaattcgaagtgccaatctggttaccaaacatatagctgaaccaaatgacctgtttcctaccccatcccccacataattcccttccatcaagatgttcacatctaatatggaggattctgt

SEQ ID NO: 29075 - DNA, 1044 bp, Homo sapiens
tattttttgtagagatgaagtgtcactgtgttgcccaggctggtctcaaactcctgggtttgaagcaatattcctgccttgacttcccaaagtgctgggattacaggtgtgaaccatgcctggcctcttacgaaatttctatttctttagtcataagattctttgaaatgttatttaaaagtctcaaaactaggtttaatagctttggtggtacttcacatttgtcaggacatgactgtctgatgacactaggacctagcaatgtctattcagcagttcatcataattagcaaatgtagcttttactttggcattcttgtacacagagtgtcaacagtttctgccttcatctaatcattctgctacatcacatcataacttgcaaggttggagttaccaaatagtaaatgtgtagttgcaaattttgccttgattttttataaaagcacttaatgacgtgtataataacctctattcactagattcaggatacttaatataaaaagaataactgctgaatgtcttgatgatttcctaatttctgatgttttgtttctttactgttcttggcaaatcagctcttggcagacttgcatggcagccagccgttccaggattgattctttgaaaaggagcagtgtgtctttaaatctttccttcacccaaggcatcctgcttggtgcacatgtgcataagcacatcactgggctctttcatggaatgagatgaagtgcgcctttgtatacatgattaaaattgaaccctctggtgatgtcaagtatatttatcctttgggtctggaagagagatgatgctgtgaaaactagcaagattattttaatgaacaaaggaagactcattgccaagggttaaataaaaaataaatggagtttttagtgacttcattagaaataatgattttattgtgtttagttgcctctgattaaccttgttgcatatctttaagttactaataagctgctgcctagtggattttatataaagatgcttactgtagtttttaaaggtggtgttgtagagtga

SEQ ID NO: 29076 - DNA, 1090 bp, Homo sapiens
agtttgttttgtataatgtgtccttagtatattaggagctaggaaatgcaagcccatactaaaaaagaaaggcagttgatgaagtgacagaattctttatcatctttcttttgtttatttacagctacactaaaaatcaacaatgagattagaagtgtgaaaagattgcagctgctaccagaatcttttatttgcaaagagaaactaggtaatacaaacattatttaacttttggggtgaaactctgtgaaattcatataagaaaaaaatctgaaagataatgttcaaaagactgaaaatttctatatgagattaaagcatattgaagacaatgtggtttgtttaagaatgcaaaggtttaaaaaatgtgaaagttttgcttataatttgaggagtttgtttctttcctgtttttcttagggtcatagtgtgctgaattatattgttatgagataacactagtatgtaatttattacactctgatgatagttcatagtttctgtactaatctttggagatctccctattgagatctccatattggtatttaaccaatatggaggggatctgtgtttcatgaaagtaattcaatgtcaagttcattattgaagattattggaggaaaaactacaatcaaaatgtttgtttaaacctatataaatttgatggctattttatacagattgatactttaccaaaggtttgcattctaggtaaggttttgcttaaactctataaaattattaatagatacaaagaagacaggttttcccttttatcatttttcagttaaaccaaactgtgagaggcagttataggtggttggagcagaagagataaggtggagaggggaactgacattttttaagtgcctgtttcattctgtacttgtgcctgtacatatgttattccatttaatcttcttagtaaacttaggagggttttaagagcctagtgggaatgttgtggtacaatgggaagatggcatttatagcagtcctttaggaaaggctggctagattgacattgttgctttgaaggcctaaaggcttattcttgttcattcctaggggagatcagccctgagag

SEQ ID NO: 29077 - DNA, 1046 bp, Homo sapiens
tggtttgattgttgggggcactgggtagacagtgtaggggccatactccagcatgaatgggaataaagacaacctgtgtccagcctggcccatctgtaaagctggcttctagccaccacaacaaggtggaaggaatggctagacatgctgccagttaccagtttgaaaagtgtcttctgttgttggaaaagcacaacctcctcccaccccacttcccttgttccctgtggcccctgggccagcgaatgcctcgggagaaccctgattgccaaacaggagagtacaaaatagcacacatttgaattacagaggagaaactggagcaaatacggacagattaatgcacaaaccaaataggtggatctggggttggccagcaattctactttggaaggactttgagaatctatttggagggcagaatgtaacttaattttagttcagtttagtgaagttttgtttttgtaaggaaaacactgatgtggcctcttcactgggccatctctgcctcagacttttggaaccatgactgtgatcttgtttggctggtcttagtaggcaattcttgggttacacatgggtgataaggtgggatgggtacatgtgatagagtaggcactcctgatcccaaaatacctcctatacttgttctgactacttcatctgtgcttctccacctctccctgaagttctgtaaggctagaatatttttatgaggttgcctttcttctcatcctagggagaactcccaggccttagcttacagtgcatgttagaagtctgaagatggtatgccctaagatggaataaaaatagacatcaccatagtggtgataatgctaataacagtggtagcaaacacatgaggtttgggatggactacatactgttctcagcgcttatattaatacgaccctcacagcaactttatgaggcattgtttcatcattcccatcttacagattgggaaaccaaggcatagagaggtttagcaacttcctgaaggtcacccagcaccagggctgggatttgaaccctggctctca

SEQ ID NO: 29078 - DNA, 1046 bp, Homo sapiens
gtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcaga

SEQ ID NO: 29079 - DNA, 1050 bp, Homo sapiens
atctggaaggttgcttctcctcagtgatttcgcattacaggagggttttccttctttgtttctcagacctggtcctgtagacgggaaggagcctggacacagtgacacattctcaaaggccctgcaggaccaccatggcttatgatgactccgtgaagaaagaaggtatgaccccataatctgagaagcattccaaagggggtatcctcttcaatccttgcagcccatggatatagagaccaggactgggcaccacagcctggactcccaagtgatggtccagagcactgttatgacactcagcctccacgccatccccagactgggcccatggaaacgaaaaccaggacaggggttccaacacgagagtctgaaatatgagtctcttagtttattggggtgatcccctgcagcactcttggtccttgccagctccagtgtgcaggagtctggggataggaatcacatcctggactcccacagagagcagcacagcacatgaatccttattcttttcagcctttcgtctgcaagtctgtgtcctcctaccaaatcacaactcagaaaccatatctgaggttgcacatggggcctttgcatagcatggaaacattgtttcttcaggtttgattcttgtatttgcagctaggtcatcaagaaatattctgttcccctgggtctagccctgtatttcagtggacttgattgaaacattgttttaatttggaaatagaggaactgttgcattacctgcatgacgatttggtcattacttacttgactttctcatttcctttcccaaataaacctgtgcttctcagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggtaagtcctgaaaatttaaattaggaaagtcttaaactactcatttttttttggtgatgcagagtttttttttgtttttt

SEQ ID NO: 29080 - DNA, 1045 bp, Homo sapiens
tctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaaggtaaagcatcttttaagtgtggtgggggtaagagattaagcaggttcttcctgggtagtcagtggacttttaagttaagcagttgaggtaaaccactgggaattaagcatgtttgggggatatgttggaatgatataaagtataaaatattaccagtagcccagtctgtctgatatagaagcaatctttttttttttttttgagatggagtctcgctctgtcgcccaggctg

SEQ ID NO: 29081 - DNA, 1047 bp, Homo sapiens
atacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttatggaagtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttc

SEQ ID NO: 29082 - DNA, 1048 bp, Homo sapiens
gtcagcctctgccgctcccagcccatcagccttgcgtgccctcccagttcctgcctccccaccctgcctagctggctggcaccccccagaggacatttagaagagctgtaaccaagccacctcccatgctgctgagacaaggtgggggcagagtcatctttgtgctggtgagccagtgcaagacaagatggcacctcacccagcagtttatagatgtgttttcagcagcagaatggaatcccccattcaaatacgacctcatacacaaccacagtctataaaataggaaacaagatctgctcaagaaagggtctgctgggaattctccatgagcctacgggcactggagctatttatcagtctcctgagtttggccaatcctggtcatagccattggtggtcttggtctcagtctttggccagcaacaccctccctaacctctccagcctttgctgctgtctgtcatgtaggtcacttgtcagatcctaatttccagaggcaggaaatgagaccctttttaccatttccaggcaggcctggaggatgggagccgtcaatctgtgccccccagcccgctccgttcttgcatcagccatcggtaagggcagcatccaatggcttggtggtctctctttcagggtaaaatacgaagccccccaagcaacagacggcctggctggagccctggacgcccggcagcagagcactggcgcggtaagcagaggggccatcctgccaccctggggccctcctgaaggaggtgagggaatgctcacccactgggtgccgttgtgggccaagcactggcccagcacgtccacaggcccttcctcgtttggccgtcaggtcggttctttttggctagtgtggttattcccagtttatagctatggaaactgctagagaggccaggccatttgcccaagcccacaagcaaggattcagacctgagcctgacttgaaactggagaccaggccgggcgtggtggctcacacctgtaatcccagcacttcgggaggctgaggcgggtggatcacctgaggtca

SEQ ID NO: 29083 - DNA, 1140 bp, Homo sapiens
gccttggcctcccaaagcgctgggattacaggcgtgagccaccgtgcccagccacaaggctgcatcttaaagcgattgagaacgtggcctgaatgaggatgggagtctcttgaaggcctgcccacaggtgggaggctcagcagttgggaaggaccccacccccagccagctttgtgttcacctttcccatttcctcctcagcatgccccaggatttgtcagaggccctgaaggaggccaccaaggaggtgcacacccaggcagagaatgctgagttcatgaggaactttcagaagggccaggtgacccgagacggcttcaaggtatgtggcttggtgggactagccctggtggagggtgtggcaggtgtgggtggacccaaggctcagaccagtggtttaagtggggatgctgagggaccagatgggcatgtccaatagaatcatcttaaaaatgatgacactgaggctcagagagggaaggtgagttacccaaggtcacacagcaagttcagcctgctctgtaatgttgtggaggggctggggcagcagtgccgttgactgagcaccggttccatgttgggcattttgtacacgtggtttctaatctgtgcttcaaccctgacgagaaagatgaggactggaaggctcagagaggttcagtgactaacagaaggtcacacagccagtaagtggaaaaggctgaaatcaaccaagaccgatttcagccttgtactccttgtatttcagagcttgtactcctgatctaactcgaatttgcctctgaagataaggaataatataggttggagtcttaacagaacccttttctaacagtgagactgagggtgcctcatctaatctccctaagccacgttttccccatctgtaaaagagtatttcaacagcagggttttcttaagcacccactatatgccaggtactgattttgctgtttcccagcactgttgtgaaattcatgcaaatagaaggaaagcacttgatgaagaaccgggaagatactgggtgttaaaacatcagcgtggggaagagcttgttcaggttgaacagagggtgtgggggtggggagtagggagctatatcccaccaccttcatcccagtcccttttgcaatctgcacc

SEQ ID NO: 29084 - DNA, 1059 bp, Homo sapiens
aagctaccatagtctgtgtcctcacttcttcaggcttctcttcacatgtccccttaccaggggcatcttgcccaacccttcatcttcagtttggtgtgcacgtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctttatgttgctataatatctattgaataatgacataattacctagggatacgtagaggcttagaccctcagaatggtctagaactgcctagaatcccactggaaaagatcttgggatttgagtggggctttagtaagagaattgatgaactagctcttcacccatgaggacaccatgatcctgcaagaagaccgagtgtgacctgtctgcctcctctcagcaagttaatggaaggacccagcctcaagcagttcccttgactcttaatccagtgctaggtccgtcagtgttgccttcctttcttacctccaggcagcgttgcctgcctggcttatctccagcttattctggagacccccataaattgccgctggcaacgtctccttgctggctcctgggatgaatgagccctgcctttggattctccaggtagctttggtgactcttttcccttaccttgtacagagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtgaggcagacgggctgggaggtgggcatctacgacggtggatgtcccagctgtggccctaacccgagtgttgggagtgggtcatctggagcagggtgagtagggtggagaaggtggccagt

SEQ ID NO: 29085 - DNA, 1052 bp, Homo sapiens
tttattaaaaatatgaggcagtaaagcacagtggttaagaacatggacttggggccaggtgtggtagctcattcctgtaatcccagcactttaggaggctgaggcaggagaatcacttgaggccaggagttcaagactagcctgggcaacatagtgagacccccatcgctctctctctctctttttttttttttttttgagaccaagtctcactctgttgtccaggctggagtgcattggcgcgatctcggctcactgcaacctccgcctcccaggatcaagcgattctcctgcctcagcctcctgagtagctgggattacaggtgcccaccaccacacccagctaattttttgtatttttagtagagatggggtttcaccatgttggctaggctggtttcaaactcctgaactcaagtgatctgcccaccttggcctcccaaagtggtgggattacaggtgtgagccactgcacctggcctattttattatttttttagagatgggggtggttctcactgtgttgcccatgctggtctggaactcctgggctcaatcgatcctcctgcctcggcctcccaaagttcttagattacaggtgtgagccactgcaccagccaggattaaaggagttaacagccccaaagcactcagaacaccaccaggcccagggtaaaggctttttcagtgttccatatgtaaactatctacatatgtagatagttttttacatacgtaaaaaacctactattgacgtatgtaaacctacacacattggcttgctctaacagaagggctgtgttgtaaggtagtaagctccctgtttctgcacgtggtcaggtagaggcaacccagcatctgttggcgggcttggtcttccaggtcagggagacttctccccggctcctactcagggctcaccaccacctatttcatacttactagttgttttagagacagggtttctctgtattgtctggtctggaatcctccagctctggttattcacaggcatagtcacagtgcactacagccttgaactcctgacctca

SEQ ID NO: 29086 - DNA, 1034 bp, Homo sapiens
aggtgaccacagtgatagtttctcgggtcttgtctcctcctgatataggactcatcaaatcttagaattagatgggatttctgggtgactcggtctctggaacccatcagcttctagcacgcagccctaaggttcccactgccatccctgtcaaactcaaactcatgggtgagtttgaggatcttggctcctggaaccccccagcttcaggcccagctactcctttagagttgaaggggctgttttctccagcgacccagacttcagttccctctgtgcctctcctcctccagggggccctccttccagaaacaccctgcctgcttctggtggtataatagaggacactcagcatggcaccctctcactttatgcctggtgatgggcctgatctgtcgggtcagtgcctttccccagaaggaacgtggtggcatttgttgattcatccgtttgtgtcatggagataatgaccgtacctacaataaagggcgaggtgagcattaaatgcatgaatgtatgcagagctcttagactagtgcctgttacattctctatgggtttctattattattgatacttttagttcattcagctaaatttaccaagcattcacaggtttccgggacactgggaatacagagaacaaagcatgtttcttcctgcttgggggagaaagatccagaaagaacgtcagcgccagcatgaagagccttgtgagaaagaacaagtgctctgtgatatttcaagagatgggaccccatggaggcctggtgtgtgggtaccggggtggccttgtgctttgagatgaagccagggggtctagcggggagtacaggtggcaggcaggcatcagttacataagcgcctcaccctgggagctcaagtactgtgtgacggttctgttcacggcccccacacagaacgtgctccttgtcagtagagcagagcagggaggagaagcaccagagagctgctgcgtggagtctggaagtatctcctccaacttccttggggaggaaagcaagggcccagac

SEQ ID NO: 29087 - DNA, 1030 bp, Homo sapiens
tagattatttataataatctcctcttccctcctcagctctccctcctgtcaggacaagcaaaagcatcagagacagagacagacagagatagagacaaaagataaaagatagagacaaaagacacaaaaaataacagattatttataataattatttataataatctattattattaatagtaagaatgatttttttgagacggtcttgctctgccatccaggctggagtgcagtggtgcaatcatggcttactgcagccttgacctcctgggttcaagtgatcctcccacctcagcctcctgagtagctgggactataggtgtgcaccaccatgcctggctaattttgtgaaaatatatatatatatatatatatatatatatatatatattttttttttttttttttttttttttttggtacagacagtgttttgccatgttgcccaggctgatttcaaactgctgggctcaagtgatccacccaccttggcctcccaaagttctgggactacagacatgagctacctatatacccagaagaataatttttttttaagtccttaatgaagacagtctgagccctgggatgctggtaacttatttatgaagacaaggcccttcctataagtgattagaaatgcaaggaatgacactaggtgtgagttgggatttttaatctgcagaagggagaacctgggggtcattaatatctgtcttcagagtgattgcgccacctcagcagcaatgagaaccatggggcttacatcgtcctcagcatccctcagccctcccgacagacctaagaggtcacgttgccattcggcttttacagatgaagaaatcaaggctaatgagttaggtggctcatcaaaggactcaggccccagattattttggcagctggtatggtttcctctgggtgggtgtattagcttcttatcgctgctttaacaaattaccacctattggcttaaaaaaaatgaatttattattttacaattctatagatcagaaatctcacacagat

SEQ ID NO: 29088 - DNA, 1063 bp, Homo sapiens
tggagtttgagctcttcaccacacgctgcccagcgatcctgccggagggtcttgaccacagagtgggggtgtgggggctgtgattcagattctccgaggtgctgatgcagctctgtggcgcctactgcccccgccccccgactgagaactgtggctgtgctcagccaccgtgactggctggggtatggctcggatcccttgggtgttggccaggccccagttgatctccaagggctctcggtgttccaggaagctatggcttggtgtctgaaacacagtctggagtaataaatgtcgggaggaaggatgtgactaggctgcacagggaagagaccaagacactttgagccaaatctctctttctcttgggaccccaagagctgattcacctggaacatcctggagccatgacacaagccatgctctgatggcagaggctgccagctgccacccaggacagagagcttatgggaggtggtggagttcctgctccccgcaaagcctgagggctggtagagatgtgagggtgtttcaacgttgctttccaagataaggaatgagttctttttctgtccttcttcttctgtccctggacagcctgactgcgtcaaagaaggaggtgggggagccagggggcagctggggtaggaagaagtccagcttggtgacattaatgggaggacagaattgcctggctcttctgtttttggacacgggcacagttatgaaactttgagcaaccccaggcctggggctggttcctggtggccctggcccacccctgcctgctgtgtgaggcctgtgaggtgcatgaggccactgtccataaatggaattgtcagtttattaccctcggtacccagcccagtgcctggaagttcttcccggatgtcgactgccgtggggagaagaggggcccactggccacagtgagggtgctgagctggagacgagttacacccgatctcatcctgggaggagactgtggtctggagggggtgagagcaaaaatgcagaggcttaaaacagaggtgagggcagagggaggcaggagagaccggga

SEQ ID NO: 29089 - DNA, 1091 bp, Homo sapiens
ttctaaagacaaagtgagtaagcagaaaatgggcaggtgagtttcactggaagcaagagcaacccagtgtatttttggaaaaaatcttgaatcatactaatgggataactgtgttttcagttctaataattgaaataaacctcagaatcactgtgtatcattctctgaatcctctggtttattacactattcttgacaaaaagcctggggcactaagaagatagcatctcccccacaatgtcccccgcccccatccttagaaaagcagcagctaccttgacacttaggtgtgactgcagcctccatacatcatggaaagagacaaggccccaaggagtttttttgttttgttttattttgtttttaaagaaaagggcaaatgaggggtccccacatgcaaaaagtccaagactaggataaaggtttcctcaggccaggaattcatgctacttttctacatttagaaccaatattttacagtgcaaataggcttaaaaatttattacaggaaagaattggtacaagcttaaaaaaaatgttacaatgatttttataaactcactgaatgacaggctcatagtgaggtctgactggcacaatgatattttgaagtgtgtccctggtattatagaggacaatttgctccctggtgtccaagagagagaagagcaattgagcagcctgggtctgacccagcaaaactggagtcccctggtggctgaatgtgcccggtaatgtaccaaggagaaaatcattttaggacatttcctgtatgtgtgtttgggaggagagagacaggcaggggctgggaagctttggaacagggtgggcacgatgagatgtcagctaatgaaggaggccctgccttctccatggacaaatccccagctttcaggacagtgtctgggacgtggtaagtactcaagaaatatttattaaataaacaaatgaaggaaagaggtacttctccctgtagtctcaactctttgagtgtttcatccaatctccagaaccccagcttcctttcctccatactactcaattgaaatttaccttactgaagtcactgaagacctccaaatcatggccaa

SEQ ID NO: 29090 - DNA, 1032 bp, Homo sapiens
aaaaaaaaaaagaagacatattatccattatttttaggtgagttgtaatttaacccacggcattgtcgggaacagtagtctggggtttggatttccagatatgggtcctgaaactccacgggtcttgggtctctgtgacctttcttcaacctggagctcagaccctttgtctttctgggagcttaagttacctgcatagaagcttcgcaaatcggtgtccaaacagttctccaggaagcgcctcagaggtaggatgtgcccgatcggggcagtccagtctgttaagaagtcttccacgatgtgatggatggccgtgggccgaggcaggggccagtgtgcagggcggaacctcacctcctgttctgtggggaggagagagggggccatgtcagagctgtgaggctgggcttcccctcctcgggccgacacagcacggatcccacacagcccaaacacttccctcgttcactcgtgctcggctttcccgacagcctcctatgctgggctgtggtcagactgttcaagagccacctgcagatatttgaaaggctgccatgaggaagaggaactaggcttttcccttgtggtttcggaaggcagtgctgaagctaacaacgtgaggctggcgtttccctaagactcacatggactgagatctactgtggctgctttttattttgtattattatttgttggagacagtctcgctctattgcccaggctgtcatgcagtggcacaatttaggctcaccgcaacctctacctcctgggttcaagcgattcttgtgcctctgcctccagagtagctgggattacaggtgcccgccaccacaccgagctcatattttacatttttcgtagagatggggtttctagtctctaccatgttggccaggctggtctcaaactcctgacctcaggtgacccacccgcctcagcctcccaaagtgctgggattacaggcatgagccactgcgcctggctgtggctgctttcaaactggcctttctctgagaagactcagatagaggc

SEQ ID NO: 29091 - DNA, 1124 bp, Homo sapiens
gacactgaaataaacacaggggactcacaacgtgatattcatgaagttgggtttctttttttctttttttgagacagaatcttgctttgtctcccagactggagtgcagtggcgaggtcatggctcactgcagcctcaaccttccagtgtcaagtggatcctcccttctcaacctaccaactagctggaactacaggcacatgccaccacgctcggctcatttttaattttttttttttttttttttttgtagagacagagttttgccatgttgcccaggctggtctcaaactcctgggctcaggctatcctcccacctccgcctcttgaactgctgggattataggcatgagccaccccgctcaaaccaaagttcttttaataaaggaattccgcagtgcagggtagacagcttccttctatctctcatatgtaaactacctccttttcttgctctccttttcccctgacccattgtctccttctctcctcctcaggaggctggatggggacacataccatgagtgacatcttaccagagggtggccatgaacttcatcatgttccacaactgttaatgaccactggcgctggccctgctgctctctgaactcctctctgtggaactgtgccccttctctgggaagagtccttgaagctctactgagaatgaaacctcttctttcagctcatgtcaatcttggtattttcccaacatgttcaggttctggcttggaggtgctatctgttgttgactttggacataaacgaagctgttatttgcctcttttggtttgttatgttaacaagcttttgggatttgttctttaagattccccacccctattgtatgatgataggtgctggaaccagactggttgggttcaaatttttgctgtcgctaacttgctttgtgaacacatgtcagttactgaatctccccgtgcctcagttttttaaatatgtaaacagggagttctcgtagtacccgtgggtcttagtcagttattgctatagaacaaaccacccccagacttagtaacatcaacaacaactattgtttttttcattcatgcatctggagagaggctggggaggaggaggcttgggtttggcttatctag

SEQ ID NO: 29092 - DNA, 1332 bp, Homo sapiens
cagctgtgtatccttctgacatgagcctggggcggttacgtcctggggtcctccactcccagggcaccctcacctacagtgatcccggcttctgaatcacacaggcacctggtttctacccctccctgacacccacagcctgccttcacaccctcctttatggcccacagacctttgtgagaagtgccaatcaagcagggagactggggcagggtgacctcagatctctgaagtcccaccaagccctgaaattctaagattttagatttgctgctggcagttccagggccaccaatgagagtaatggaagaaataatgcaatattattattattattattattttgagatggagtctcactctgttgcccaggctggagtgcagtggcgcgatctcggctcactgtaacctctgcctcccaggttcaagcgattctcctgcctcagcctcccgggtagctgggactacaggctcatgccaccatgcccagctaatttttgtatttttagtagagatgaggtttcaccatgttagtcaggctggtcttgaactcttgacctcgttatccgcccgccttggcctcccgaagtgctgggattgcaggtgtgagccaccacgcccgacctaaaccgtttttaatgattattaaaaccagccagatgtaatgcatggtggttgcccctctacatttattgtttaatcttggctctaagaggtggaggtgagaagctccattataaggaacagaaaccacccagagaccctacacacccacatcacacaaccagttaagcagtggagtggggtttacattgatttggggggctctctggctcctaaaccagggctctttctactgtaaatggatgattgggtgagggaaacaaggatcctcaagaataggggacagtgtttgggggtgcacaggggctgctgtggttcccacaatagggttcctcaggaaggaacctgcagcatctgccagcacagcgccccctagctgtgctgtaacgcagataatggggatcaccccttagccaaacaccccttggcagcctccctaccctaaagaccgtgctgaggcttcctgggcccctggaaaagtcagattagtctggacttcctcctactccaggaagccttcccacctcttctgctgccaccccaggcaaacataggggccctctgtgctcaacactgaattctaaactatcctcaatttcactctctcttgcctgcagcctgacgtttccccccagggcttggcaaaggcaagagtgcctcggtgtccggcacaaggcctgaccgcatgggtgaagtaggttcctaaaa

SEQ ID NO: 29093 - DNA, 1066 bp, Homo sapiens
gggagttcgaggctgcagttagctgtgatggagccactgcactcagcctgggtgacagagtgagaccctgcctcaaaaaagaaaaaaaaaaaagtcagggagctggggtgggagcaagtgggtaaggccacatggcagacccttctacaggacattgtacagaggaacacccttcccgctcccattccttcccccagagatgcatccttaatccctgctgagcagggaaacttggccctgccatgaacctgtcacttaaccttggacaggtctcccttccctccgaacctcagtgctgcctgtcaaataggccacgctgcggctttgcagggttgttggagaatcagatgacatcatgtaatggttggccaactgtggatcgcttcagaacttcagcaaacattccacgaggacttctcggtgccgggggtgccagggagggaagaagatgattcagaagttcccccccacgagggggaggagttagggttgggggaggatcagatggtgggaagggaagagaatgtagtcagaaaacaaagcaagctttgtcctattggcttctttgttcttatcttgttatttaacctattttgaatttcaaataacattagaagggcagtattgagatttctatgcttggaggtggcagcaatggttttaaaaaaggaagaaggctgagccgcagacataggtgttcttaaggatcattattgacttttatcagctgaggtcccaggtctgtgtaggtaagtgacttgcccaaggtcacattgtgaggacacagagcccagcctgccctcccactctcagaaggggccagggtgatgttttggcatgcaggttatcatggagatctgtgattcagctggcattgatttggcacttgttaagtgcagagcccaagctagatgcccaagggagaaaggcaggaaaatccaggcggcctccccaccctccaagtgcattgccgatctcgggaggcgagactgggctccacaagccagtcaagggcttatgtgagtcagaggctctgagttcaagtctcaactagctctgtggatct

SEQ ID NO: 29094 - DNA, 1886 bp, Homo sapiens
tatcctcttcagctgctaatgtttggaccccggatttcctcctctgtcgcgggcctgccgtcaccgcccattctgtcttccttccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggtgagggcctgggccatcttggcccacttttcagaggctgaggctgaggcccagaggggttcagtggctcctccaagctccaagtgagctccaagtgaccacagaggtcaggcccagaccccacatcatggatggggagggggtgcagtggtgggaacaagctgactccccaaaacacctgaggttgagagtgaggaggtggagtttgaattctagctgcccctcacttgctgtgtgacctgggcaagcacatccccctctctgggccttagctgaaccagtcacccacccattcttgcccccttcaaccaaagccttcccctcatgtcggaatgatatcatggagaggtgaagggcctgggctctagattccaatccagttctgcctgaatttcaggaagtcagttgacctctataagttcaagtcctcgcctggataatgagtctctcggggtcattgctaagattcagtgccaggagaggcgcaggggggctgatacttagtaggtgctcaggacactggagctgttgttatctgaacttggtttcctgtaactcgacaaatttgggaaaccactcacaggaaccgcaagccacaggccttcctgcccagccagaagtgccaccttggccgttcggtcagagctcacctgagaaccatgggcccctgctgccacctggtggccactccctgccttgcgggagtggctctaacacccctgccccaggcggctgctcagaaccgcactgaggactggtccacagaaacccgattctgtctcaggtctgtagtcctggaagcaggggctggacatgtctgtccttcatttctatacagtcagaccctgattgctggtcccatcctgtgtccacaaaccagctcacgtgctatgggttcacctgcagccatcggccagcgtcatggcagggagccggtggccatggctgaggtcacagttgggactgagaggagatttgagctccagacttgattccacctcgtcagacttctatggccttgggctagctccttcgccccatcccaaactgagcctcac

SEQ ID NO: 29095 - DNA, 1030 bp, Homo sapiens
ggccagggcagtgcctgatggctcaaacaaggccagcacctgtgtccaggccaggctctcttccatctgggccctccccttgacatcaccccagtgccctttccccctttgacctcaccttgacctctgaccctgggctgaagcacaggtgatcttcccgttgttcttgcccccagttgctgccgtccaatgagttgcagacaatggtggattcgctgaagcgagggttgaaatgcaggttcagcttgtctgtcccctggcccagattaattacaaagctgcaggagaaggggtagcaggtgaggttcagggctcaggcctggataaagcagcttgggttggaggaccttggttgaccacaagctggaagaatcaaagcttgtgttagttgagatctgtgccttaaaacaagggaggtaacaacctgctcagacttagcactgtggtagcacattccatttggagcagggatcacgctgttgagagaagggtaactgatagtgacagcttcgggaattgggggtggctctcctgggagagagaaatgctatctcttagatatctgaagacctattaaatttagccaccagcagccaacctaaggtggtgagctccctgtcactatgggtgtgcaaccggggttgtatgacttcttggcaagatcactacaggagcctgggctagacctgcagggttcctgaaagtggggcattctgggtcatggggtgtcttcatttgggagtctcagaccaagggtatcacacattttgacaaacttgagggacccaagtaggagaaataagtcacttttcccttagctcctatggcatgcacctgcccgccccctctctaaccaaaagtagataaagcacagttccaagatgcgctgacatgttctgcaggcgagagagcctttcgctggactgtgactcacggaggtggtgaggccgctggttctaaccaagaggatgccagcgagaccactcagcctcccctggtggctgccctggtttaatgctcatgaaatgcc

SEQ ID NO: 29096 - DNA, 1034 bp, Homo sapiens
atctcagctcagctctgagagccctcccagagagcagctcccgagggctccagagccctccgaaagccctcccagagagcagcccccacctcccaggctgtctgcacttctccttgctatgctttgctctgtaacattttgcaacagtctgcagtacacggggtttgttaatctgagtattcattgtttctcttgctgggcagtgaacttgaggagggcagggattttgtctgttcactgctggagccccagcacccagaatacttaaatctgagttggatgaatggcggccagccactgggattccagggctttgggccccctgccataacatatggcccagggcaggcgccacatgctgggtcagtccccagcctcctgtccacagatccttctctgttctacctcctgggctgtgtccttccacaccctcagctcggtgctcaggcgtgggcagaactggctgggaaggggtggtccttagaggtgggctgtggagaaatgaagatcgagctctggctgccgccatggccttcccatgcaaaaagtattttgtcatccaaaatcaatattttggtcaggcacagtggctcatgcctgtaatcccagcactttgggtggccgaggtgggtggatcatttgaggtcaggagtttgagaccagcctgaccaacatggtgaaattccatctctaccaaaaatacaaaaaaattagctgggcatggtggtggacgcctgtgatcccagctactctcaggaggctgaagcaggagaatcgtttgaacccaggaagctgagattgcagtgagccgagatctcgccactgcactccagcctgggcaacaaagcaagactctttctcaaaaaaaaataaaaataaaaaaatacaggccggacgcagtggctcacacctgtaattccagtactttgggaggccgaggcaggtggatcacgaggttaggagatcaagaccatcctggctaacacagtgaaaccccgtctctactaaaaatacaaaaaaaaaaaaaattagcc

SEQ ID NO: 29097 - DNA, 1107 bp, Homo sapiens
gggtgactcctcctggtccctgcttgtgtgttgcctcttccaggcagcctcctcagccccaaactgaactgagtcccctcctctgtgtttcttttttgtttgtttgagacggagtcacccagagtcccagctctgtcacccaggctggagggcagtggcgagacctcggctcactccaagctccgcctcccgggttcacgccattctcctgcctcagcctcccaagtagctgggactacaggcacccaccaccaagcccggctaatttttgtatttttagtagagatggggtttcatcgtgttagctaggatggtcttgatctcctgacctcgtgatccacccacctcagcctcccaaagtgctgggattacaggcatgagccaccgtgcctggcccctcctctgtgtttctacagctccttggcttccctctgtcacacgttattgagaacctagcttcccttggcccacttcccggctacacagctccttgagggcgggactatgatttttttctcccttacttctggatctcctctgagcataaatttcatgagaattatggagacactgttctcagcagaatcagaggaggtggggctggcgtgatgggtccagctgcaggggtgggaggagtggggaggaggggaagggccctgaccatagtctctaaaagtggggccctttggagggcagctgtgctcatctgtctgtctacacccacaatcaggtcttgaggctgtctgggcaggaaggcagggggagagctttcccacgtgctcagtcacactcctctcccactcctgaccacacctttgccagggtcaggagtggaagagcaggaatcccactgccgggccacaatgaccccagctctcctcttccagatagagccacgaaccccctgaacaaggagctcgactgggccagcatcaacggcttctgcgagcagctcaacgaggactttgaggggtaggtggccgtccccacttgtttgcactgccctgcactctccagaacccagtctcgggtacaatggcctgggtgggtggagacccggttttcattctgaacgtattcacaaagtgatgaggatggggcacttgg

SEQ ID NO: 29098 - DNA, 1100 bp, Homo sapiens
aggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgttcacctgtgtttgagtctatgtttggggagggaggaggaccccctgctggagtgtgctctccctggacctggcccaccacattgttctctgcatgaaatgacccattcctgttcctgagtgtcttctgtgtgtagcgatactttgagtcaagagtgctttatagccaggcgcggtgact

SEQ ID NO: 29099 - DNA, 1051 bp, Homo sapiens
aaattagccagggggccaggcgcagtggctcatgcctgtaatcccagcactttgggaggccgaggcgggcgaatcacctgaggttgggagttcgagaccagactgaccaacgtggagaaaccctgtctctactaaaaatacaaaattagctgggtgtggtgggacatgcctgtaatcccagctactcgggaggctgaagcaggagaatagcttgaacctgggaggtggaggttgtggtgagccgagatcgtgccattgcactccagcctgggcaaaaagagcaaaactccgtctcaaaaaaaacttagccaggcatggtggcgtgcacctgtaatcccagctactcgggaggctgaggcaggagaattgcttgaactcaggaggcgcaggttgcagtgagccacgattgtgccactgcactccagcctgggtgacagagcgagactccatctcaaaaaacaaaacaaaacaaaaccatactgatctcacaccggtctttcattttatgctcactattctgcaagttctgatacaaagacaagtcttgtccccgttttgctaggattttcattcctgaatgtttaagtatgtcctggaagcttctaggggcaggaaagggtttggaaacagaccttcccctgtgtaatccttgctttagggcagatagacttcttccatcagaagccttctctagtcccaacccaggcctgtgatgcagcagggcgcgccaccacttgccagagccatggtggctcggggtgcccagcccaggtccccccagctactgctccatgtaagtcattgtcttgtgcctctttagggaggggctggagacaggtctgaggaggaggcgtcatccacggagaaaccaaccaaagccttgcccaggaagtccagagaccccctgctctctcagcggtgagtcttggcctgctgcctccccggtcccacccctcctggctggcagtagtgacctggcccttagggtggtgtggagcaggtgtagggcccggagcagccctctgcctgtccagtgatcctctgcctctcc

SEQ ID NO: 29100 - DNA, 1023 bp, Homo sapiens
gtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccac

SEQ ID NO: 29101 - DNA, 1028 bp, Homo sapiens
atggagtctcgctctgttgcctaggctggagtggaatgcagtggtgtgatcttcactcaccgcaacctacgcctcccaggttccagcgattctcctgcctcagcctcccaagtagctgggatcacagccatgtgccaccacgcccggctaattttttgtatttttaccagagacggggtttcaccatgttggccagcctagtctcgaactcctgacctcaggtgatccacccgcctcggcctcctaaagtgctgagattacaggcataaaccaccgcgcccagcctccagtgctgtgcatctctttatttacttattgtattttgcaaaattgaccaaagtatgtgtctctccagcctgtcaaatgagaatctggaaggccaggatgacaggcaggagccaggttgtgatggttcctgactgcctagaagaggaatgtagcactgatctgtcagcattggtgatgtgtggaagaactttgagcagggaagtggtctggtcactgtgttgcgggtactaggaggagtcgcaggggccagaaaagcctggaggaggctggtgctgttaggtgcccagggcactggaccaggaccctggtggtaggtgaggtctcctgcgtgttcattcactctcccaaggactgactgcctgagtgaggtgcaagggtagggtgagaaaactcagcccggggtgccagaaggccagtttctagagttagatggacttaaccttggcctcattcctcatggtggagagactcctggcagcaaatgctgggaaagaacttcagctccctgggcctccatttctttatctgcaaaatgggaacagtaattataaaagcaataatttttttttttgagagggagtctcgctccgtctcccaaggtggagtgcagtggcacaatctctgctcactgtaacctctgcctcccgggttcaagcgattctcctgcctcagccttttacatagctggattacaggcgcctgacaccacgcccggctaatttttgtatttttagtagaga

SEQ ID NO: 29102 - DNA, 1031 bp, Homo sapiens
tatttaaaaggtgacagttattcattcaagaaatattaagtacctgttaccacttactttccaacagtcttgcctctctcccctccaacgcacacttttctaggccctgagggtatgtctgagtacaagacagacgagattcctgacttcctagacttgggagaagggtgcaaaacagataataagtgaaaaataactttaagtcatggtaatatttttgaagaaacagggacaacgagattgggagtgacttgagatgtttgtatctctgagtattcaaaagggaattttacgcagacctgagtttagtttctggggtggtcttgccatttcgttctatcatatatgtgggtttgagcatactctgtatttgttgtatccaacctccaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacaggtatgggctactggctgaaagggcctctttctgggtgggactggcctggtaatatagttcctacaaatgaggtgagcactctgtaaacagtactttcgggggggttggggggtgggggtctttgtgagtccttgaggctagggacattttattttgttagactttattttatttatgcatttgtttattttttgaaacggagtgtcactctgtcgcccaggctggagtgcagtggcaagatctcggctcactgcaacctccgcctcctgggttcaagtgattctccagcctcagcttcccgagtagctgggactacaggcatgtgccaccatgcctagttaatttttttgtatttttagtagagacagaatttcaccatgttggccaggcgtgtgttgaacccctgacctcaagtgatccacccgcctca

SEQ ID NO: 29103 - DNA, 1030 bp, Homo sapiens
ccacattgtcttgattactatatttttgtagtaagttttgaaatggggaattgtaggccgggcgcagtggctcacgcctgtaatccaagcactttgggaggccgaggcgggtggatcacctgaggtcgggagttcgagaccagcctgattaacgtggagaaaccccatctctactaaaaatacaaaatcagccgggcatggtgacacatgcctgtaatcccagctacttgggaggtggaggcaggagaatcacttgaacccggaaggcagaggttgcggtgagccgagatcgcgccattgcactccagcctgggcaacaagagcgaaactccgcctcaaaaaaaaaaaaagaaagaaagaaattgggaattggtaagtcctccaactttgttctttttttttttttccccaagattgttttgactattctgggtctcttggatttgcttattgattttaggatggacttgtcaatttctgcaaagtagccagctgggattttgagaggaattgcctagaatctgaagatcactttggggagtattgccgtcttaacagtattaagtcctccaggccaggcgcggtggctcatgcctgtaatcccagcactttgggaggtgaaggtggacggatcacgaggtcaggagatcgagaccatcctggctaacacggtgaaaccccgtctctactaaaaatgcaaaaaagttatctgggcaggccggcatggtggcgggcacctgtagtcccagctactcgggaggctgagacaggagaatggcgtgaacccgggaggcagaacttgcagtgagctgagattgcgccactggactccagcctgggcgacagagcaagactgcgtcccaaaaaaaaaaaaaaaaaaaaaaaccaatattaagtcctccaatctatggacatgggatgtctttgatttatttaggtctttggttgcgttcaccagtgttttgtgttttcagtgtacaagtctctcatttgttttgttatagctaacgtttttttgaacacttaactc

SEQ ID NO: 29104 - DNA, 1028 bp, Homo sapiens
tggctaattttttttttattttattttttgagatggagtcttgctctgtcgcccaggctggagtgcagtggcacgatcttggcgcactgcaagctctgcctcccgggttcacgccattctcctgcctcagccttctgagtagctgggactacaggcgcccgccaccatgctcggccaatttttgtatttgttttagtagagacggggtttaaccatgttagccaggatggtctcaatctcctgacctcatgatctgcccacctcggcctcccaaagtgctgggattacaggcatgagccaccacgtctggcctaatttttgtatttttagcagagatggggtttcaccatgttggccaggctggtcttgaactcctgacctcaaatgatctgcccgcctcagcctcccaaagtgctgggattacaggcgtgagccactgcacccggccaagttcttgtttttaatcttgcttttgtacctccctcctgcaaagccatgctacaaagcctgttggctggaagaatggtgtgtggagaaacacgaccgtctgcctcaaactgtcaagggcttcctttgggttcccgtggttcctctggtttccttttccccgcctttattaggctacaggcagaattgtttatggaactgtttccttccctggcctagccagtccttccctgccaggatcctgccccatggctagacacctgcagctgttacctgggaagaaatcagaaaggattcagccagatgcaggggcttgtgcatataacttcagcattttgcgaggccaaagcaggtggattgcttgagtccaggagttcaagatcagcctgggcaacatagtgagactcccgtctctacaaaaaataaacaaaattatctgggtgtggtggtgcatgcctgttagtgccaactgctcgggaagctgaggtgggaggatcgcttgactccaggaggtggaggctgcagtgagccgtgattgtgccagtgcacccagcctgggagacaaagtgaaaccctgtctc

SEQ ID NO: 29105 - DNA, 1040 bp, Homo sapiens
tacagaatgggtgacagaatgagagcgacactgtctcaaaaaaaaaaaaaaaaaaaggccgggagcggtcgtttgtgcctgtaatcccaacactttgggaggccagggtgggcggatcacttgaggccaggagttcaagaccagcctggccaacatggtgaatccccatctctactaaaaaaattaactggacatggtggtggacacttgtaatcccagctactcaggaggctgacacatgagaattgcttgaacccgggaggcggaggttacagtgagccgagatagcaccactgcactccaacctgggcacagagtaaggctctgtctttaaaaaaaaaaaaaaaaaaaaagttttgtcaaaacttagcagagcaaggctaagaaagctcaggaacctggggcctcggcgatgcctgtagtggcaacttatgtataggggctgcagggagaggttaggctgtggcattgagccctgatagcccctatcatcaggaagtggtagatttcagttaatcctgagttctggaaaaataaaaaaaaaaggaccatctgactggtttcctctgcgccctgaatacccctaagccaacatgtgctgaggctcaagagcattggtacaaagtgcatggggatttgattagctaccttcccacctgccctgtgggctgcttgcgtccctctcccttgtcctcccccagggagatggagaaaggccctagctgagaccctcacttactggtggcttgaggcttgaactgctcccggctgtaggccccattggcttgacacatgttggcaggccggaggtggggacgggctgcgaggatgggaggcaggtagatgggcgaggctatttgcttggaaggtaagactctctggctggatgttgggctgcactgtaggggcaaagcatctcctcctggggaacgaagagttggggtgggaggacccacatggcttttttttttttttttttttttttttgagtctgagtcttgctctgtcactcaggctggagtgcagcggcgcgatctcgg

SEQ ID NO: 29106 - DNA, 1067 bp, Homo sapiens
ggtgactgggaaagccttgtgaagggattagaattctagtggggacaggtaaagagagttggttttgtgggtactccaggtgccagaaacagcccaaggaaaggtccaggtggaggcaggcagttgtggatttgtgatgagggatcataagcagcttggggcataaggctggagaagatgacactggtcctgtgagtgacaggttcagaagattagagttcatttggtgggcagtgtgcagcacttaaaggttttgaggccaacatccagcatccaggccactcataaatccaagtgtcctgtttttcttttctttctttctttcttttttttttttttttgagatggagttttgctcttgttgcccaggctggagtgcaatggcatgatcttggctgattgcaacctctgcctcctgggttcaaggaattctccagcctcagcctcctgagtagctgggattacaggcacacgccaccatgcctggctaatattttgtatttttagtagagacggtgtttcaccatgttggtcgggctggtcttgaactcgtgacctcaggtgattcacctgccttggcctcccgaagtgctgggattacaggcgtgagccactgtgcccagccaagtgtcctgtttttcttggggagcaaagcttgatccagctcattccagtctttagtgctctttccacttaagggctatgacaccatctggtggctccttgcctgctgtaagctcttgtacagccataatgggactctgcacttggtaggtgcaggtggagtctcactctgtcacctaggctggagtgcagtggtgccatctcggctcactgcaaccttcacctcctggttcaagcgattctcatgcctcagcctctcgagtatctgggactacaggcatgtgccaccacggccggctaattttttgtatttttagtagagacggggtttcaccatgttggccaggctggtctcaaactcctgacctcaggtgattcacctgtctcagcctcccaaagtgctgtgattagaggcgtgagccactgcacctggccagaacaac

SEQ ID NO: 29107 - DNA, 1049 bp, Homo sapiens
ctgggaggtggaggttgcagtgagccacgatctccccattgcactccagtctgggcaatgggagtgaaaccttgtctccaaaaagtagagagagaaaatagaaattgaaatgaggtgcactgggcactgaggcaaggctctggggttggagcagttagaatggtgtgcctttgcacatgtctccctttccaccaggacattctgctgtggccgctggactccggagtctgtgataggcctctgccagggaagatctctggcagtgcccctacacaccactccctactgtgcctgcctacctagaagatgacgtttctaggtggggaccaggatgccgttccaccctcactgcctgttgggcccttctccctgggtttgtagtctccctaacacctgtccctatccctacaggatgtgtgcccctgtgatggtggagctggagggggagacagatcctctgctcattgccatgaaggaactcaagtaagtcactcaaatcatggttcacttctccaaatctctgggaggcatctgttgggctctctgttgcaccctttgctcccacttgcctggctggagaagttgatgcttattcctacagatccttaggaacagctcaccaggaagtaggaggaagagagaagaggaggcagggaaagtgggagggcactgatgagacatggacgtcttctggctgttggaatttccctgttcctgctgcaggaggccttaccaatattctgtcattcttccccctcttgtctgatataaaaactttctttttcttgtaattgctttcttacaaagtacactcatcagccccaagaggctgctcctaagacttctctttgcttgtgttttgcacacaatctgttccttctgcggcagagctggggtcaccagccctcatgtacttgtgacttctcccctgccacagggcccgaaagatccccatcatcattcgccgttacctgccagatgggagctatgaagactggggggtggacgagctcatcatcaccgactgagctggagtcatcttcctgccc

SEQ ID NO: 29108 - DNA, 1081 bp, Homo sapiens
tgcacttgtttctctctctatatatatactatatatatagtaagagataggaggctgggcgtgctgggtcatgcctgtaatcccagcactttgggaggctgaggtcaggaattcgagaccagcctggccaacacggtgaaaaaccatctctactaaaaatacaataattagctgggtgtggtggcgtgcatctgtaatcccagctacttaggaggctgaggcacaagaatcgcttaaacccaggaggcagacgttgcagtgaaccaagatggcaccgctgcactgcagcctgggcaacagagcaagactccatctcaaacaaaaacaaaaacaaaaaaaagacagagtcttactacattgcccatgctggtctcaaactcatgggctcaggtgatcctcccacctcagcctcctgtgtagctgggactgcgggcgcattccaccatgcctagctttgtttcttcctgtacttaattcactcgttttcatccctgctcctctctctagactatgggcccctgaggccagggactgtaggcttctctggttagtacccctggtgtccactccagtgtttgacacaaagtaggactcagagcgtgtcctctgaaggcagagctctgctcactgagcacttcccatgtggcagacctgtgtgtgtcactttctgtacattaggaacacaggcaaggcagctgtggtgccaagcagatgcccgggagccaaactggggaagttcctgtttgtttctcatcagtaaaatgagagtaacttgccacagctgagatctgagcccaggcagtttgggtacctcatcacattgtttgcaaggattgagttagtatacataaggcaactagcacctagcacagtgcctggaacagagtagctgctcaattaaggttagctgttattatcattaatgaaaattaaacaagatagcttatgtctggcccatccatggccagacacggtatcacatgccatgtctcctctgtcagaatggctggtgggatttgggaggccgaggcgggcagattgcctgagctcaggagtttgagactgggcctgggcaatatag

SEQ ID NO: 29109 - DNA, 1057 bp, Homo sapiens
gagtttggtcaactcggccgcctaagcctcaggccctgtcatccctcagcacctgccgctgcccgctctgggactccctgaacacctgcgccagcctctcctgctgcgtgtgggtgatgggggtggagctggggacctggggtgggggtagtagccactctgacagcctcacctgtcccacacagtcgtactgcctgaaggtgaaggagatggatgacgaggaatacagctgcattgtgagtgttggagggggtggggggcttgtacttccccccacctggtctgccagggatagcaggtggctcaggccaacccgggagagaccggggggacttggctggactctcgttcctggagatttagggccatcttcccagtcccgctcgctgggcctcggggtgctgggcacccggccgggaaccactccctcagtctgggggactcttggagggaaatcggattttcttcactcctatgaggcgcttttaagtgtttgatttttctgctgtcgggatccatttcgtggccagtgttcattgaatgtggcagaggtttgggtttggttttttcctctcttcaaagctatcactgagtgcttctgagaaacactgaagtctcagaaatgaggtctcaggaatgaagaacagccgtggctttgaaagcacagtgcggtgcgaggccgtccctgagcaggcactcctgtcccacccccgccccaggccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacggtgagcgccgccctcctccccgtccgctctccatttcagaggtgggaaaactgaggcccagaggggtactctcagggccaggccacggcccagatgtaaagcccctccaggagcccagccatctgcccagagcctggcctgggtggagctggcctgtgcgcgtgggctccgtgggctgccatccatgatccat

SEQ ID NO: 29110 - DNA, 1042 bp, Homo sapiens
ttacttgattctcgcaatagccctgggtggtaggtgcaattattatctccagtttataaaagaagatactgagggtcagagaagttaagtgactggctcaaggtgtcacattcagtaagcgttgaaggggtctgtgttggtctgtccttgaagatgccccctacgactacactttcaatgatttctgccttgaacctggccccatgactaaaaacctcacgtcaaactcaggcagcaataacgggaaggcttggtgcctcccatcactggagcaactagtctagctggtcactaagtggacagcccctctgtttccctgcagtaactaattagcagaatagcacaaagataaaacccgaaggcctttgtgcagaagtttcagagacataagcaaagtgagagcattaggttctgcatatctttcttgttgttgttgttgagacagagtctcgctctgttgcccaggctggagtgcagtggcacgatcttggctcactgcaacctccgcctcccggcttcaagtgattattctgcctcagcttcccaagtaactgggactacaggcgtgcgccaccactcctggctaatttttgtatttttagtagagacagggtttcaccatataggccaggctggtctcaaagtcctcaactcgtgatccacccgccttagcctcacaaagtgctgggattacaggtgtgagccactgcacccagtcacatgtcgtattttaaaagggatttaaaagtatcattggattgtttgtaacacgaaggataaatgcttgaggggatggatacccattctccagcatgtcatgattacacattgcatgcctgtatcaaaacacctcatgtaccccataaatatatacacctactatgtaccacaaaaattaaaataaatggtgggtgagaagaaacactgcatacggtttcaaaaccatcagagaggccatgggaaaaattttaaaaatatatttacgaagtgaaacagccattctaagtatgacaccaaacccataaacttgaaaagaccgata

SEQ ID NO: 29111 - DNA, 1101 bp, Homo sapiens
ctcctgggctgaagcaatccttccacctcagcctcctgagtagctaggactacaagggtacaccaccacgcctggctgatttttcaattttttgtagagatgaggtctcattatgttgcctaggctggtcttgaactcctggcatcaagtgatcctcctgtcttggcctcccaaagtgctaggattactggcataagccaccatgcctggcctagcagcactatttttggtggtcaaaaactggaaacaggccgggtgtggtggttcatacctgtaattccagcattttgggaggctgaggcaggcagatcacgtgagcccaagagttcaagaccagactaggcaacatgacgaaactcccatctctattaaaaatgcagaaaattagccagcatggtggtgcgtgcctatagtcccagctacccatgaggctgagatgggaggatcacctgagcctgggaggttgaggctacagtgaacagagatggtaccactgcactccaacctgggggaccagaacgagaccctgtctcaagaaacacaaaacaaaactgcaaacagctcaaatgtccatcttctgtagacaagtaaattttgctgtgtttatacaatagaatattatccagcaatgcaaatgaacaaactataactacacacagctgcatggataaatgtcagaaacatgacgttgagtgtgagaagccagatgcaaacgaggactcactgtgcaattctgtgcatgtacagtggccaggtgaggcttatggagtgctgaaatgctctgtatcccaatctggagggtggttttaaaaaaatgttttgagccagtgcgttggttcacacctgtaattccagcactttgggaggccaaggtgggcaggtcacttgaggtcaggagttcgagaccagcctggccaacatggtaaaaccctgtctctactaaaaatacaaaaattagctgggcatggtggcacacacctgtaatcccagctatttacaaggctgaggcacagagcagggctctgtctcaaaaaaaaaaatcataaataaaaaataaaatttaaaaaatacttgattttaatttttttagagatgggggtc

SEQ ID NO: 29112 - DNA, 1048 bp, Homo sapiens
tttcataaggagcttgcaacctagatccctcgcatgcactgttcacaagggtttgtgttcctatgagaatctaacactgctgctgatctgacaggaggtggagctcaggcagtaatgtgagcgatggtgaacagcagtaaacacagatgaagcttctctcacttgcctgctgctgatctactgctgtgtggctcagctcctaacaggccatgggccagtgccagtccacagcccaggggttgagggctcctgttgtagcacctgagttgaccaacagttaatgtgtgggtggggattgggatcgggcccatgctcttttagttgtctgactgtgctttcagtattatttttgtagacgttggccccatcaggtatggtgagaataagctctctaggcctgtatgatgccttacacccctccttttcttttccagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggatttttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagc

SEQ ID NO: 29113 - DNA, 1062 bp, Homo sapiens
tccttccccgcagaagcccacagtccagcgaggaggtgcatgtgcagtgtgctgtaatcccaggaactgggacccttgtctgcccagggcctgggggtgggggatgacgggtgggcattagctggaggaaaaggtgggagatggtaaggcaggatcagagccaagaacaggcttcacgggggtctgtagccccagagataagcccccacccttccacagcttaagcgtatttcatgctttcactcactgcctcccgttgtcctgaagccaccaggtggctccagcctatcctgacctctggcttccttgacagtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaaggtatggccaggacagaccttgcctgcctccaggaagcaccaggggccactcctgttctgtgaccctgagtgcagggcagaggtttagtcactgccatgggagagctggacccactgaggtgtggcctcggtgccatctctctactcccttagaggtatcctgtggcctcctgtcctgggcagtggtggtgaccatggagaggagaaggtagggttagggtatgatcttcctccatagaaaactggtgacagaatgtctgggcccagccaggctcagcctccagggtgctgtcacaggttcctatggcctcactgggaccatgtctaaggtctcctctcagagcagaggtctggttggagtaagtgcagggggttatgggcgtgagttctcttggggcttaagctgttggtgtatcctggacacttgcccactgcagaccttgcccctggtcttggaggggcatttgatagaggggtttgacccctgctccgtacaaaggaggtactggccccagcctatctgagatcttggaatcagtctttggctggccttgcctccagaaaaggcccc

SEQ ID NO: 29114 - DNA, 1035 bp, Homo sapiens
agtgacccagtaaattcctggtcaggctagggtgaggaccacgcagcctgctcacgcatcttccgtccctgtctccccgctgctcagcacctctgctctctggccctgctcctgatgggccagtgcttctcaagctccttctctctctttcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagac

SEQ ID NO: 29115 - DNA, 1088 bp, Homo sapiens
ccggtgtggggcttaggccaatggtttgttcaaatgcaggctcctgggtcctgtcagccctaaggaaccagactctcctggggtggagactgggaatctgcatttctaactgacttaggagatcggatgcccactgaagtttaagccgcatgcactgcctgaggctccagctggccatggtagaatgcccgcgccctggcatgtgctggcggcggctcctcgaacgcctctcccggccttcctttcctggccacccaacccctcttgtgtaaagcccacctcctggtgtccttttccaggaagcttccctcatgctgcccttctggaaggtgccttcccctgtgctgacgtctgcaggatgcgtgttacaccccatttggatatcacatcttgagctgtgggaaaggagagcagggcttccctctctgaaccccatgcctggcagggtaagtgcccagggagcacctgctgcctggatggggagtctgcgccacttctgctagcacagcagcatcccgtacctgaaagtgaaacgtctgaataggctcgccgtcctgatcgtaagtgaacttgccaaggagtgtcccctcctgctgcaggtcttcgtcaaacccctgcaaagagagcggagggaagtggggaggggctggagcagggagaacacccctccccactccaatccctgctcctcccacccagcaggtcaggcaccagagtggcctatgacaagtcacttcactctcttgtgccacagtttctgcctccaaagcctaaggtaacagggactgaagtgctgtctcccaccctagctcctcctcttccaaatccactcccctcccttccagtccaagggtgaccctgacttgatcctcagtagagaggcccacaggatccccctgcagcccctctggccccaccacaggacagatactcacaaagatggcgaagtccttgggggcactggagatagtgctgttgggtgacaaggccttgggcacatgctctaaggtaacggctgtggggcggatgcgggcagagaggcggaccacggcgaagccttgtggcccctggaaggcccagcagttgcc

SEQ ID NO: 29116 - DNA, 1093 bp, Homo sapiens
gctgtcactgggttctggtcctggctctgactgtgtctccctcagcctcagtttccttctcctaaggcgagagcgctgagtggaagaattgtcttcagactcatccctacccccggtctggaccctcatgggtttggcgctgtcttccaggccctgcgtcctctgacgcgtatgtgcacatagatgcacacacatgttggcaccatggactactctgacctaccagggtagggtgctggcctcctgggtccttcctatgcatggcactgttagaattgtctatggacttgtctgcctcctgtactagaaagtaaactccgccgggcgcggtggctcatgcctgtaatcccagaactatgggaggctgaggcgggtggatcacgaggtcaggagatcaagaccatcctggccaacatggtgaaaccccgtctttactaaaaatacaaaaattagccgagcgtggtgggggcgcctgtagtcccaactattcgggaggctgaggcaggagaattagcttgaacacaggaggcggagcttgcagcgagccaagatcgggccactgcactccagcctggagcgacagagcgagactgtgtctcaaaaaaaaaaaaaaaaaaaaaacgaaagtaaactccttgaggacagggacctgtgatctcttgtttaccgctgtgtctctattatctatcaccatgtgctgggcactcaataaatacatttgtgaaaggatgagtaaaggtttgtagccaggtccagtgctcgcccttggcgtcacagaggtgagtagacattggctcagggataacctggaaccagagccttgaaattattctcccaggagcacagttcccaggcctccccagtggggattgctgtcttcccctccacacctttactactcctttattttattactgctgggcacgtctgtcttgttaccgagttggcattgattttagacggctggccctctgctttgtaagttcccagagggcaaggtccctgtataactgtccccactctagttagcatttgggaaacgctggttggattgtgacattgggagggaaaattgtaaatggtgcaggctgag

SEQ ID NO: 29117 - DNA, 1089 bp, Homo sapiens
cctccgtaggcttggatgctggaaagatcaagcaggtggggatcatctgtgggcaggagagcacccggcggatcggggattacaaggttaaatatggctacacggacattgaccttctcaggtaggtgccagcccagctgtcccctgtgcttgaaagaacagaaggtcctagggaggccaagatgggaggattgattgtgctgggaggtcgaggctgcagtgagccgtgatcatgccactgcactccagcctgggcaacagagcaagaccctgtctcaaaaaaaaaaaaaggtccagaaggcctggggcagacgcagactgtaggccccagtgacacatgtgcagtcaaagtagttcagagcccaggcaaactctttcttcctcccagagaggttggtttggggcaggttaggcccagcaggccaggagttgggtactgtagaaacaaggggtggagttgagctgggccaaagctgagggcagcaactagtgccacaagggaggcaggcgaagccagagttggcatgggatggacagaccaggcctgttggtcggtgctgcccatggctgcagcagaggtgtgagatgaattgtgtatttccctctgaggacacctcctctggacatcaccccagcgctcatggcagcagaatgggcagtcatcatcacacggccaagcccgtgcagagctctggatgtaccttcttttatgcattccctactcaggccccctgaggcagtcactgccatcaccccagaggcattttcataagaggaaactgaggcatggagacatcaggcagcccaccctggtcatggggcttgaacacaggcagcctgaatttggaatatgtgtccttaaccgtcaggtaacctgtatgtgaagtgttggttggggagataggcgcgtccacttgcctgatgccaatcatggcatttaatgtcatggccaaggctgttcccaaagccagagttcccatcaacagaggcctcatggcctagaaagtgcatgttagaactccttgccctcacgcgatctaggcaactgagtgtcgaatatttgtccctaatttgtggggtcctgtttcc

SEQ ID NO: 29118 - DNA, 1030 bp, Homo sapiens
tgagttggccgatcgctgtgctgtaaatcctccccatatggctgattttaagccacccatggcctaacaagagtgtcataatgggagctggtacgtgccagctttagtccccaggcattcagcgggtgcttaatagatgatggttgaatgaggaggaaaggatgcagagagtgttggtcagctagatttgggagctgcgggcgatactgtaggtgagaagggctttcagggggaggcatgggagggctggaggtgaggggccaccctgcaccagccctggggtgaggcttgagggaacggagagcttctggtgtcctccccgtcctgagaccctttgcacccctgaccctgacgcacacttgcactaacccctccttcgaggggctcctctccaccttggcctggccttggggttctgcacagaatgggccccaagcttaagccaatgagagctcagagatgtggcccaagcaggtcccaaacctcatgttccattcccttgctgtgctgttccctcgacttgaattcctcttccattcactgtcccctgtaactctgttgtccatcaaaagcttcctcatgacccccttcctctgtgacaccagccccacaacccaagtcagacagacccatctccccttctgctcttcccccgatgctacagcccctcccatgtacacgttcctgcctataaaaatatcaatagccagcatgtgttgtgttcctatggcagccagtgacagaggttccaggatagtcccctctacagatggggaaattgaggtgcagtctcttgttcacactgacccactcttttttttttttcttttgagaagagtctcactctgtcaccaggctggagtgcagtggcatgatctcggctcactgcaacctctgactccctggttcaagtgattctcctccctcagcctcccgagcagctgggagtataggcacgtgccaccatgcccagctaatttttgtatttttagtagagatggggtttcaccatgtgggccagatgttctca

SEQ ID NO: 29119 - DNA, 1483 bp, Homo sapiens
tctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaa

SEQ ID NO: 29120 - DNA, 1052 bp, Homo sapiens
gcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaagggtgagtgggccaccaccacatcgtcctggtgggatctagggttaggggcctcctacctttgtatctgactcacttggccccatcactcaaatgttttgcagaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccact

SEQ ID NO: 29121 - DNA, 1065 bp, Homo sapiens
cattgtggcgccagcctgcgcttcctgaactggccagagccgggactcaaccgatgcagcacgttagctttggaagcagacagtctctagactgactgactgtactgaaaaatgtgtatttcatgtcattttctcttgctttgctttaacctcctatttttcagaccttgggcttatcattcagggtgcttttcagaaaggtaactggaggctggagaggggcccctacttcacctccgtctggagaggcgtgatgctgttggataccctgtcgctggcaacccacctgcccagtacttgaatcttgaaattctgacacattgaatctggaaacattgccatatcctttagtttttcttttctctgtggctttggactttgaccttctcatttttatgttcatgccaccatcctgaatctaaatcatccttggtctatttctgggttatttaaatagctctctagtcagttgtcttgtttctagtttctccccagaaaacatttcctacgtactattttcttttcctttctttagcaacctgtccttactgtgtgaaatccaaacacctttgttccagccaagttcgtttactgctcccatttatcaactgtcatttctttcttttgaatctttgcgttctgtacaatcttttctctgttttccatattattttctctctttttgtccccatgctctataaaggtttgacttatgtaaaattttctccctgcttctggctgccaattcattgtcccccttactctcaaaaagccttctcgaaactttgtcttcctgaaagcctttcttaagtaacgcctccttcatttggatatagtttgttcttactgatatgattgtgatgataatgaattacgtagactttgctaattgcattcattagttctaatggcatttttatagatttcgatgtttttttaaacaaatatatcatttacaaagaaagacaaatttactttccagtctttgagttctaattcataccttaatgtcctggctagtacttcgagtaccatgctgaacagaagtgatacgagtgggcattc

SEQ ID NO: 29122 - DNA, 1455 bp, Homo sapiens
atcaggtttcaccaccaatgaattccagaaaagttttggttttcagaagtttttggattttggaattgtgggtaagggactgtagactatttactttcttagctctaatgtttgctagcatttgttactctctgaaaatggaacccactttcctttttttttctgctacaggatgtaagattaaatctgttctttctctataggccagttaatagaaattaggacacctcttcacaaagctcaataccttaggcagttgccactgtcccctgatacctccactagatacttcctactccttgctggctttatatgaaggatctcatagttcccctcttctcctctctcctttcggaggtacctcgtgttaataaatgctaagtaaaagagatttaaaatgtacagtacctcatgtaatatctatcctatctcaaatagaaatgtttcagaaggtgcaacatgctttctctggaccgacttttcctattaccagcgaatgtggaagcttaaaaagtaacgtatacttgtgtgtcatttggactttggtattaccataagggaatatatacttatgataacatgaaactccaaatggtacagaagtataaaggaaaagcagaagttttctcttgccctactgcgcccctcactcctccagcttctgaccacaaggtttggacccttttaaaataatttttttctttagctcagacattccaggggacagtttggggaattctgattaggcattataaccccacttggattgattttgtgttcattgtatgttaaattatggagatggccttttctgtgttaactggcagttatagcttttatttctagagcgatttgttcagattgcatggttttgaactgttaattaaatactttttgtttgtttcgagaccggatcttgctccatcgcccatgctggagtacattggcgcgatcatagctcactataacctcaaacacctaggctcagtcttcccacctcagccttttggaaagctgagactgcaggcatacatcactacgcctgactgatttttaaaaatctttttgtagagacagggtctcactgtgtttcccagactggtcttgaatgcctggactcaagcgatcatccaacctctgcctctcaaagcactgggattacaagatacattttttaagaatattaattgtgacagattgaaagtgtctgagtattattcagacacagagattgaaatataaattattgatctatttaatgaaaaataatttttaggagtcaaaaacagcatataatatatttgacagtgaggtttccctaacggagcgcttacttaagaaacggggtgttggctcattcaccaagtcagttgttctcaaggtaagcatgtgggcagtgggatgcagatgtcatcctactaattattcccaaggatgttgttgacattatttatg

SEQ ID NO: 29123 - DNA, 1092 bp, Homo sapiens
aggagggagaacagagaccccatccttacctgccccatcaggggagttcaccctggtgatgggtgaggtgtcaggtggcatagctgaaccatccttacatctcactggggagtttggactgtgttgtctgtgggctggaaggcttttgaacttgttgaacaaaggaatgacatgatcagatttattttttattataagagcaatttatgctctttgtaaaaacttgatgtttatgaagtagaaaatggaaaattcttgcatcctattcctcaggtgtgtcctttttttttgtttttgtttttgttttaagacagccagacagggtctttctctgtttcccaggctggagtgcagtggtgtgatcatggctcacttcagtctccaactactgggctcaaacagtcctcctgcttcagcctcccgagtaactaggactacacgtgggtgccaccacacgcggccaatttttaaaaatatttttgtagagattgggtcttgctatattgcccaggctggtcttgaactcctggactcaagtgatccaggcctcccaaagtgctgaatttacaggtgtgagccactgcactctgccaaaggtacctatttttaaaggctgttggatgtcttgccagacttttctccatgctttcaggtatatcatacacacacacacacacacacacacacacacacacacacacacacactgtattatacattgtatacattatatatacacgcagataatgtataatgtaatatatatgttttatatatttatttgtatatttttgaccaacaggggattaagatatacaaaatgttttataatggcgtatcttatttacttatttaagacagggtctcgctatgttgccccagctagcctcaaaatcctgagctcaaatgatcctcccacctcagcttcccaagtaactgggactacaggtgtatgccaccactcctggctggctcttattttaatctaacaagtagttgttagattaaaacaactttaaataaatacatttgtatacttgtgaggtgtgtgtgtgtgtaagtgtatgtaaaatccacccttagagggggaat

SEQ ID NO: 29124 - DNA, 1073 bp, Homo sapiens
ttgagactgggtcttactgtgtcatccaagctggagtgcagtggtgtaatcatggttcactgcagccttgacctcccagactcaagcaattctcctgccttagcctctttagtagctgagactacaggcacatgccaccatgccccgttaattttttacatttttttgtagagatagggtcttcctgtgttgctcaggctgatctcgaactcctgagcttaactgatcctcctgcctcggcctctcaaagtgaagtgctaggattataggagtgagccaccacgcccggcctagaggaattcttgcagccggcttgcagtttagcaggacctggggattgatttaacccaagatccactgaacattcccaccccttctatgaattccaagactagtttggctgctctgaaagagaagagagaaaactggagtggttcacagttttactgctgcagctgtacctgatcagatggtaggattaccgtgtagttctgagcatttcaaagcagttgtggaggaatttgccgctatttataccttggaaggaaaatagtgctgtaggtaacttcaactagataatttcaaatgttgattttataattaatttttatgtttattttgaatacgtgtgtacctgatacagaggttcacagcctggcagagaaagtaatgcagctgttctgtaaaacctggattcaagagtacttggaaaactgctcagtttccctagcctacctgtcctctaccttaattctttttttcccctcccttctgaatacaggcagtgtctgagactcactgccaagcaggctagggactgagtgacatggtctctttctagccttgtctgttaaggagacatgtaatgaacaactttacagggttggcacactatttggactaatgatagatccagagaagaggctgtgttttaacctaagcgggaaactttaatcagaatagggaactaaaaattagtgttattctcttgatagtctctgcggttgacaaaaaattaatgaatccagtcgtcctctgaagtgctgagggtcagacataaccacgtagcctcg

SEQ ID NO: 29125 - DNA, 1999 bp, Homo sapiens
atggcataagcctatttttaaaaaaacaggtggaagttctgtactataaaggatatccatttctcaaacaaaccagtctttatctttaaaaacctctctagtaacccttatcctgaatcagcttatttaggtattcaggaaatgttgctgggcagattctcctacaagttttatgttatacaaactgtacttctttgagagtttcaaacagccccagcaagttggaatgccatgtgtcgtatccttaccattctcccttgttttgttttcacaagtctcatactgcctggccttttcacagatgaattctgttctatttctgttttcttctgggcctggtcagctattacatactgaagtgataaagcagaaatcagtcgtctcacaaggtgctgtgagcaaaggtgctgtgttcttttgtttgaggcaacaacaataaaaatatttacaaaacaaattttttttaaatctcagaactgcagttggcaaatgattattactatactttgtaaatatgattcagtctggatagggaatctaggaactgagtaatttttttgcgtgtgtgacagagtctcgctctgtcgcccaggctggagtgcagtggcacagtctcggctcactgcaagctccgcctcccgggttcacgccattctcctgcctcagcctcccgagtagctgggactacaggcgcccaccatcacacccggctgatttttctgtatttttagtagagatggggtttcaccgtgttagccaggatggtctcgatctcctgaccttgtgatctgcccgcctcggcctcccaaagtgctgggattacaggcgtgagccaccgcacctggccggaactgagtaattttttaataaaagtaatgtaatataagcttgtcagaaaacattcaaacagcaattgtgactgtagaaataaaggtgagacctggccaggcgcggtggctcacgcctgtaatcccagcactttgggaggctgaggcgggcagatcacgaggtcaggagatcgagaccatcctggttaacatggtgaaaccccgcctctagtaaaaatacaaaaaattagccatgcatggtggcgggcgcctgtagtcccagcaactcgggaggctgaggcaggagaatggcgtgaacccagaaggcggagcttgcagtgagccaagattgtgccactgcactgcagcctgggtgacagagcaagactccatcttaaaacattaaaaaaaaaatttaaaaatttaaaaaaaaagaaaggtgaaacccttcccttcctaatcttcctaaacattttctgtacatttttaaacaacaattaaattgatttttctcccaatatcattcttctaagacttaacttttgtaatttgagatattttcagtctatttctttttctttttttttgagacaaggtctcactctgtcacctaggctagggtgcaatggtacgatcatagctcactgtaatcttgaattcctgggctcatgggatctttttgcctcagcttcctgagtgcctgggactacaggtacataccaccgtacccagctaattaaaaaaaattttttttgtagaaatgaggtctcacgttgttgcccaggctggtctccagctcctgggcccaagcagtcctcctgcctcagccttccaaagtgttgggattacaggcatgaacctccttgagcggcctatttcattcttttaaacgtctgtcaaacattctgttgaatggatatactacagtcattcttctctaagagatattttgggccaggcgcggtgactcacgcctgtaatcccagcactttgggaggctgaggcaggcggatcacctgaggtcgggagttcaaaaccagcctgaccaacatggagaaaccccgtctctactaaaaatacaaaattagctgggcgtggtggtacatgcctataatcccagctactagggaggctgaggcaggagaatggcttgcacctgggaggcggaggtt

SEQ ID NO: 29126 - DNA, 1033 bp, Homo sapiens
ctttttaaatttttatatagcaaaatcagcctttctggctttcatgttttatgcttgccttgagaagtctttcctatcctaacctgataaaatatctttaggttttctattttagtttttacatttagatgtttaattgattcactactcagttttgtatatggtgtgaggcagagatctaacttaatttttttccaaatggttctcattcattggtattagcctgtacaaacagcccatttcacttacagaggctggtagagcacatgactaatgtaacttactcaaggtcacagagcagattcttgtaatgattaggactaaaattatgtaattagctgatctgtgccactttctttatctccccatttaacgttttgaccataggttcccaaaacctcaaaaaattattttctgtgatgtttatttcaatagaactaagttctattaagaggcagattaggtagctgtatatgtagaaagctcttgaaaaataattgacttgtgatattgagaaatatctgtgctaaactattaatattctagatcagttgtgctgaattctggtatttgtatgtgaataagatttataatgtatatagctgtaaacactttatgtgtattgtttccatggggtttatttactattagtctatctaatgtaatcatttttctgggatattgtctttgagaattatattagcaaatcagacaagcaaagtttattgccatataattactacattaaaattacacagctttaattgcatgacgtgtttactgcaggagtaaatattaaaactatgacagcttttaaaaaagcagctaagcaggtacttgctcatagattgtgtttgaccatgctttttgagaggtcattatagataaaatgcagacgggcttttgatttggtcttatttatatttgtgatggtctaaaggtttgtgggaagatcacttgttctaattttgaagccaaataccaatttttattttttttgagacagagtttcgctcttgttgcccaaactgga

SEQ ID NO: 29127 - DNA, 1082 bp, Homo sapiens
cacatgcagtgtctgtaggcggagagtatgagataacagcatttcacaaatgaaagtgagtggaaaagggctgcttcccctttaaggcagtctcagctccagctccctcccctttcctgattgacaaacctacccgaagtcacatgatctgcctctatttgaaggtcacaaaaagctgcttcctttagagacagagagggagagagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgaggttggtaaatattttcaattttttttaaccaattgatttatatggatcttgtctaaccgttttcactggtggtgttgcaaatcgacatttgtctagcatggagactggcttcagacatttcgtggatctgtgtaaatcagacccgtgatgtactttggttcggcattttagaaatggaaaagacgtggtaaaatatttagattttgaagtgatttaattgcacttttaatgtatatgcagattttcatcatcgtttctatcttgcaataaatgaagctgcgagtaattggaaatttgctatttagaaagaggtttttaaaaaacacagacctccccctccccccttaaatctgctgcaaaaatttgcataaatataaatgggtttgcattctttcggctgctaaggccgacaaaggatctgggagggcaagccctagaacgggaaagcctttttctatctttttattttttaaactgggccctccttcctagagagatgtaaaacctaaagtaagacctaatacattttaaacatcaggttgggggcgggtgaacaccaggaggtttggggtttgtagattcccctgcttgaaaacctcccaagcaatatgtggctcacccctctcctttctgcgcgcgctcatttgcactgggtctctgtgtgtgttctcaaatgtgca

SEQ ID NO: 29128 - DNA, 1052 bp, Homo sapiens
aattggtcttagagtttacaaggcaaaggagaacattgaatacagcgttttctccctcattgtgattattctgggcccacacatgtaaattctgtttatttgactaaattattactaggttgtttttttttttttaatatgagatggagtcactctgtcgcccgggctggagtgcagtggcgtgatctttgctcactgcaacctccgcctcctgggttcaagcgatgcttttgcgtcagcctcccgagtagctgggattacaggcgcctgccactacacccagctaattttttgtatattttagtagatacagtgtttcggcatgttggccaggctgatctcgaactcctgaccttgtgattcacctgcctcggcctcccaaagttctgggattacaggcatgagccaccgtgcacaacagccagttttgactcaatgggcaaaatgaaaatttaggtccattgcccactttatacaatgctgttgaattaatatgggtgacagaaaaatggctttcattcattgacgttggaatttgttttttaaaaaacttagaaaatgatctgtttactcattcattctgcaaataattactgagtgcttttcacatgccaggtgttgataagtacaagtacaagcctagcagtagtgtgaagattttctccagacacgactgctgaagttagagaatagatgcaaggggctggctggtgctcagggtgttggggggttaaaaagggtggacacctagagagataacagcttctgcaaagaccacggggcactagtggacattggcatatttggggaacagcatagagagtactttgacatggttggagtgtcgtgtgcttaagggaagaaataatctgagaaatgagaggtaagctgaaaaactaagccttgaccagatgcagaagagtgtataagccacgtttgaaagtctttttcctgagaacagttgaagggttttaagtgggaaagtcacttgttcagattggatttttgaaagacgattctggtgtgttgtggaaactggctgggacattgca

SEQ ID NO: 29129 - DNA, 1046 bp, Homo sapiens
tcaccttcctcagccctctacttttcatccctattcgcttcttaataaataaaagcgaatcaaaaagacagcaaagagaaaggagaaacattttataatgcagagttttgagcaaaatacttaactctgtgtctttatatgccaccacatctctttaatttttagaggatatgaatattttgtcgtttgtatttcataagccatctgtactgtgttcagactctgtgggttctttgttgtttaattataggaaaaggaggtatagggcaggaactttttacatacttgtgaattttggtcagtcctgtgaaatgtaagcctctggcatttattcacggaccattgggataaaccaggcatgtaggttcaattttttttgcctttgttgggatgctgtggccagtagccagggccagtcattccagattcatcccctgccactctagtccccagggactaacagagtccagacagtgtacattttcctggctacgggcttgaccttctgcttcctctgtcccactgcattccaaaaatgctaacaagtgactagcgagcgtaaattttatgtgttgcaaaagcagttgtggaacttgggtttcaatgtttgcaccactatttgtaagcaggatgttatctctaaatgatacatgtgtaactgacccaggggggctgcctggcctccttgatgctcttctgtgagaataattgactctggtagtgacagagctgcctgcggctactaagaagctctgctgtacttaggccacctgccattgttctgtctctgctgctgctgctgctttttctatttttaataagttgccaattacttggtttttatagtgataccaacagttcactaaaatgggcataggaaaaatgtagttggtttctaaccttcaatttcacttatccagtgaaattaatgacattaaacactttcatcagttattattgtgaaagtacaggtacatttttatcttactgaacatcatggtttagtttttccattttgaagacagtatacaactatgtagctaaga

SEQ ID NO: 29130 - DNA, 1025 bp, Homo sapiens
actcataaaattggcaaaaattaaaagaattaagaaaataccggccaggagcagtagctcacacctgtaatcccagcactttgggaggctgaggtgggcagatcacgaggtcaggagatagagaccatcctggctaacacggtgaaaccccatctctactagaaaaatacaaaaaattagccgggcatggtggcgggcgcctgtagtcccagctactcgggaggctgaggcaggagaatggcgggaacccgggaggcggagcttgcagtgagctgagatgcgcccgtctctccagcctgggcaatagagtgggactccatctcaaaaaaaaaaaaaaaaaaaaacaaaaaaacaagaaaaaaacaagttttggtgtggttatggaatagcaggagcttttacttttctggtgggagtgtaaattgttgaaaccactttggaaaagagtgtagcaatgtctagtaaagttggaaaacatggacactctatgagccagcagtttcagttgtgggctggtaacctaccccacagaagagctgtatgcatgtacaggaggcatgccctaagatgtctgcagcaatgtggcttgtcctggcaaaaattggaaaccttaatgcccatcagtaggcaaatgtataaatacagcgtggtactctttacatttacatgaattttagggacatagcattgtgtgagaaaaacaagttgcagaagaataaagtaataaaattccacttaagaaactcagaaatacaactgaaatgttgtttaggttaccaagcatggtgtggtcaatcaagggagtgctaagttaaggggaagttaacgcttgtggagtagggaaaggtgggattatacagggggcttctgagtaccggaaaggttattccttaagctgagtggagggtatataaaagttattttgtatgtattaaatatgtaataaaaatttttctccagaagttttattattttttaagagtggaaaaataacacaaatgtcatctccatccaaaaagtaattc

SEQ ID NO: 29131 - DNA, 1093 bp, Homo sapiens
tcgcttccttcccccacctgaaagggtttaactataaaacagagatagaaatatctgtggtacaagttcactacacagatcaagtagtcaagtgagatgagacagacagtgagtaagaaaaagctgttgtctctcagattctgtgggaatataggcacagatgatgctcatcctaacaccaggcattggccccctcactgagcaagcctggtaatgttatttgttcaacatgcaaaatttgatctttaaaaaacagctttgaaagtaacatggcttggacagtctttttcttaaaattggtaagggagtttgtatatcagtttctgcttctctattcattgaaaactgttaacactttggtaaaaattattttctttaccattttatacgcacagctttcagttgttaacactggtgtagaatctaaactcatttacactatttaagtttgcccctttgactgcagtggagacggtgttagggcttaaataaagactggcttcagaaactattaacatattgttggtagcaaacattcattgataaccgtctttcctagaacttaattaaattgtaaggaaaatattctttacctgtcaccttagtccaggaacctggaaatatgcttgaccagagtttcaaaaccttggaaatgacatttggggctgggtaattctttgttgtgggggccatccagtgccttgtaaggtgtttagcagcctcctaagccttctacccactagatgctattagcaccctgccacctcagtcatgacaaacaaatgtctctatatattgtcagatgtctcctgaagggcagaatcatccttgctgaaaaccactgtcttacactcttctttttcacttccctcccacatttagtcagttaccagcccttttaatactgcttcctgaatatcttagtgagatttcttcttcatcttcttcttcttttttgagacaggatcttgctttgtcatccaggctggagtgtagtggcatgctcctggctcactgcagcctcagcctcctacgtagctgggactacaggtgtgtgccgccacgccagctaatttttttattttttgtagaa

SEQ ID NO: 29132 - DNA, 1275 bp, Homo sapiens
tccccttttcagtgactagttaataactttatgtctagttaacaattttttatattctttgtatgacaatctgtatgttaagatgatgagtgtgatttctgtctcctatgtggacctcgactaatacctcgtgaacagagccaccagctcagcatgggctgcatctcagcttctccttcatacatgctctgttctctgtagccagtgaccttttgaaatgtaaatctgatattcctccccttcagatccatcagtggattcctatgctctcaggtaaaagaagaaaattcttgcagggacgtgagtggtctggctcatttacaagcctggtctcatctcacacttcgcttcccttcatctttgtgatgcagccacacaggtcttattttagctcctcaacagccacattgctttctgctgcatagccttggcccatgccgttccccctagttagatgccccgtctgcttcttacctagtcagctttttctttcttgggcctcagtttaattgtaacttcctggggaacacccttttggcctccctggcaaggtctgttccccgaccgcatgcactcccagcccctcatttcccttatggcacccacagtctccgtgagcatttgtatgtgctactctctacagcaggcctctttccccacctgcactatttagtttcatgagtgcaggaactaagtcagtgttttttttcttgctgctgtgccccagagcttggcacattatatatgctcgataaatatttgttgaactaaaagtaggaagagaccatttggtgaatcagtttttaccataagcgtgaatcccatgaacccaggacgcagaggttgtagtgagtctagatggcgtcactgcactccagcctgggtgacagagtgaaactctgtctcaaaaataaaaaaacagaaacaaaaacgcaacacctctatattaagtggttctttctaattttttagaaagtctctcttgctgtgcatttaactacttcagtaaaaatactgacaaggagccaaaccaggagaaaaaatctacttattaaactggaaataatgtatgttaggttgctgccttctctagtattcatcgggaaagataatattgaaaacgtacatactcagttgaaacctaattctcatagtggtttctgtattaccacccctccttaaaagacaaacatgaattatcctacttcgtttccttgagttgccatcagtcccaaattggaggttttgataccacgaacccacagcgcacaggta

SEQ ID NO: 29133 - DNA, 1022 bp, Homo sapiens
gtttttatttaaattcgagataattatatattcaaatgcagttgtaagaaataatctcttttatccttttatgcagtttcccccattggtaacatcttgctgtattctctctctctctctttttttttttttttttttttttttttttttttgagacggagttttgctcttttgcccaggctggagtgcggtggcatatcagctcactgcacccttacctttgcctcccaggctcaggcaatccgcctgcctcagccttgtgagtagctgggactacaggcgtgcaccaccacttccagctaatatttatattttattgtagagttggggtttcaccacgtcacccaggctggtctcaaactttgggacttgagcaggccacccgccttgtcctcccaaagtgctgggattataggcatgagccaccacacccaacctgtattatatttttaaaaattgaatgcctctagtttaaaaaggtatatagttgtgttacagccaatagcatttccttctctgactcagtagtaatactaggtttttttttttgaaacggagttttgctctgttgcccaggctggagtgcaatggcgcaatctcgactcaccgcaaactctgcctcctgtgttcaagcaattctcctgcctcagcctgctgagtagctgggattataggcgtgtgccaccacacctggctaatttttgtatttttagtggagacggggtttcaccttattggtcaggctggacttgaactcttgacctcgtgatccgcctgccttgacctcccaaagtgctgggattacaggcgtgagccactgtgcccggccagttttttgttttgtttcaaggaatctctgttcacatataaaaaattgcgtaaaagccccccttttcttacgtacatgatatcatcaagtacacattttttgcatcttgcttttaaaacttaacaccttatcttgaagacttatcttccttagtacaaaaagaactgcttgttataattgcatagtattctct

SEQ ID NO: 29134 - DNA, 1029 bp, Homo sapiens
atcacttgataacaggaattcgagaccagcctggccaacatggcgaaaccctgtcgctactacaaaaattagccgggcgtggctgggcgcgatggctcacgcctgtaatcccagcactttaggaggctgaggcgggcagaacacgagatcaggagatcaagaccatcctggccaatggtgaaaccctgtctctactaaaatacaaaaaattagccaggtgtagtggtgcgcgcctatagtcccagctactcaggaggctgaggcaggagaatcgcttgcacccaggaggtggaggttacagtgagctgagatctgctgcactccagcctagcaacagagtaagattccgtctcaaaaaaaaagaaaaaaagaaaagaaaagaaattagccaggtgtggtgcctcgttcctgtagtcccagttacttgggaggctgaggtaggagaattgctaaaccctggggccggaggttgcagtgagccaagatcgcgccactgcactccagcctgggcgacaaagcaagactcgtcacaaaaaagaaaaaaaaattatcagccggtcgcggtggctcatgtctgtaatcccagcactttgggaggccgaggagggtggatcacaaggtcaagagatcaagaccatcctggccaacatggcaaaaccccgtctctactaaaaatacaaaaattagcccagcgtggtttcatgtgcctgtggtcccagctactcaggaggctgaggcaggagaatcgcttgaactcaggaggcggaggttgcagtgagctgagatcgcaccactgcactccagcctggcagcagagcaagactccgtctcaaaaaaaaaaaaaattatcttactttatttggtttgagtaattccagacaagccaattccttgcatatgccttaaaatacgtaaactgggaaattcatgaaaagcttggagtcagagggctatgtcggcaaaagtctattgccatatttcatggattctgagcctcacgttcttttactcacttgacatctctgaagt

SEQ ID NO: 29135 - DNA, 1069 bp, Homo sapiens
ggcaccctgtgaatcgaatgcatggcagcttgacagagagagagcactttgtttgcattgcttgatgtaaagtccaggaaagccattcattatataaaccactgggattagtcaaaagatgagagaggatcctagtatgcgatgtgtattggtgattcttggaactgaggtttagtgttccgtaagtgtgtgctcttggcataagggctaacttaactgctgttgcttattattttgggggccttttttccttctcagactagagtgttacaaatttgagcctccatagttccaccgtcatatgtgttcagggcataattggacatggggcttgtgcgaaggcgaatctttagatgcctgtgttatgtttccagaatgctaggaggatagagaaaatgatttgctacattgcaatatagaatcttcggaggattctaaaataatactatagtttttaaattagatttttaaactcagtatttctttttgtgggccctggattttgagctttgttaaaaactgtatgtagaaataagggatatttagctgaaaggttctactagaagttttgagagtttttggccgggcacggtggctcacgcctgtaatcccagcactttgggaggccgaggcgggtggatcaccaggtcaggagatcgagaccaccctggctaacatggtgaaaccctgtctctactaaaaatataaaaaaattagccaggcatggtggcgggctcctgtagtcccagctactcgggaggctgaggcaggagaatggcgtcaacccaggaggcggagcttgcagtgagccgaggtcgcgccattgcactccagcctgggtgacagagccagactccgtcttaaaaaaaaaaaaaaaaaagttgtgagagtttttaatagatgaatactaagtcaactaacagctaagaaattctaaatatcttttaaagtttattaacagatttcaacttaaaatgtcttttggggtgatattaaaattcagagcttgaataccattaggcattggcaaagataatgaattgatggttgtcaccagtaggatgcttta

SEQ ID NO: 29136 - DNA, 1033 bp, Homo sapiens
tctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaa

SEQ ID NO: 29137 - DNA, 1047 bp, Homo sapiens
gatctgcccacctcagtcttccaaagtgctgggattacaggcgtgagccaccgcacctggcaacttttctattttagtctcttactgtgcctaatttgtaaattaaactttgtcttaggtatgtatgtataggaaaaacatagtatacttagagttcggtactattggtggtttcaggcctccactggggggccttggaaggtgttcccctcagataaaaggggactactttatctggataatgtttctttcatcacctaaaatttatctagagagcatctatcctaaaaagtctgttgtggcatatgctgacatgcttgtgtaatctattgttacttataaaacaatgctaagagcatttctgtgatcattttctgcaaagaactacagagaaactgcctgttttcatcctgcagggtgtctaccactgccaccagtagtacagctttttaatctattcaatagtaatctgtttatcttccaaagaaatgaactgaaatggtggactgatcttaaatacctatttaagatcttgatgggacaggcgcggtggctcatgcctgtaatcccagcactttgggaggctgaggcgagtggatcacaaggtcaggagatcaagaccatcctggccaacatggtgaaaccctgtctctattaaaaatacaaaaattagccgggagttgtggtgtgcgcctgtaattccacctactcaggatgctgaggcaggagaatcgcttgaacctgggaggtggaggttgcagtgagtcgagattgtgccactgcactccagcctgggcaacagagcaaggctctgtctcaaaactaaataagtaaaaagatcttgatgcaaaataagttaatcagagtgaataagtttgttcatccaactcataggttaggaaaattgtccctaatcgctgaagatcttaagtggtgaaagtctaactggggtgaggggtacagcctttggtcaaaatgcctgatgtcagcacaggacatagagaagtaggcagaaatagtctcaccttgagatgggcaaagtagggg

SEQ ID NO: 29138 - DNA, 1755 bp, Homo sapiens
aatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttat

SEQ ID NO: 29139 - DNA, 1084 bp, Homo sapiens
caaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagcatttactattgtggtttcctgttttattctgccagtttaatttgctcatttgttgaatgtttatatattttttcttattcttctctccctgctccacatgtaaaagctgtcagaaattcaacatttgaatttgggccgcaactctgtctaccttgtcttgtcatgtttttgttag

SEQ ID NO: 29140 - DNA, 1075 bp, Homo sapiens
gtcaaggtgggcagatcccttgaggttaggagttcaccaccagcctggccaatgtggtgaaacgctgtctctactaaaaatacaaacattagccagatttggtagcatgcctgtaatcccagctactcaggaggctgaggcaggagaatcacttgaacccgggacgcggaggttgcagtgagccaagatcgcaccactgcattccagtttgggtgacagagcaagactccgtctcaaaaaaaaaaaaaaagaaaaaaatctaaatgttcaataataagagaataagtaaggcatagtattcatacatccataggttggaataacatgcaaccatttaaatgatgcttacaagatctaatgtgcaaatgcacttaggtttgtgttatggtaacaaagacagtttataaattgcacaaaaattggttgaaagtacaccatgatgtaaatgttgattactctggtttatgagataataggaaaattaaatttctttctactttttgagttttgttttgtttttggagagggagtcttgctctgttgcccaggctggagtgcagtggtgtgattttggctcactctcactacaacctctacgtcctgggttcaaatgattctcccgcctcagccttcctagtagctgggactacaggcgcctaccaccatgcccggctaatttttttattgtttggagagatagggtttcgccatgttagccaggctggtctcaaactcctgacctcaagtgatctgcccacttgagatccgcccacctcggcctcccaaagtgctgggattacaggcgtgagccaccgcgcccggcctagacatttcatataaacagaatcgcatacaatatgtgaccttttgtgtctggcttctgttgctgttttcaatatccatgttgaatcagaacttcggttctttttatgactgaaaagcgttccattggttgtaccatgtttcatttacccaattgtcaacaactgatggacatttgggtaatttctactttttggctactatgaataatgctgccatgaacaagtccatgctaatttacttctttctttgc

SEQ ID NO: 29141 - DNA, 1029 bp, Homo sapiens
ctgctaaaagaccctagcaacagtttggagagttggctgtaaggagacagggatcatgtcagaacaagttaggggctactttaaaagtctgaggccacattggtgcagtggccatgtaaatggagaggaaggatatagatccagagtcgaaggcagactggccagcccagccctggtggttgaccggagtgagtataaagagcttggtgagtggggcgctactgccatttactgaggcaggagctacaagggaggaatggcaggtatgtaatggtgagtaggaggaatgagaaagtggctgagttcagtttggggattgaggtacccatagatcaaccaggtggacgtctcactcagtaggtatgaggtctggcacttgagcaagtggtctggcctagaggtgacagatttgagggtcgtgaggttattggggtaatcataagattgaaggagattatccagagagtacagtcagtagggcaacttgttgggacacacactgcatttcactgaaattatttgtttaaagacatactgaatggctatttgttttctagacggatctgtttggccgaggcatttcttaccgcagatactatattgaatacgctgcagaacatttctgaaggattggtcgtgtaccccaaagtaagaagcctcaattcaaaagtaaagtactagggaggggttagaatgtgggagggagggtgctctggggtgtgttgagggagctgtattctgatccgataggcattcttcccacccgagctcatccttcagttcataagctctagggaactagctctgtggaattcatagacacattatagaaacagaaaaagaagtattttaaattgccttaaactatctagcagcatgaatcatcagctctggtgtgactaggcagagtagatgtctccatttgcctgtttttaagtacttgaggcagatgggttcatttctctcctatacttagctcttgaggctgagcactgatatgtaacaaataggggttttaagaattctttc

SEQ ID NO: 29142 - DNA, 1038 bp, Homo sapiens
gaggcgggcagatcacctgaggtcaggagttcaagactagcctggccaacatggtaaaaccctgtctctactaaaaatacaaaaattagctgggcgtgttggcgggtgcctgtaatccgagctactcgggagactgaggcaggaaaattgcttgaacccaggaggtggaagttgcggtgagccgagatcgtgtcattgtactccatcctgggcaacaagaacgaaactccatctcaaaaaaaaaaaaaaaacctcttcctatgtggcaactttttttaagttaatatttcctttttaaaaatcaaaagtctgacagggcgcggtggcttacgcctgtaatcccagcactttgggatcacgaggccaggagatcaagaccatcctggctaacacagtgaaaccctgtctctactaaaaatacaaaaattatctggacgtggtggcgggcgcctgtagtcccagctactcgggaggctgaggcaggagaatggcgtgagcccaggagacggagcttgcagtgagctgagatcacgccactgcactccagcctgggcgacagagtgagactctgtctcaaaaaaaaaagaaaaaaaaaatccgaagtctgagttagtaagaaaactgaaaaaacatcatatagaataaaacaacttgttactctccataatgtggtagttagtgtctgtgctgtgcattttgtttgacatcctgctgtgtttatgactttaaccttgaggcacctttcttggtcattcaccgtatcttttcctataggtaattgaacggcgcattcggcaagagctgcctttcatggccacagagaacatcatcatggccatggtcaaagctggaggtagccgccaggtttgtaacccctcatgttcctggataagttgagagtgcacgtttggtcctgctctcttctccgtgaaggagagcagatgaaggtgtttatgtcattaccttcagtcacagtaatggtacagagcagtggccataatctgccatctatggagggtgattttggtgaactgaatt

SEQ ID NO: 29143 - DNA, 1049 bp, Homo sapiens
ctccctgtccccccccccttttttttttttttttttttttgagacggagtctcgctctgttgcccaggctggagtgcagtggcgcgatctcggctcactgcaagctctgcctcccgggttcacgccattctcctgcctcagcctcccgagtagctgggactataggtgcccgccaccacacccggataattttttgtatttttagtagagacggggtttcaccgtgttagccagatggtctcgatctcctgacctcgtgatctgcccgcctcggcctcccaaagtgctgggattacaggcgtgagccaccgtgcctggccctccctgtccctttttaagcgtggaggtgtgtggtctgggaggggagagggtgaggtgtctattgatcagatatgggtaataggttaacataacccatgaccagaacattaaaaggctgtaaacaaacaattgcttcaatataaaaacgcatacctcgtgaatttggaaacatgtcaggttgatagaaaagtgaactcgggtagaacctcacagaaatgaacccgacattagggtgaaatattgagaagggaagggaggagataatcatctcttttattttacagccatctttctatgcctggagtggatgtaggaacagcctgctggctcagaagcttaaaaaaagctctgtgtgttttcagtttttctcttcttagttctcaatgaaggttttggcaggagcccaaaatcttgtacatttgataatttaacatcagtttcatctgcttactctccagatagcctgttattcagctggtgacgtcagtaattttccacagcagccattcatgagctcatgcagactgtcacaaggaaatgggaatagcacaatgagtgttacagaagaaaaaaagatcctgtttctttgccatcacatattatacacagacttagggaatctagactggagcacaagatatgtgggaggggttagaacaccactcctacctgtagtaataatcattgaaaccacttattggatgccttctgcttaccagacactagtt

SEQ ID NO: 29144 - DNA, 1058 bp, Homo sapiens
acagcaagaccctgtgtatattaaaaataataatatggccgggcacggtggctgatgcctgtcatcctagcactttgggaggctaaggcgggcagatcacttgaaggtgggagttcgagaccaacctggcctacatggcgaaaccccatctctactaccaaaaatacaaaaaattagccgggtgtggtggcgcatgcctgtaatcccatctaccaggaagctgaggcagaagaggaacccaggaggcggaggttgcagtgagctgagatcacacactgcactccagcctgggtgacagagcgagactctgtctcaaaaaaaaacagaacaaaaccaataataataatctaatgggttgttgtactgaatgaactgtaaagttctctccaattctgagatcgtgattctctgattgaaatctaaatctgcagactccgagacctagagttctttttagaagatttacctgcttttcctcacttttccaacctagtctcttatattcccgcttcaccacctatgtgctgctctttgtttcggacctctgcttccatcagctcctcaccttcttcaggtgtttgctcagatttttcttactgagccttccctgactacctaatttagaatagcagctcctgaaagtgcctatggttcttcctgcctcattttactctgtagcactattcatctgacatacagtgtggtctcttattaattttttaagttacttctttcccctctagaatgctgggactttcaaagaagggatttctatctattttgagcacttctgtgttcccgacacttaaaacagtgcctggtacataataggcactcaataaacatatgttgattgaatgagtatttcctcaacacaaagtcaccattgggtctgctttgtgttctaggagaatatctagctcatgctgtccacttcgtaccttttctctgttgcttcccttactcgctggtgcctttctcttttcctcttctctttggatcacagcatttcaagactagaagtctgagatcacctcttcataaggaccagagtccct

SEQ ID NO: 29145 - DNA, 1030 bp, Homo sapiens
gccgggaggtcgagagagactttgcctccgtgtattcccgtctggtgctctgtaagaccttcaggtaactcggcccgggttcttctggtggggtcaccagcagtgggagggcggggcctgacccagccccggcaccccaggagctttggtgtcccctcaggttggatgaagatggcaaagtcctgaccccggaggagctgctctaccgggtaagggggcctcctctgccagaccctagagacctctctggggttagcctgtgggggagcctgagtgacagctgacggtgccgttcccaggctgtgcagtctgtgaacgtgacccacgatgcagtgcatgcacaaatggatgtgaagctccgctcactgatctgcgtggggctcaagtgagtgtggaaaaggggttggaggagagccctggagtggggggacccagcccagcatcagggggggtccttacagggaaccctaaaggacaaagaacctcaggggctcaggtccttccccaaagagggtggtctgggagctgctgagagacaggtcagaggcttccaccgtggctgcagccagaagggcctggagctgcccctgctccccactcctggccatgtccccagtgagcaggtgctgcacctgtggctggaggtgctctgctccagcctgcccaccgtggagaagtggtaccagccctggtccttcctgcgcagcccgggctgggtccagatcaagtgtgagctccggtgaggaccttactgggcttgggggatggaggtggggtgggaagggctagctgggggtgacaagagccttaccaccccttcctcacctctagagtcctctgctgctttgccttcagcctctcccaggactgggagctccctgcgaagagagaggtgggtggtgtgggcctcgtagggcctgcactgatggagctgcccaaaccgttcgcggggtggctaaggtgggaacccgaagtgctggtgtcagcggttaggaactaccccagccatgcccaaggcctgtgaggtgag

SEQ ID NO: 29146 - DNA, 1046 bp, Homo sapiens
catgaaaatgattccatgtaggaaggcaagtggcattctgaactgtgagtctacttttttttttttttgagacggaatttcgctcttgtcgcccaggctggagtgcaatgacacaatctctgctcactgcaacctctgcctcccgggttaaagcagttctgctgcctcagcctcccaagtagctgggattacaggcgcctgctaccacatccggctaatttttgtatttttagtagaaatggggtttcaccatgttggccaggctagtctcgaactcctgacctcaggtgatccacccgcctcagcctcccaaagtgctgggattacaggtgtgagccaccacacccagcgatatttacagattgtacagattatattatattatctgtacaagaaagatgcttccatggttccctgattattgccaaaggagtaatgttgtcattagcaggacagcaagacattcatctcaaaaaaacactgaaacatatcagagaatgaacgggaagaatcagtggaattcctaatgaagcattatttctaaaatttttacattcttaaaattagttttagaatatgtggtatagtttggaatgctaggtttaaaaagggctactcagggagttgggcttgtcagaataacttgtctgacatatgtagaaccacttcatggttgttttctttttctttttctttttctttttttttttttttttttttttttgagacagagtctcgctctgtcgcccaggctggagtgcagtggcgtgatccggctcactgcaacctccgcctcccagattcaagcaattctcctgcctcagcctccagagtagctgggactacacgtgtgcgccaccacacctggctaatttttgtatttttagtagagagggggtttcaccatattggtcaggctggttttgaactcctgaccttgtgatctgcctgccttggcctcccaaagtgctgggattacatgcgtgagccaccatgcctggcccacttcttggttttcaactacagcagcaaacagatttttaggg

SEQ ID NO: 29147 - DNA, 1027 bp, Homo sapiens
tccaggctagtctcgaactcctgagctcaagcagtccgcccaccttgacctcccaaagtgctgggattacaggtatgagctgccatgcccagcttcattctttttaaagactgaataatattccattgtatgcgtatgccatattttatttgtctattcatccattgataaacatttggtttctatcttttttttttttttactattgtgaataatgttgctgtaaacataagtgtacaaatatcttgtgttcaagtctcttttaattccatttggtatatacacacaactggagttgctagatcaaatggtaattttatgtttaatattttgaggaccaccatactgttatccatagtggctgcaccgtttcacattcccactagcaacgcaccaagggtttcaatttctccactctacaccaacatttgttctgtttttgtggcaatagccaatcctaatgtgtgtgaagtggtatcttactgtggtttggatttgtatttccctaatgattagtggtgttgggcatctttttatgtgcttcctgccttcctaatggttttttttttgttttgttttgttttgttttgttttttctttttgagacagtgtctcgctattgctcaggttggagtgcatggtgagatcatagcttactgcaaccttgaattcctggacttaggggatactcttgcctcagcctcctgagtagcttggattacaggcacataccaccatggctgtttttaggtttttgtagagatggggtgtcactatattatccaggctggtgttgaactcctggcctcaagagatcttccatcctcagcctcccaaaacactaagatcacaggcatgagccaacatgtccagcatcctcttaacactttcagtcagtatgtttcctgccacaccttgaccaaggaaggaactttagcaaaatagctctggctaattctaaacctggaattagcacaacagttcactctacccccataaccaacattaactctattttttgataaaa

SEQ ID NO: 29148 - DNA, 1111 bp, Homo sapiens
acttgagcccaggagtttgaaaccaacctaggcctcatagtaagaccccatttctacaaaaaaaaaaaaaaaaaaaaaaagtttttaattagctgcatgtggtggcacatgcctgtagtcccagctacttgggaggctgacatgggaagatcacttgagcccaggaagtcaaggcttcagtaagccacgatcatgccactgcactctggcatgggtgacagagacccttcctcaaaaagttacatggtttagctgggcgtggtggctcacacctgtaatcccagcactttgggaagccgaggcgggcggatcacaaggtcaggagttcgagaccagcctggcctatatggtgaaaccccgtctctactaaaaatacaaaaattagctgggcgtggtggcgggcgcctgtagtcccagctacttgggaggctgaggcaggggaatcgctcgaacctgggaggcagaggttgcagtgagcagagatcgcaccactgcactccagcctgggtgacagagtgagactccatctcaaaaaaaaaaaaaaggttacaaggtttgacagatgttcattctcaatgagaaggatcctgcaacagaactcatttatctaccacagaaaacactagtcctgtttaaagtttgtccaggatccacaaactgcactacaggaaaagaatgcttggcactcagttgcattgttggagctgttaaaaagcacctcaacaggttgcatcctttagttagaatttccatagaccagaggttccatgagtctcccatgcatgcacaacgtgggtttctgctgtgggaatcactggcagtcgtgcttgggataccttggactccatttaaattaagatatctgtaatgcagcttgtgttaacatgcaagcttattccttttgttgggttgctttgggcatgctgtcatagtgcatgctgtaaattgttaagacccattttgatagcactgtctatcatttcaaacagcttgccacttttgttcttattcctgaaataggatgccttcaaggcacactcttggcattggcaaatgtatttcttttcttttttttttctttttgagacggaatcgctgtgtcaccaggctg

SEQ ID NO: 29149 - DNA, 1948 bp, Homo sapiens
cctaagaagtgccaatcataaagtctaactcttgatctttactggaaggacatcaagcatatagtaaggataggtagcatttgaactgcatatcatgtgtacctggaatgctctgtaaagaaattgactcataggaggcacattccttacaaaaagaagtaaagcaagattaggcatttgatcacctaggaaggaggaggaacttttgtatcctgttgagtctgcataacagtttgaaagagtcatgactgtcctggcacaatggtgtgcacctacagtcccagctactcaggaggctgaagcagaaggatcgcttgagcccaggagttcaagacagtagtgcaccatgattgtgcctgtgaatagccactgccctccagtgtgggcaacatagcaagaccccatctcttaaaaaaaaaatttttttaagccatgacaacaattatctatgccaggcaataagggttcaaagcaaaattaataaaaagacaaatccctcttttgagtgaatgaagccactaggactgccatatgttttaggtttcatgctaaaaatatagtgctgaataagttatttgtcaacatttgtgattgtgtgtgcaagtgtcctttaattgattttttaatttttttattttttttgagatggagtcttgccgtggtacccaggctggagtgcagtggcacgatctcagctcactgccacctccaccttccgggtacaagtgattcttctacttcagcctcctgagcagctgggattacaggtgcccaccactatgcccagcaaattttttgtatttttagtggagacagcaggatttcaccatgttggccaggctggtctcgaactcctggccacaagtgatctacctgcctcagcctcccaaagtgggattacaggcgtgagccaccacactcagccatttaatttttttttttttaattttttttttgagatagagtctcactcttgtcacccaggctggagtgcagtggcataatctcggctcactgcaaccactatctcccaggttcaagcaattctcctgcctcagcctcccgagtaactaggaccacaggcgcgtaccaccacgcccagctaatttttttgtatttttagtagagaccgtgtttcactgtgttagccaggatgatcttgatctctccacctcgtgaaccaccgcctcggccgcctgaagtgctgggatcacaggcatgagccaccacacccggcccctttaattgattttaattgttcattatccagcagatatttactgaacaccaactgtgtgccaggcactgctctgggttctgaggatacattagtgagcacaatagactatccatgctcactcttcacagttacattctggtggaggagagacagtaagcaaacaagacatgaagtcatctggaattaaatgctatgaagaaaagtgaagcagtgaagggggatgaaatgtgatggaaggtgctaatttagatgggatagtcgggaagggcctctatgaggaggaaacatttgaggaaagatttgaatgaagaaagggagcaaaccatgtaaatattcccaccattgcaccacttgcttttactcttttgggcattttggcaatgccgttcaacctcatactatgaaatgttttcatgttttcttttttttttagacagagtctcgcactgtggcccaggctgtagtgcagtggcacgatctcggctcactgcaacctctgcctcccagttcacgtgattctcctgtcccagcctcctgagtagctgggattacaggtgcacaccaccatacccagctgattttttgtatttttagtagagatggggtttccctatgttggatagactggactcaaactcttgacctcatgatctgtccacctcagcctcccaaagtgctgagattacaggcttgagccaacgcacccag

SEQ ID NO: 29150 - DNA, 1050 bp, Homo sapiens
gagtggttgagaggtgggggaaggacagggtagggtggggtggggtgggtggaatggggagtcgaagcgaatgcggcggtggaggatggggcagtgcggcgagagcctggaacctgaggtcctaccgcattagaggcctctgaggaccccccttggtgatcttgctccgcccctttttgaagcttggggtcctctcacttggaggggtcctctcacttggagggatcctcgctgaaccgaggcctcacactgcctggttagagtctggagtgtaatgcttggctcttctgagacgtctgttggcttttcacacaaccaccccactcttgggttctctgtcacgtccagaatctcccccttccaaaataataataaaaagcatggtggaacttgttaagaaaatccgagcccaaatcctgtggcagttagggagggttgagtactagtcgcgaacgacttggtaagcgtgggaaagcaaaaatggaacgtgtctttttgcatgaaatgccttttagtggtttgccacagtttgggagaacagtatcgattctcacctaacatgaaagctgttcaaaatggagattctaaaatagggaagatattcctagaacatctggctaaacactgacaatatcccccgtcctagtgctttttggtgtctcattgtggccactgctgctcagttacagccagcagccatattgaaaaataatagaagtaggggcttttcctccaccttgaagctgtgatgtgaaaagtggtaaagaagttactaggcactgagaatggggtttgaaagcgaagaaggtttgggagtatttgtaattgaggaagccagagttgaatgaatgaaattctgttaaactcttactggaattattatcttaatagaagagtctaaacatataaaagttgagaacatcagtttattttatggtaagaatcaaaattctagtgaattgtagaatttgttatgaagtaatctaagatttaagtgatgaccttgttctgtgtactgacacgggtatttaattatccagcttatcccat

SEQ ID NO: 29151 - DNA, 1011 bp, Homo sapiens
gatcggcccgcctcggcctcccaaaatgctaggactataggcgtgagccactgcacccggccagactaaattattttaaactataggaaacaaattaaaagatgacattaatttctgtgttcatatactcagccttttggagaatagaacatacgtgtagtctactgttgtctttggtataataagattaacgtaatatccaaaaacttttgtttggtggttccctgtggccaaagagatgataactgcagctgcagcctgaggtcctaaagagtatgtgtgtgtgttacaagcagaatgcactgttccctctttttgtctttgcagtggaatgcagtagccctctgggcctgggatattgtggttgataactgtgccatctgcaggaaccacattatggatctttgtaagtaattggaggaggatgggaggaagttgagaaggttgcagagattgtggctatcttgatgtgactgattttcttcttcacacgaggagatagcaagcctactctgagcactcggtcttctgtatctagtctgttggtgtgtttgaaatagagtagtttttttatgatgtcctggaggcatacccagctctcagaataaatctactcaatctaaagatggcagggacacatttagaattaattgtggacgacaggcactgttgatttttcctgcatatcttccatcttgtacctagactcaaaggtagaaatagtgaaaggaggaaaataaactttgagctaaaatattctgaggccaagcgcagtggctcatgcttgtaatcccagcactttgggaggccaaggcgggcagatcatttgaggccaggagttgaccaacctggccaacatggtgaaaccctgtctctactaaaaatacaaaaattagctgggcgtactggtgcatgtctgtaatcccagctacttggcaggctgaggcaggagaattgcttgaacctgggaggcagaggtggcagtgagccgagatcacaccactgcactac

SEQ ID NO: 29152 - DNA, 1056 bp, Homo sapiens
ggtgaaaataggccgccatgatcagggcagcccgaaagttcaaactgtctgagcccctgttgggagtgagcaggcggagctccctttcacaaccaccaatgacttttccctctcacctccctaataccaccaggcagctactggcacctgtcaggtgggcatggttgagtcagagggagagcctgtccctaagagggggcagtaggcaagaagtcctgtaagatggggaggggaaaggggaatcacagcgacagccaagctagtgtcagtgtcgtcacctaatcctggagcacactgtgatcacttaggttctaactaaagttgcttatgtgtttaagcaggttttatgtctcaaacaggaaattatcttggaattaatcagagtaatttactttgtctttcaggtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctgaactttcctcctctgtactgtgggcttctgaggactaagtggcatcatgtgggcacagagagaagctttgtaaaatgtaaaaccgctatacaaatgtgacctttggttgtgtatgacag

SEQ ID NO: 29153 - DNA, 1048 bp, Homo sapiens
tgcatttgtgtgtaagagctcctatgcaatttaagtttcattttttttgttcttggcaaatgaatttcgaatcctttctctttactgtacttactgtgtttcctctactttccactcttcgaaattttctctcctttgcagaatattttctgttgaggaatagggtgtaaaaaaatcttgattttgtgtgtgcgaggtccaagatttcaggttagaggtgaagtttaacaattcttttatcttacctaccattcttagcttttttttcctttttcttcttatttgctttaagaatcaatatggagcgcagttcatttcacatctcccagttctttggtgtgagaccaaaatgtctgaaactctgggtttttaggttgggagaacaggggcatgttctttgcagtttgcagtcactttctcattttaggggaaataagataaacaattttgtggagttacgtacctggaaatcaaggttagaagttgaaagagttccaatcatgaactacaaacgtgaactgattgtacaaaagtttaaaatgtgcattaggtttggtgtttgtgtgtgtctttgtctttttacacttttaaacatacttggagatcaagattttcgtttaaaagctttacgaccagttcattcagttgtggactagctcctttgtcaggagaagttcagggagacttcttccatcatcccttcattcttttcttacagttagtttaatggtgttatcctgatgggtaaggaccttttctttgctgggataatgaagatgaagaatggctggccatctgacagtccacaagatgttcccctttactacggagcatctctttaactccctgagagcaggctcagcgtcatccctccatctgccagtgagagtgcataatggagttaaatgtaccctttgagtttgtagagaacttcgagagcatgtttctaaataggcttcatttcagagggtgaaaatgggaagacagagctaatgctttgaattcgttgcttttataagaaagatgtgaaatgaatttaagttaacct

SEQ ID NO: 29154 - DNA, 1040 bp, Homo sapiens
ataatacaggaatttagactttccattttacccatttaatggatggggcagaattgtgctttaggcagttaagtaaaaggaggaatagtttgggaagaacagggaaaaacaggaggcagggagaccagtgaaacagctgttttagggttccagccacccttaccacagaagatggaaagaagtggaaagatttgagggaagatggatgatcagcagaacttggtgactgattagaagttaggtagtaagatggacaaatcaaggataattccccagtttaaagtttgagcaacttgttgggtgatgatttatttattatttatttatttattttgagacaatctctgacccaggttggagtgcagtggtgtgatctcagctcactgcaacctccgccttccgggttcaagcgattctcatgcctcagcctcccaagtagctgggactaaaggtatccaccaccacgcctggctaatttttgtatttttagtagagatggggtttcaccatgttgatcaggctggtctcgaactctggcctcaagtgatctgctcgccttggcctcccaaaagtgctgggattacaggcatgagcagctgtgcccagctggataattatttaataaattggggagcataggaagcatagtatttgtgaagtgggtaggcaggtgtgatgggggtagtgatgttacatttggggcattttgaagttggtggttcttctgagttgagcagtcagtcactcttcatttgctgcacctttatctcattttagccaacagacattgaatacctaccaagtcttaggtatttgcaatgtaaagacaaattaaggtgccttctgctgtcagagacttcagagatacagtggggttggtatacatgtccacacagttttcccgtaagttatgctttaaaaggttttttaaatgttatatataaaggcaggggatgggttgcttttgacagagtaggtttggagcgttgatggaaaacttcatggagaaaatgtatatttgaacagggttggtggaaatt

SEQ ID NO: 29155 - DNA, 1023 bp, Homo sapiens
tgcttgatgaactctgtacatgtgatgtgactagtatgaacttctgaggttgttgagatgaatgagaataaacgtgaggtgccaagaaaaatgcctgacacattgaaagtgctggataaatgtatgctgtcatcattgtaagctgggctatctcctaatagtgtaatgagtccattgaataacaataggtaacatgtttatagtgcttagtgtgtgccaggtactgttctaaacactttacatttattcactcatttaatcacaaataacatgaagtaggcactttgctgttatgcagagatggaaacaaggttatccctgcatcttttttttttggcagggggaggaggacgggaacggatggagttggtttttttttttggagcttctgagacccaagcttcaggccatgctcccccaagcacctccccaccaccaccccccaagatgtagtcttgctctgtttcccaggctggagtgcaatggcgtgatctcagctaaacggaacttctgcctcccgggctcaagcaattctcctgccccggcctcctgagtagctgggattacaggcgcctgccaccacgcccagctaatttttgtatttttagtagagatggggtttcaccatcttggccaggctcgaactcttgacctcaggtgatctgctcgcctcggcctcccaaagtgctgggattacaggtgtgacccactgtgcccatcctgttccctgccccccccccctttttttttaagttattgagacagagcctcacttggtcacccaggctggagtgcagtggcaggatcatagcgcactgcagcctcaacctcctgggctcaagcaggccctttgagtaactgggacctgtaggtgcatgccagcatatccagctaattttttttttttttttttttttttttttttttttttttgagacaaagtctcactctgttgcccaagctggagtgcagtggtgtcattgcaacctccacctctcgggttcaactgattctcctgcctca

SEQ ID NO: 29156 - DNA, 1057 bp, Homo sapiens
tgatccacccgcctcggcctcccaaagtaaagtgctgggattgcagatgtgagctaccacatccggcctatatccagctaatttttaaaaataatatttttgtagagaggtggtctttctcccctcggccttccaacgtactaggattacaggcgtgagccacccttctggctgtcttttcctttttattttttcacacttccagtggtccttgggatctgtgtatactttagaatcatcttgtccagtttcttgacaaacttctagaagtttgattgatactgcattgaatctatagatcagtactggggaatgatgtttttaatactgaggatttctaagtgtttgagatattctgtttagtcagcctttacttttgagtttacacctgttttatatacattgtcagtttttccctatgttataaatctttttttttttttttttaaatttgagatagagtctcactcttgtcacccaggccggaatgcagtggtacaatctctgctcactgcaaactctgcctcctggatgcaagcgattctcgtgcctcagccttctgagtagctgggactacaggcatgtgccaccacgcgcagctaattttggtatttttagtggagaccgggtttcaccacgttggccaggctggtcttggctggtcttaaactcctgacctccagcagtccacctgtctcagcctcccaaagtgctaggattacaggcgtgagccactgtgcccggctctacattatttaaaaaattatttgtaaccatttgttgctggcatacagaaattcactttgatacgtttatatttatggtataaccagtcatcttgctaacctctcacaatttccagttgtatgtatttctttaaaattgacaacagttgtgtatattcatgggttatagtgtgatgatatatgtatttgctttgaactttctatgtcaacagttatattatctacagacaataagttttgtttcttcctttttcctttttctttctttccttcttttttgttttgagacggagttttgcttttgtcaccca

SEQ ID NO: 29157 - DNA, 1015 bp, Homo sapiens
tgataaaatgctaaaagatacagaaggagcaggattgggaagaaaaaaaaaaactacaagaagaggaagggcacatacaggaagagttatacttaggaactaagattaattggatcaagtagaccattaaggcaatattttgtcttcaagggatggtccattttttaagaggataatagctgtggaatttttgttgttgttagtagacaaggtctcacagtgcccagacttgatgtgaattcctgggctcaagctatcctcttgcctcagcctcctgagtagcttggactatagatgtgtaccactatgcccaacacccagtaatgcctttttaatgtgaaaactactttagagaattgaaaggaaagaaaactcaaataatttttatagtaggttaatactgtcaataggtcaatcaggagtaattttcttcccccaggggatgtttggtgatgtctggagacagttttgattgtcacaattgggatatgggtgctactggcataagtagaaagaccaggagtctcctaatgataatagagggcacaagacaatcaccctccacccacaacaaagaattatcacatagctcaaaatgttaatagtgccagggttgagaaaccctgcattaatctatacttagcacccagttttgtttgttcttttttgagacaggatcttgctctgtcacccaggctggagtgcagttgtgcagttaaagctcactacaacctcaaattcctggactcaagtaatcctcccaccttagcctcctgagtggctaggagtatagcctagtgccaccacacccagccgactttattgtttgtagagacagggtcttgctgtgttgacctgggctgaagaattcctcctgccttggccttctaaagtactgagattacaggtgtgagctaccagggctggtcttgcaccctgtttttggtaggggtggtttgtatggtgaaggagccagaggcatggtgttgtaccctattctggctagactttggtt

SEQ ID NO: 29158 - DNA, 1056 bp, Homo sapiens
aagaaattactgccagctgatcagcaatcagtgtagtctgtgtatttaaacccatagtctgccatagaggagcttggagtttccaggtaatgcatcgtgatcaagggaacaagcagtgtcaggaattggttgaaattcagttggtctaggcaggcaaggcatgcaatcatgaaggaccagattgtttggggaaatatttggataaagacattacatttattaacaagagacaacaacacagcttagaaattccaacattttgttgattcagataataggactcttgagggcataatttattgtcttagtcttttattgtttgtcatgcgggttctgtgatagaatgactttcatactatatctatcatgaattttcatgctaataagaaacaggttaaacaactcccccatgtataggtatggatattattggagccacataggataaatactagtagtttaaaaaaaacataggtagcagcagcacttgcagtcagatttgtaactaccaaaagtagcctggacttgatttaaacctgtttctgcattctattgcccctgcaatcttttggccatatttacatagaatcaagaaggtttttttctttcttcttcttcttttttttttttttttttttttttggagacagagtttcgttcttgtcgcccaggcaggagtgcaatggcccaatcttggctcattgcaacctctgcctcccaggtttaagtgattctcctgcctcagtctcccgagtaggtgggattgcaggtgtgtgctaccacgcccagataatttttgtattattagtagagacagggttttaccatgttggccaggctggtttcaaactcctgacctcaggtgatccatccaccgccacctctcaaagtgctgggattacaggcgtgagccaccgtgcccgaccaagaaattatcttctctgaatgcttctcatttcaggccacctcattcttttatgcttccatcaaactgccacttgtaaattacttgtaaatcattcttgtaaattacttaccttagtctctgaatttcat

SEQ ID NO: 29159 - DNA, 1028 bp, Homo sapiens
ctcccaaagtgctggaattacaggcgtgagccaccgcgcccggccaaaacacactatcgtttttgtgagcaagtatctaaggatgtgagaagagaataaattttaaaggtcttcccatgtggtgatcctcatagactttgatttttatttgccctagcatagcatactttaaatgttattgagggtttgctaactgtcatgtaggcaagtgttcaatttaatacaatttactgcagtcatttttacccgatctaatacaatttgtatgaagtcattaaaaagtgttcttataggcatgtgtgtcataacattggtttagagtacatttgcttagaataaagtaggttgtgtatagcatggtgaaaaatgagggctcttaagccagactgcttgaggttgaatctcactttgagtactctgtgactttgtgcaaattgcttacccattctttttgcctttcttgactgtgaattctgagtattaataggagctaccttatagggctgttaggaagatgaaataagttaatgcatttatgttacttattaagtggtcaacaagttagctattattaatgtaaaaacattaacctgctcttgaaaaaatatgttttcttctctttagtggcacactgtgcatcttctcgacaaatcatttcacactggaagaattgtacaagacatgattgtcctgtgtgtctccccctcaaaaatgctggtgataagagaaatcaacagcgtaagtgatgaaatcttttgaaggtttatatgaaaagttttaaagtctcaccagtgccatttatagtactacttgattatgtgagggacctgtggtgttgtactatgttgaataaatgtttttttcccttttaatttttctgcttccctagtgcatagaattgaactgcttagggagtttgaggctgcagtgagctatggtcatgttactgcgctccagcctgagtgatggagtgagaacctgcctcaattaaaaaaaaaaaaaaaagaaagaaaaaacagtgcagtggc

SEQ ID NO: 29160 - DNA, 1066 bp, Homo sapiens
atgaacatgcacagtttaaaatcagtctagtcacacacttctccctgcctagctccttaatgcgaatagaagtgacatagcatattgattccattacaataatcagtgtcagcttgaattaaatgaggtcttctcctacctttcttcactaaaactatttggtgacccctttttgaagcccaatgatgagtgaaaatgccagtgtgccctccctgggtcctatgccaacagcagctcaaccatccactactggaattcggaaacagtggcacgaagatattactcaggatcttcgaaatcatcttgttcacaaactgtaagtaagattgtggacacgtctcattcgtaaagagatgttacgtcaacatgttttcaatctcctgggcatttaattactaaaggaatattagcaatttttctgtagcatggaggttgatgttgatacttctactcttgtggatttcttgctgctgctgcttttttccttctcaacctttcccaccatcatctatggtagtctttcagctttaatggtatgtgaactattctgtctagtgacagtaaataatatattaaacattgtttttagctattgcctttgcaaaacttatatatctaagaaaaactaggcctcagctcattaaaatattgcattgataacatccttttctgttactcctggtagagcaggggttttttgtttgtttgagatggagtctcactctgttgcccaggctggagtgcagtggcacgatcttggttcactgcagacttcgcctcccaggtgccagtgattctcctgtctcagccgcccaggtagctgggactacaggcacgtgccacctcacctggctaatttttgtatttttagtagagacggggtttcactgtgttggtcacgctgacttcaaattcctgacatcaagtgatccgcctgcctcagcttcccaaagtgctaggattacaggtgtgagccaccacgcctgtcctggtagagcttttattatgtaaaaatctggtagggtggactctctggtcttctcgtcctccagatgtgcacatggca

SEQ ID NO: 29161 - DNA, 1041 bp, Homo sapiens
ttcaccatgttggccaggctgaaacttctgacctcaaagtgatctgcccacctcagcctccaccgtgcctggtcccatggactcttatttggcaaagtctcttcataaatttttagaagcctttggattctgcttctaattgaccgagtctgtcttcactgactttgtgactgaaaagttaagctgagggtgaagagtgttttaaggtgataagacacaatgttttttaggagctgtctgaaacaaagcggggcttagaatctagaatcagtgattgagcctgtagtgatatttccatggggacagagtggttaattttgttattgattcttgagatgcttttagagcttcaggctgaatgattttttaaagttcttctgcttaattggtaactaatttcaaatgcactttttttttttaagttttcaaaccagaagaactacgacaggcactgatgccaactttggaggcactttaccgtcaggatccagaatcccttccctttcgtcaacctgtggaccctcagcttttaggaatccctgtaagtatttggtggtacttttgattttattttttaatttgataacagctttattgagagataattcacattccaaacagtatagccactcatttcaaatttgtaattcagtgattttttttttttccccctgagacagggtcttattctggttgcctaggctggagtgcagtggcacgatcgtggctcactactgtctccacctcccgggctcaggtgattctcccacctcagcatcctgagtagctgggataactacattcatgtgccacctcacctggctagttttttgtattttttagtagagacggggtttcgccatgttgcccaggctggtcttgaacgcctggactcaagcaataggcccatctcagcctcccagagtgctggaattacaggtgtgagccactgggcctggcctaattcagggagttttagtatattcacagagttgtgcatgacactttcattttcatcatctgaaaaaaatcctttaccat

SEQ ID NO: 29162 - DNA, 1010 bp, Homo sapiens
gagccaagattgcaccactgcactccagcctgggcaacatgttgacagagactccatctcaaaggtcaagtgcttccaggggcaaaagccttttaggacttttcctctcttgtatcttgctgtgatttcagatggaacattttaagttctgtgggcttagtttcctcattgtacaccccttctagtactaaaattttaaatgtctttgactttactgatctcacatgtactttcataaagaacctgaagttgcttcagtagaatatcagcctgatgtctagaaagtccatagtagttctgtttctctgccctttgagtagtttaatatctctgtaaactaatatttaaagaagtgatggacatcagtcacctcttggggaatatagacaggccagaaactaaaacactgcctggaaaattaacaatgataatggatgatactccatctcccgtaaaaatagtgagacttgagtaatgtttgatgtcacttgtctttctaggattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaaggtaagaaatgtgtttcagatttgactttaacttttctgggatacctagaataatatagtggtgactgggataagagaatatcctgcttctggctttgacatggcttttttttttttttttttttttcctttttgacagggtcttattctcccaggctggagtgcagtggtgaggtcatagctcactgcagcttcaacctcctgggctcaagcaattctcccacctcagcctcctgagcagctgggactacagccgtacgccaccatgcct

SEQ ID NO: 29163 - DNA, 1048 bp, Homo sapiens
gtaatcccagcactttgggaggccgaggtcagaagatcacctgagggcaggagttccagactagcctggccaacatgatgaaaccctgtctttactagaaatacaaaaattagctgggtgtggtggcatgcgcctgtaatcccagctaactcaggaggctgaggtgagagaatcgcttgaaaccgggaggccgaagttgcagtgagctgagatcgtgccactgcacttcagtctgggccacagagcgaggagactccatttcaaaaaaaaaaacaaaaactaacaaaaatggcgttggattgtgggctgcactgtgttggctgtagatgaagagaacatggcagggaaggcagcccagaggggccccgagccaggccttaccctgtgttttctctcactctcctgagtgagctgctgggataccggatgtgggacaggcaattggtgtcaggacgtatcccaagcccttgagctgggccagagggtctgtctggtttaggacccctgtgtcagctttgcctgttggctgctttgtgacctctgagacgctttccttcctggtgtgtttggaaatagcactgcttagtctagtctaggctggttcttcctgacccagcagtgccctggggctggaaaagccctacaccctacctgttccctgccccaggcaggacagcactgaagtcacagtgaacaaaaagaacctcctcctctgtaccccagcaccatggctctctgtagagcagctcgagggcatcttggtcaccatccctcattaggtcagttgctaccaaggcactgtgaaagcactgcagagctgcagcccatcagggtcagaaagggacacaggaagactcagttctctggacatgagtcttgtatgtgccacaggcagagggctgggagggggcggggagggcaggatgcctggggatcagagtgcagagcccatgaggagcacaggctgcacaccagcttccaggcccagctctggcacaaatgagtctgtgtaattctgggcaggcgtgacctctgggtcacttttcct

SEQ ID NO: 29164 - DNA, 1034 bp, Homo sapiens
gaatctgaaaataatccctcaatctgaaaataataatccctcaaatatcactttttagtttataacaaaagggctttcacatgtgttggctcatctgtcctccatagcaactgtgtcaggtagacattttctagataagaaaccttaggccgaattgtgtgtcttgctggaaagtcagacagcagaggtaggattcccacccagttttctggctccaaatcgtcaccctttcccagagtcctgggccaccttagcaagttacttttcatttattttattttattttattttacttttttgagacggagtctcgctctgtcgcccaggctggagtgcagtggcgcgatcttggctcactgcaagctccgcctcccgggttcacgccattctcctgcctcagcctcctgagtagctgggactacaggctcccgccactacgcccagctaattttttgtatttttagtagagacggggtttcaccgtgttagccaggatggtcttgatctcctgacctcgtgatccagccacttcggcctcccaaagtgctgggattacaggcgtgagccaccatgcccagccttctttttattttttgagacaaggtctcactctgtcacccaggctggagtacagtagcacaattgtagctcagtctgccaggctcaggcaatcctcctgccttggcctcccaaagggatagggttacaggcatgagccaccacacctggctgctgcaagtttctttctttctttctttctttttttttgacagagtctcactctgttacccaggctggagtgcagtggcatgatcttaggtcactgcaacctctgcctcccgggttcaagtgattcctgggctcaacatatctgaattcaagtgaactcctgggctcaacatatctacccacctcggcctcccaaagtgctgggattacaggcgtgagccacctcatgcctgtctgcaagttacttttcaagtgcctcttgtgagatgctgtggggcaggtttgcaattgactttgtcatttat

SEQ ID NO: 29165 - DNA, 1046 bp, Homo sapiens
ctactcaggaggctgaggggggaagatcagttgagcccaggagatggaggctgcagtgagccaagatcacaccactgcactccatcctgggcaacagagcgagaccctatctcaaaacaaagaaatttttttcccagaggagggaagggtgtgggctgttaggtgcctgtagggctggggcctttggtctcctgacgcattgttaatcaggctgcctgatgcccatctctgcggtgtcactgaacccaggatccaggctgactgcatggctttgaataactttcctagcctcttggagtactattttcctgcctgatggggatgttgtgagatttaaataaatctcagttatttagtgacaacacatttttttgtagagcaaagctagacatagagtggcccttttgtttaaaagctcctgtgactcctctaccttagggtggaatccacagtctgccccgtctacaaaacctctatgggctgggtgacacacgtggctcatgcctgtcatcccatcactttaggaggctgaggtgggaggatcacttgagaccaggagtttaagaccagcctgagaggctgggcgcggtggctcacgcctgtaatcccagcactttgggaggccgaggcgggcagatcacgagctcaggagatcaagaccatcctggctaacatgatgaaaccccatctctactaaaaatacaaaaaattagccgggtgtggtggcaggcgcctgtagtcccaactactcgggaggctgaggcaggagaatggcgtgaacctgggaggcggagcgtgcagtgagccaagattgtgccactgcactccagcctgggcaacagagcaagactccgcctcaaaaaaaaaaaaaaaaaaagaccagcctgggcaacatagtgagaccttgtctctacaaaaaattttaaaggttagcgaggcatggtggcgcgcgcctgtgatctcagctgcttgggaggctgaagtgggaggatcccttgagcccaggagtttgaggctgcagtgatcatgccattctgggcaacaga

SEQ ID NO: 29166 - DNA, 1027 bp, Homo sapiens
gggctgtggctggaagtggggctggaactggggccaggctggaggtggggctggggtcagtctgctctttctcaacacctgtacctggcaaaacctggctgtctggccccaaggaacatgcaggtccttccatcagaactggaaggcctgcatggcaatgatttaggagaagaaaaccgcagtctgttcaccctagtccacaaggtgatggctgaggtctgagttggaggagtagctctggacctccatgaagctgggaccgccgggctcacccaggcctcgtgttttcttttcctgataggtcgacactacccctaaagcaagaagaatatgaggtgagtgtcagctgccaggctgagcaaaggtgaagggcggagatgtgcaggggagaggcgtgggccgggtgccagagctggggccagaggtcatgagccccctacacaccttgcccccaacaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatggtgagcctggcaccctcttttctctcctcctctgctgccctgatcccctggatgcccagtcgagccaggcccataccccagtgagcctgtagaccagggccagcctcctcccagcctgctttcagaatttcattgtctgttctcgtggctcttaatctcaactgtacaacatgctcagctggagagcttttaaaagtacggatgcataataaaaagtttttaaaaaaaatgatactgatgccctagccctagccctgccctagatgaagtaagttagaatcttggggtgaccctgggccttggtgggagtctgacttctcctgctcctccctcccggccccactgtttcttccatagcctcagcctcctca

SEQ ID NO: 29167 - DNA, 1033 bp, Homo sapiens
ttcctacccaccgcatgggcctgccagccatcactcttcaattctgcttccggaattatcatgtgtgtccaccctgcccataggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaaggtgggtgggctgcagcggggcaggcagcacagctggggcccagcccctccacccccagccgctgctctactccccatcacaggtagacagaacaggggtgggcctcacagctgcacgggaggagaaagccacggcctaggctcctggggcccgtgcaggatgaattccacatcagaatgagcgtcttcttcccttagcagcttccagaggcaggtgggacacatttgggacattcagctggagaccgagcccgtcactggcctgtgctctggagtgtcaggagcctacatgactcatagggggctggcttctcttaccactgtagggccctgaggggccgcggggcagtgtgcccagcagccacatgaagcatttaggactggcgcatggtgagggctccatccacttgagctctctgtcactcttctgttgtcactgtcctcatttctggctcacatcagcctggttggtatttaatggacatccatcatgtccctgactagcttctttctggtcccagccaagcgccttggtcccgctgtacggcgatatgtgaatagtcacgaattgctaaggccttcccagtgtagccctttcatttcaccagcatgcagcctcacagctctggaggaggaaacggaggctttgagagtgcacccacggctctgcctctcccccaacctggcccctagcagtggcccgcccaggcctcctgaacttgctccttgtcctcccagcagccaggctggtctaaggacatgtcactcttgggtcaaaggcctccatca

SEQ ID NO: 29168 - DNA, 1617 bp, Homo sapiens
ctccccaccaccgccccggtgtgcgtacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatg

SEQ ID NO: 29169 - DNA, 1045 bp, Homo sapiens
tagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcttcccttagcctttgttctagaaaataaacttgtgcactttgacctctgtccccgagatgtcactcctgttcctccccacctggtacttatatccaggggccttagctgctctgtcctcatgggacagacctggccggtactagctactctgaggaatgctaagcattccgaggggtgaggggcaggtctgtg

SEQ ID NO: 29170 - DNA, 1115 bp, Homo sapiens
tcctgcgtcagcctcttcagtagctgggactacaggcacccaccaccatgcctggctaatttttgtatttttggtagagccagggtttcaccatgttggccaggctggtctcgaactcctgacctcaagtgatccacccgccgccttggcctcccaaagtgctgggattacaggcatgagccaccaccatgcccggcttcccagacagctttaaactgcagtgtggagtggaccaggacagcggttcaggaccagagaattgcctgaagacggagtcatttgggccaggtgtgcagtagacgctcagatgcttgataaatgatggcacgaggaacaaaagcagccagctttattgagcatcttggttgcagcaggtactgtgcagctagtacatccgtccctcacagcaaccgtggaagttcactgtccacatttatagcccagagagtttcagtgaaggttccaaggaccctcaggaaggaggcagaaaaaagatcgagaaccactgggaactgggtatcggcaaacgtcccttccgccctgacattctggaattcacagcacctctggatgcactgtgaaaaaccgaagtggcgtggcaaggcagagttcccggaagaaaaatacagactcatgcttaggctggagagatcgcgtgcctgcatcaagaccttacaggattactcctgtaatcctgccttgggagatcaaggcaggaggatcacttgaggccaggagcttgagactagcctgagcaacagtaaagccgtatctctacaaaaaaaaaaaaaaaaagtaaaattagctgggtatggtggtccacacctgtggtcctagctacttgggaggctgaggtggaaggttggcttgagcccaggaggttgaggctgcagtgagtcatgatcacaccaccgcactccagcctgggagacagagcaagatcctgtctcaaaaaaataaaaataaataataaaggaacaattaaagagtaagacaagcagaggccgggctcagtggctcactcctgtaatcccagcactttgggaggcagaggagggtggatcacgaggtcaggagttcgagaccagcttggccaacatagtgaaacccccgtc

SEQ ID NO: 29171 - DNA, 1087 bp, Homo sapiens
acagtggcaggacaggcatctccaagccagggagggtctcagcagtggtgcgcccttggtctcagggtgcagagtgcggagaggggttcgaggaggcatgtgtcacaccggctctgggactctctcctaggcctgctggatttggggaagccatggccagtgtgtggccactgacaggtgctgtgctcatgtgggaccaggacaggacagggggtcctattgaaagaatctggctggatgctgactgcttttgaagctccctccccctgtacgctgggggtggcagaggagcggcagggactgtggatttgggcagcaggagcctgggtctgaagcagaggctttccttggtgcgcctgctgcagctcccgcttgccggagggctgaactcatggatgggatggaaactgttatgtaacaggaccacaaggctcgaagccctgcgttcctaggataccacaggcaaaacgcgcgagggaggagagaggagggcgtggactgaggggcagacctggtggccagcaccaggtgtctcccaagtcctgcctgggaaccccatggccagattagtttggcggagaatactgataaatctctctccaaatctcttctgttcccagaagtcagaggtcacccccaggtccccagggctccaactcctccttgcctttagaggggcccagctggcttttgctgcctgagtctgacttgagcacctggggtgtcctctcaggggacctttctcaggcctccctctcatcctgctgtgccagcacctgctacctagcatcaccaggtggccctggttgtccccgcaggactccttccttccacaggacgctctcagcccactcccaaaccagagccaggagacagatcccacagcccccggcctcccttcacccctctggaactgggtgtgggtttgcttgggctaagccaggaaaggagggtcagcaggttctagccccagggagacattgcccgaacggggaaggacgtactgggagcttagggcaggggctccggagctctcgcacgcagctctgggctcaggcccctccgaccacactccatgctgtcaaat

SEQ ID NO: 29172 - DNA, 1023 bp, Homo sapiens
gccatatccttcagcagtttggtagaaagaaagggagtcatgtggcatttggccccagtgtgactccctgtagtttctctccttccccgggccatcggctgtgttgatgttcctgcctccctggctgtagcccagccactgggcaagagctcactaggccacaggaactggggttgaaaaagtccttgctttgaaggacaaagggtttcttgtatgttgccatccccagggatgagcaagcagctttcaagctggtggtgctgttaggaactggtgggaagagagaattttgcagttttccatcctttcctatgaaaaacttacagcaaggatttttcatccaaatctttggagtcaggcacacctgggtccaaactccatgttgccacttgtggcctagctgtgcctcaagttcctcatctgtaaaacgggagcaactgaacctccctcccggggaggtttgtgagactttaataatgatgtgatgatcatggtgaatatttagatggtactcactgtaggccaggcactgatttttgttttgtttgtttttgttttgttttgtttttgagacagagtctcactttgtcacccaggctggagtgcagtggcgtgatctcggctcactgcaacttccgcctcccaggttcaaccgattcttgtgcctcaccctcctgagtagctgagattacagatgtgcaccaccacgccggctaatttttgtattcttagtagagatggggtttcatcatattggccaggctggtcttaaactcctcacctcaagtgatccacctgcctcagcctcccaaaatgctgggattacaggtgtgagccaccatgcctggcctgttatttctcagtgtaaagataagggacctgtgatattgaggggttaaagtacttgcacagtttcactgctagtaatcttggagagccaagatctgaactcggggatctaggcccttacccacaaccaacatgcctaagtaaggcaagggtgtggacagtgcaatgctttgt

SEQ ID NO: 29173 - DNA, 2008 bp, Homo sapiens
gtgcctgggccaccatgtgccttaaattataaagtcgggcagtgacgctcagtaggggttggtttctccaccttcctctgggtgaccttaggcagattttgcctctccgaacctcagtgtccccacctgtctaaaatggccccttccttctagtgtggtggggaagaacagcagcatgtcgacacccggtgagtacttagccaggtagctgtgaactctccttatctaaccctccctgccaggggcctgccacagcgccagacctgggcctggttaggtggtgcccagctgggccagtcagctccctgtggaccttggcctttgccctgggagcatgcggtgcaggcctgccctgtggctcagcagctgcagaatggctggtgttctgtggcctggtgatggtggggagtgggtgcttccctgtcaccttccttacaagaccctgggagcacctgagggtcccttgcggtcccattcatggtcttactaaggtagctcacccagaacctgttttgagcatctaggaagagcaagctgtgagatgaggaaggtatctgcccaggccttctctgagctcctcagacactgggaacctcagtctcttcatctcttccttgggcatagatatcatacctccttcccttccctcctgcttggcccctgccagcatgagatgaaatgtcactttccctactcccacaaattggcttggacataagcccagggctttatgctcattttacctttttttttttttttttttttttttttgaggacagagtcttgctctgtcacccaggctggagtgcagtggtgcgacctcggttcactgcaaccgccacctcccgggttcaagcgattctcctgcctcggcctctctagtagctgggactataggtatgtaccaccacacccggctaatttttgtatttttagtagacatggggttttgccatgttggccaggctggtctttaactcttgacctcaagtgatccacccgcctcagcctcccaaagtggtgggattacaggcgtgagccaccatacccggcctcattttacctttgagcaaacatatgagaggagaattagtgtccaggccacacggcaccagcctcgcctttgacaattgaggaaaccaagagggggagtcgctcttccaggcagggtaaccagtcatcctggtttgctggaaactgaggggactcaggctttactgggaaaactgggagttaccctatctccaggatacacacctggcaagtgacagtgtcttatgttcaaagtctggttgccgagcctgtgtgtggcaccaaactattgccttcaattttttgtttgctgaattaataaatgcaaatgaatgaatgaatccttccctctcactgcccttctcagtcctccttgggcaccttggctcatgtgccttggtctgagtctagactgtgccagcagcatcctgtgggaggccagatggctggttccgctgctgagttccaagaaaccccttggcccctgcttggttcagcctcagccttcaggaaccccccagggtccacccaacaggcttgtaccgtgtgcctagggaggaggctgggttcccacctggtgagccactcagccccgtagtattagcggtttggcttcagacttgtcactttgcttcttggagctcagtttcctcacctataaaatcacagtactgggggctgggcgcggtggctgacacctgtaatcccagcactttgggaggccgaggcgggcagatcatgaggtcaggagattgagaccatcctggctaacacggtgaaacctcgtctctactaaaaatgcaaaaaattagccgggagtggtggcgggcacctgtagtcccagctactcaggaggctgaggcaggagaatggcgtgaacccgggaggcggagcttgcagtgagccgagattgcaccattgcagtccagcctgggtgacagagcgattctgtctccaaaaaaaaaaaaaaaaatca

SEQ ID NO: 29174 - DNA, 1048 bp, Homo sapiens
ctgttccccttcaaattcttcacctactaggttgtcaaccctctgaaaagccttccagggccacgtgggagcctcgtctgggtgcatatagctcctcggccgcctcctgctgtggatctgatgtggtgttgaagtatgagacctgggtttgtcttctcccagctcttccaccagtagaagtcccctccaagggcaaggcctgggtctgctcctgcagtggtccttgctctggacctggcataaaggagggctccaggagggtttgcagttgaatatgtgagagaaagctctctgtctctttttttttttttttttttgagacggagtctcactctgtcaccaggctagagtgcaatggtgtgatctcggctcactgcaacctccacctcccgggttcaagtgattcttctgcctcagcctcccaagtagctgagactacaggggcatgccaccatacccagctaattttttgtatttttagtagagacgaggtttcatcatgttggacaggctggtcttgaactcctgacctcaggtgatccatgcacctgagcctcccaaagtgctgggattacaggcatgagccactgcacccggccgagaaagctctcttattgtctttgcccctagctacagataaggcaaccacggggcaagaaacttactgcgtattgaagagaaaatcccagcttcctatccaggcttcaggcagggcccatgctatggcctggagccccctttgacctcatctgctccacttgcctcttgcttgctgctggtcttttcttccctgaacccaccgtcctgttcctgcctctcgcccttggaagtgtctggtcctgctgctcttctccctgttaagcatgtgacaaggaatcgtatgcttcaggtcacaggttgaaagcccccttctcgggaagacctgccttgtcttgtccacccaatataagtgtctacttggtcactagccactgtcactggtcgtgattatcttaccatctgccattttctcatttatttgtttgttttcagttaatagaacattgct

SEQ ID NO: 29175 - DNA, 1076 bp, Homo sapiens
attcccctcccattttgaataatcatatgttgaacggcatgcaccgtgcttgcaaaatagtgagctccatgagcaagcaagtgaggcagggagaaggtgggggcacatcacctgtctgagagtaagcaagatgtgacgccatgacaagtcaggctggtcataattggccccagttaactcgcatagatgcgtcaccctttcatacacactccagggcaagaaattttgtattgtttctttgaagttatccaagaaaatacttcctcaatttgatctcttcagcaggtgcaaaggaagaaactggctttggggaagcgtggttgcctacttaagaaaaattatttttaaaaaatttttatttattatttattttgagacggagtcttgctctgttgcccaggctggagtgcagtggcatgatctcggctcactgcaacctccacatcctggtttcaagtgattgccctgcctcagcctcccgagtagctgggattagaggtatgtaccaccacacccggctaatttgtgtgtgtgtgtgtgtgtgtgtgtgtgttttgagacggagtctcgctctgtcgcccaggctggagtgcagtggtgcgatgtcggctcactgccagctccgcctcccggattcacaccattctcctgcctcagcctccggagtagctgggactacaggcgcccgctaccacgcccggctaattttttttttttgagacggagtctcgctctgttgcccaggctggagtgcagtggcacgatctcagctcactgcaagctccgtctcccggggttcacgccattctcctgcctcagtctcccgggtagctgggactacaggcgcccgccaccacgccctgctaatttttgtatttttagtagagacggggtttcaccgtgttagccaggatggtctcgatctcctgacctcgtgatccgcccgtctcggcctcccaaagtgctgggattacaggcgtgagccaccgcgcccggctaatttttttgtatttttagtagagacagggttttaccgtgttagccaggctggtctccatctcctgacctcgtgatcc

SEQ ID NO: 29176 - DNA, 1158 bp, Homo sapiens
ggcagatcacctgaggtcgggagtttgagaccagcctgaccaacatggagaaagcccatctctactaaaaatacaaaattagccgggcgtggtggcacatgcttgtaatcccagctactagggaggctgaggcaggagaattgcttgaacctgggaggcagaggttgcagtgagccgagattgcaccattgcactccagcctgagcaacaagagtgaaactccatctcaaaaaaaatattttaaaaaaaccccacaaaacaaaaaaaaatgctacaggtcagggctgggcgtggtggctcacacctgtaatcccagcactttgggaggccaaggcgggcggatcacctgaagtcaggagtttgagaccagcctggccaaaatggtgaaacactgtctctattaaaaataaaaaaaataaaataaaaaaaaaaactagccgggcttggtggtggttgcctgtaatcccagctactcaggaggctgagggaagataattacttgaacccaggagtcggaggttgcagtgagctgagactgcgccattgcactccagcctgggcgacagagtgggactcttgtctcaaaaaaaaaaaaaaaagaaaaagaaaccctgtctctactaaaatacaaacaattagccgggcatggtggcacgcgcctgtagtcccagctactagggaggctgaggcaggggaattgcttgaacccgggaggtggaggttgcagtgagcggagattgtgccactgcactccagcctggtgacagagcaagactccatctcaaaaaaaaaaaaaaaaaaaaaaaaacacacaaaaaaaactacaggtcagaatagagtgacacatagtctctctgaaatttagtcagttcagtttcattccctgggaagttaattttaatttagaagctgctaattggcaggccaaggtccacatctggcagatttattttcttggcatatactgacatattacagttttaaaagtgagttgccaatgttgaaaatttgggatattgtacaaaaatatcctaagttgccacttgtcctaaattcaaaatatctggcaacactgggcattcaaactggcaggaattgtctggagttgaatagcagctgtctcctttagacagggcttgtgttctctggttgcctaag

SEQ ID NO: 29177 - DNA, 1050 bp, Homo sapiens
aaactcctgacctcaggtgatccacctgcctcagcttcccaaagtgctgggattacaagtgtgagccactgtgcccagctgggactatttttttttttgagacagggtctcactctcttgcccacactggagtgtagtggcacgatcacagctcactgcaacctcaatctcttgggtttgagtgatcctcccacctcagcctcctgagtacctgggaccacaggcgtgagccaccatgctcacctactttttttattttttgtagagatggggtatcgccacattgccactgatctcgaactcctgggctcaaaactgttctcccaccgtggtctcccaaagtgctgggattacaggcgcgagccatggtgcctggcctaaggtgggatcttgagcatgtcttttttctggacctcattttcctcacttggtaaaatggcagtcagctctgccctgctgtcctgtgtgccaggtcctgggttagatgctgccaccaaaaggatgaataaggtaccacagaggatgaggagtcggggctggcaatgcacaccagcctgcactgccacacttccaccttgctcttcatcaggcatgaaggagagctgtcatagaagtttgctttgattgattggaacctgaacaactgcagatggggctgtgcccttgcctgcctggtggcttctttgatactgacagtggtgatcctgggagagaacaaatctgagtctacccgctgggtagctgaggctcagctggagaaggaacctgcccacaaccatgcagtgcatgagtggtggtgtctcgtctttgtaccctctagtactctaaccactaccccatactccctttctcatgccactttgctttctatctactggtatccccacttcggttttaagggtagggacttccttaatctggatctccagcctccagcacagcatcatctaattatagtaaaggacctattgtttgtcaaggacggctgtgacaggagtacccaccttgttgtccagtctggcctgggtacttgacacacattatttctgt

SEQ ID NO: 29178 - DNA, 1026 bp, Homo sapiens
cttgaactggcctcaagcgatcctcctgctttggtctcccaaaatgctaggattacaggcgtgagccaccacaccaggcccccaggtcagggttaaactcagagcttctgactcccagtctgaaacttttttcttggcctcaaacaataggacagagcctgtcaggtgtgggttgaactctgctcctccttaggaaggaagtctcaagcttggcctaagctttgagaattctggggggcagagcgtgaggtctgaaaggggctgttgtggcaggcagggcggccacaacagcccctttgctctgttgtgtgggtgcagccgggagtcagccggaacgttgagcctggcagggagagtggacccgcgcagagctcagtctagatggctgggaggcttgtggggagaagacggttgagtcctgacagggccggaccccagggcaggtttggactgccattttggctctgatgaggaagggaggggtggggcctccggggaaatggggtctaggaggaggaggagctgtgagaggccagtggcagtgacccggtctctgttcttgaaaactgacagatactcctgtctatgtctggagctaatgggcaaagtcttagtgtcatagttgggtagccaggcatcccaggcctgaggtgtggagggttgtagatggcggacagggtggacaggtgaaggggatgctggtcctgattccctgtgccttagtggggctgagggcacagagggaagtagcgaaatctagctgtgaacttggtcactctcctgagcctgtttcttggttgttgttaaatggctttcttggttgttgttgttgttaaatggcaggaatgatgagatatgcatgttgcggggacttagtaggaattacgatgctgggaaagccaggatcctttgaaaagaaccagcgctgccctcttgtgatgttgtcattcacttactcatcaagtaattgtggagcacctaacaagtgccaggtgctgcaggaggtgaggaggtggtgcagtgaac

SEQ ID NO: 29179 - DNA, 1030 bp, Homo sapiens
tcactgtgttagccaggatggtcttgatctcctgaccttgtgatccgccctactcagcatcccaaagtgctgggattacaagtgtgagccactgcgcctggcctatctgatttcttgtattgtaacgatagtgcatatacatttatttatttattgagacagagtcttgctctgtcgcccaggctggagtgcactgactcaatctcggttcactgcaacctccgccaccccagttcaggctattctcccatctcagcctcccaagcagctgggatgacaggcgtgtgcgccaccacactcggctaatttttgtatttttagtagaggcagtgtttcaccatgttggccaggctggtcttgaactcctggccttaggtgattcacccacctcggcctcccaaagtgctggaattacaggtgtgagccactgtgcgtggcctatagctcattttaaatataccataatttggccgggtgtggtggctcacacttgtaatctcaataaatatactgtaatttgtctgggtgtggtggctcacgcctgtaatcccaacactttgggaggctgaggcgggcagatcacttgaggtcaggagttcgagaccaccctggccaacatggcaaaaccccatctctactaaaaaatacaaaagttagctgagtctgtggtggcatgcacttgtagtctcagctgcttgggaggctgaggcacgagaattgcttgaaccggggaggcagaggctacagtgagctgagattgcaacactgcactccagtctgggcaacagagtgaaactctatctcaaaaaaaataaaataggggccgggcgcggtggctcacctctataatcccagtactttgggaggccgaggcaggtggatcacaaggtcgggagatagagaccatcctgactaacatggtgaaaccccgtctctactaaaaaaatacaaaaaattagccaggcgtggtggcaggcgcctgtagtcccagctactctggaggctgaggcaggagaatggcgtgaacccg

SEQ ID NO: 29180 - DNA, 1069 bp, Homo sapiens
tgcccactgcagccttgacctcctgtgctcaggtgatcctcctgcctcagcacccctgagtagctgagtagtggggactacaagcatgtgcatgcccagctaatttttttgttttttgtagagacattgttttgccatgttgcccaggctagtttcaaacttctgtagcaatcctcctgtgttggcctcccaaagtgctgggattataggcatgagccactgtacctggcccgaagacttaattttgttagtgctccagaattaggtaggcccctagaactgatgaactctcttttttttttttttttgagatggagtctcgctctgttgcccaggctggagtgcagtggcgcaatctcagcccactgcaacctccacctcttgggttcaagcgattctcctgcctcaacctcctgagtagctaggattacaggcacgtgctaccacatccaactaatttttgtatttttagtagagttggggtttcaccatgttggtcagaatggtctcgaactcctgacctcgtcatctgctcgccttggcctcccaaagtgctgggattataggcatgagccaccgcgcctgggtgaactgatgagctcttacaagacctgatgtaccagatgctgacattagtttatatagaggggtagacctttcctgttactggaatactgatgtctttaactgggtagttaaacagttttatttcaaggatgcgcttactggtagttattgacttattttcaggtcacatgtacttaagcattgtaattattttatatagtcatcccttgttattgagggaattggttgcaggactccccgtggattccaaaatccgaggatgcccaagtcccttaaataaaatggcatagtatttgcatataacctacacacatcctcccctatactttaagtcatctataggttactcatagtacctaatacaatgcctatgcatcacttcattcacatggcttcaatgtagtacttggcacatggcaaattcaggttttgctttttgaaacgggaatttctttgtttttcctgaatatttgagatttga

SEQ ID NO: 29181 - DNA, 1048 bp, Homo sapiens
ggggtcaagcgatctttcacctctgcttcccaagtaactgggaccctgtgctgccatgcccagctaatttttttgtttttttttgtttggtagagatggagtctcactatgttgcccaggctggtctcgatctcctagggtcaagtgattctcccacctcagcctcccaaagtgctgggattgctacagatgtgagccactgtgcctggcctgaatatacgtattgttaattctctgatttcaatggcagggactgcttatacttctaatgtatacttactgcattctggtttttgttaaaatttgatatttatgcccattactttcactgattcattacccctgaaggtagggatcttgccttattttagtgccatatacaaattcagtgcacatattttgagcaactaataggtactgagcacttatggagcttccatttagtggtaagtaaatattaattgaattttttttttcagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtcagtaatattttaagatcagcttttcccttatatatgagaatatcagtactctgatcaaagaggactgtggagaaggaagcaagttacatcttgtctaggagtatgctttcctccataaggggaccttgctcgatgtggactttgttaaatgggttaaacagctctggggtgaaaaagggtccttctgttagtcttgtggtaaaggcagccactgacattcttctgatttttctttccatttgactccctgcctctgatcaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcat

SEQ ID NO: 29182 - DNA, 1026 bp, Homo sapiens
ctacagtctgaaacttttttgagcaccgacctaatgttcaaaggaagtgcttattggagcattatgggttgttagatttttgggttgggaatattcaaccagtaagtactataaaatgcaaatattccaaaaaaaatctgaaatctgaaacatttctggtcctaagcaagcattttgcaaagggatacgcaacctgtagtacgttctttatcattgttttaagtagttaatatattgtggtacagattctgaggtggtatagcaaattcgattgtattattaaaaagcatatttatattttgagagcttgcttaggattattggagagaataaaacagtgaagctttggtgttatgagggaattttagatagaaaagtgcagtttttcagttcatgctctttcattttttactccctcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcaggtaggtagagatgccttttgttgttgttgtttttgagacagggtctcattgtgtcgcccaggctggagtgcagtggggcgaacatgactcgctacagccttgacctcctggactcaagcgatccttctgtctcagcctcccaagtagctgggatcacaggcatgtgacatcacacccagctaatttatttatttatttattttttaagagactggatcgactgggcacagtggctcatgcctgtaatcccagcactttgggaggccgaggcaggtggattaccgaggtcaggagttcaagaccagcctgaccaacatggagaaaccccatctctactaaaaatacaaaatgagctgggcatggtggtgcatgcctgtaatcccagctactcaggaggctgaggcaggagaatcacttga

SEQ ID NO: 29183 - DNA, 1050 bp, Homo sapiens
aaagttagattggaggaatctagaattcaggagctagtccagtatacaagtagataatgagaactcaaaaacaatgcacagggctgcagtctaataacagatgtactatagctttttttagaaacaaaattttctctttacagtgatcacataggaataacagatttaaaaaccatttaaggctaggaagcaaaaccaaggcagactttagattttacttaacagtcttaaggttcctgggcctgccaggaagtgacagattttactcattcactgtaaggctgggaatctttgaaggcaggctttctatgtacattctcaagtatgatattctagttaaagccctggtaatataagcaatatttgttgtattctgttataagagagaacaggctgggcacagtggctcacgcctgtaatctcagtacattgggagcccaaagtgggcagatcgcttaaggccaggagttcgagaccagcctggccaacatggtgaaacgctgtctctactaaaaatacaaaaattagtcagacatggtagtgctcgcctgtgatcccagttactggggaggctgaggcgcaagaatcacttgaacctgggaggtggaggttgcaagatctgagatcgtgccactgcactccagcctgagcaacagagtgagactctgtctcaaaataaaaaaaaaagagagagagcaaagtcttactggacttttgcaaataaccacattgccgtaagaatactcatgaatagaccagcatggtggctcacgcctgtaatcctttcactgtgggaggccatggcagcctgatcacttgaacccaggagttcaagatcaacctgggaaacatgcccaaaccccatctctactaaaaaatacaaaaattagctgggtgtggtggtgcatgcctgtactcccaggcccttgggagactgaggaaggagaattgattgagcctgggaggtcaaggctacagtgagccatgattataccactgtactccagagggagaccctgtctaaaaaataaaaaataaaataaaaaaaag

SEQ ID NO: 29184 - DNA, 1067 bp, Homo sapiens
aatattccaaatatatgtcataaacacattactctggcagggtggctcatgcctgtaatctcagcactttgggaggccaaggcaggaggattgcttgagctcaggagtttgagaccagcctaggcaatatagcaagatcctacctctacaaaaagattttaaaaattataatagctgggcatggtgacatgtgctggtagtctcagctacacaggatgttgaggtaggaggcttgtttaagcccaagaggttgaggctgcagtgagcctggatgacagagtgagaccctgtctcaaaaataaataaataaatacagaaaagaaaagaaaattatcttcatcagtttttaattgagttctgtttgattttgattagagatttcaggaattcatcagtttcttcattagagttctgaaaattctttatttagtccatagatcttaaagtttttaagtttttagaaacttgtatttaagattacttgttagagtcttcttatgaatctgattgcaaatgctcttagagaagaatcagaaccacagatgacaaagacttggaacaaccatggttgaaaatcttttttttttaggcgactaattttttttttttttttttttttgattcgcagtctcgctctgttgcccaggctggagtgcagtggtgcgatctcggctcactgcaacctctgcctcctgggtacaagcgattctcctgcctcagcctcccaagtagctgagattacaggcacatgcctccacgcccggctaattttttttgtatttttagtagagacggggtttcactgtgttagccaggatggtcttgatctcctgaccttgtgatccgcccacctcggcctcccaaagtgctgggattacaggcatgagccaccatgcctgtccccatggttaaaaatctaatggaagttcattataatcagcagtggacaaggaaatttgtcaatttgttatttatgtgtcgcaagcaatacagaaggttaccagggtgtaaaaacaaaaaaatcttaaccctttcatagctcaggttttatgaaaaagttgtgaatt

SEQ ID NO: 29185 - DNA, 1118 bp, Homo sapiens
ggcactgcgaagccactcagccctggcgggattccctcaggtgctggaggactcccggacagtgctcaccgctgctgatgtgctcccagatgggcccttcccccaggacgagaagctgaaggatggtatggtctgccctgccccgccctgtcctccgcaccacccgatcttctctagctgctccttctctcctgttcttgtcactctttttttctccccggaagtgccctcttgtggcaccttctaagtggtccccttgggcagatgggcgtttcgtgagtggcctccctaattaactggctactttttagcaatagcatttctttttttttttttttttttttttttgagacagagtctcactctgtcgccaggctggagtacagtggtgtgatctcggctcactgcaacctccacttcccgcgtacaagtgattctcctgcctcagcctcccaagtagctgggactacaggcacatgccgccacacccagctagtttttgtattcttaatagagacgaggtttcaccatgttggccaggatggtctcgatctcttgacctcatgatccgcccacctcggcctcccaaagcgctgggattacaggcgagagccactgcacccggccacaatagcatttcttagattacactgagaggatgcggacagctcttatatattaaatagtagatactttacaaccatgaactcaaatctccaccataactctgggggaagacactgttctctctactttctatatgaaagaggacaagtgatttgccttggctcttccctctgaatcaggctgacttcctgagttctttgaggttcaagattattctgaagccccggggtccctgcctgacatgtctcagacccaccctggcatatctttggagtctacttatctttctgcgtggcctcttagtgctggtgagggctgcctgggccctttctgacaggctggctccaatagggactgcttagacctgtttacacagttacacttttggctaacctggatctgggggacttgctaccatgatggacacatgttccttggtgagcaggtctgtgcaaacctaccctccaaggccaagggagctgagagcgcca

SEQ ID NO: 29186 - DNA, 1024 bp, Homo sapiens
gtgtttcttcatctgcagatggcccaggagctggggatcagtgagaaagactccaacttccagaacccatttaaaatcgaccgcacagaggtgagctgccagggcctatgcctgtgtctgctttgcctctgctgggccataggacaccgaggcctgcaggggctggggaccttgggtggctttggacttggagccaggcagcctgggcctgggtccagaagatatcactgactcattggagcctgtgggcaagtcattgctcccctcttagcctcaggctccctgtctgttcacagcatgtgaactccagttatggggggtagttaggaggctatgaacaaacccatcccagcacaaaataggcatcccacttcaggtggatatcagggtagctagggagatcaggccatgctcttccctgcctttgaacctctgagcaccaactgggcttccatcccgcactcctgtacatgctctcattccaggggttccagggggctgaggtgggctttgagagctggagaccaagtttgggataaaagatgaggacaggccgggcacggtggctcacatctgtaattccagcactttgggaggccgaggcgggtggatcacctgaggtcaggagttcgagactagcctggccaatatggtgaaactctgtctttactaaaaatacaaaaaactggccaggcgtggtggtgcatgcctgtaatcctagctattcaggagactgaggcaggagaatcgcttgaacccggaaagtggaggttgcagtgagctgagatcgtgccattgcactccagcctgggcaacatgagtgaaactccgtatcaaaaaaaaaaaaggggggacagatacgatagatggaggaagggattggaagtgacagggctaggaggggcaggaaggaagggctgtggtggctggaggactggacttgtcaaaccctggtgtcgggaggggtgttgggtgtctcaagggtctaggatttaattctgcctccaggccaacaagctagcct

SEQ ID NO: 29187 - DNA, 1032 bp, Homo sapiens
gctgactggccttggcccacccctccctgtgctgcagcttcattggcaaaatgaatttgatggtatctgtatcccctgcccagccctaacctgtttctctgaggctggcctccctacggggctgcagcagcaaagggaagccaagccttagagaagcctcatggaagggcccagaacatcctgcacccatcagttactcggaagtaaggggacaagaagcagctggaagagagctgggtgtgggggctgggaggagtgctggagaaatttccccatcagaaggcccctcactgggcagtggaggcagggcagtgtggtgggactgactcaacagacatagtttcatctccaccctgcccttctcaggttgtgtgaccccagccacatggacacccgagtctgtgaactaaagggctggtccatggcattaacagtggagggtgtccaggttcttgatgtcttgaacaaagaattgggcaaaatgcacaaagcaaggaaggaatgaagggttttactgagaatgaaagtatactccacagcatgggagagggcctgagcatagggactcaaggggcccgttacagaatttttgggagtaaatacccactagaggattccattggttacttgaggtacaccctatgtaaatggaaaggatgaagtaaatttacaaattcatttacagcatataccctatggggaggatattccctgttatagctgaagcgtgaattggccttatgttccctgcctccagaccctattttcctgcatcaacgggaaagggtcagattcactggctcagctgtttaacctgtcctggtgccagcagctggagctgggtgtcaggaccagcccgcaagctcttccctgccggaaggaccaggccagtcgctgtccttttcatgctagagagtggttgtggttgctgacttagcagagaaggtgcttggctttccccttaactggagaaaaaactttctaagaaccaggcctggttggcagcagacctagctttcttggggtggcagg
